United States Patent 9,254,311 (MODIFIED POLYNUCLEOTIDES FOR THE PRODUCTION OF PROTEINS) - sequence listing, part 11

SEQ ID NO: 20632 - DNA, 480 bp, Artificial Sequence
  Description of Artificial Sequence: Synthetic coding sequence
atgaacagaaagaagctgcagaagctgaccgacaccctgaccaagaactgcaagcacctgttcagaggcttcgacaaggacaacgacggctgcgtgaacgtgctggagtggatccacggcctgagcctgttcctgagaggcagcctggaggagaagatgaagtactgcttcgaggtgttcgacctgaacggcgacggcttcatcagcaaggaggagatgttccacatgctgaagaacagcctgctgaagcagcccagcgaggaggaccccgacgagggcatcaaggacctggtggagatcaccctgaagaagatggaccacgaccacgacggcaagctgagcttcgccgactacgagctggccgtgagagaggagaccctgctgctggaggccttcggcccctgcctgcccgaccccaagagccagatggagttcgaggcccaggtgttcaaggaccccaacgagttcaacgacatgtag

SEQ ID NO: 20633 - DNA, 636 bp, Artificial Sequence; identical to SEQ ID NO: 20631
  Description of Artificial Sequence: Synthetic coding sequence

SEQ ID NO: 20634 - DNA, 390 bp, Artificial Sequence
  Description of Artificial Sequence: Synthetic coding sequence
tgagtgaacgtgctggagtggatccacggcctgagcctgttcctgagaggcagcctggaggagaagatgaagtactgcttcgaggtgttcgacctgaacggcgacggcttcatcagcaaggaggagatgttccacatgctgaagaacagcctgctgaagcagcccagcgaggaggaccccgacgagggcatcaaggacctggtggagatcaccctgaagaagatggaccacgaccacgacggcaagctgagcttcgccgactacgagctggccgtgagagaggagaccctgctgctggaggccttcggcccctgcctgcccgaccccaagagccagatggagttcgaggcccaggtgttcaaggaccccaacgagttcaacgacatgtag

SEQ ID NO: 20635 - DNA, 480 bp, Artificial Sequence; identical to SEQ ID NO: 20632
  Description of Artificial Sequence: Synthetic coding sequence

SEQ ID NO: 20636 - DNA, 384 bp, Artificial Sequence
  Description of Artificial Sequence: Synthetic coding sequence
atggagaccagcagcagagagctgcaggccgccgagtacctggagaagcaccagatcaaggaggtggtgagctacctgaccagcgccctgctgttcttcagacccgagaagcccaaggagtacctgatcagcctgctggagagactgagaatcgccaaggtgaccggcgtggccttccccttcttcatggacaacagcaacatcgtggccatgttcgagatgatggacagcagcggcagaggcaccatcagcttcgtgcagtacaaggaggccctgaagaccctgggcctgtgcaccgaggacgaggacctgcaggacgacggccacaagatcaccctggacaagttcaaggaggaggtgaacaagagaatgaaggagatctag

SEQ ID NO: 20637 - DNA, 450 bp, Artificial Sequence
  Description of Artificial Sequence: Synthetic coding sequence
atgagcagcatcaaccccaacaccagcggcatcctgctggagggcttcctgaacatcgtgagaaagaagaaggaggcccagagatacagaaacgaggtgagacacatcttcaccgccttcgacacctactacagaggcttcctgaccctggaggacttcaagaaggccttcagacaggtggcccccaagctgcccgagagaaccgtgctggaggtgttcagaggcctgagaatcttcagcaagtgcctgctgtgccacatcgaccagaagagcaagaaccccagcagcggcctgctggccgccgacagcatcatccaggcccaccccagccccgtgcagatcctgagacagatgtacatcaacaacgagctggagggcagaggcttcatctgggacagcagcatcagctggagattcatgtggaacatctacggcaccggcgagtactag

SEQ ID NO: 20638 - DNA, 492 bp, Artificial Sequence
  Description of Artificial Sequence: Synthetic coding sequence
atgttcttcagcgaggccagagccagaagcagaacctgggaggccagccccagcgagcacagaaagtgggtggaggtgttcaaggcctgcgacgaggaccacaagggctacctgagcagagaggacttcaagaccgccgtggtgatgctgttcggctacaagcccagcaagatcgaggtggacagcgtgatgagcagcatcaaccccaacaccagcggcatcctgctggagggcttcctgaacatcgtgagaaagaagaaggaggcccagagatacagaaacgaggtgagacacatcttcaccgccttcgacacctactacagaggcttcctgaccctggaggacttcaagaaggccttcagacaggtggcccccaagctgcccgagagaaccgtgctggaggtgttcagagaggtggacagagacagcgacggccacgtgagcttcagagacttcgagtacgccctgaactacggccagaaggaggcctag

SEQ ID NO: 20639 - DNA, 420 bp, Artificial Sequence
  Description of Artificial Sequence: Synthetic coding sequence
atggtgttcaaggcctgcgacgaggaccacaagggctacctgagcagagaggacttcaagaccgccgtggtgatgctgttcggctacaagcccagcaagatcgaggtggacagcgtgatgagcagcatcaaccccaacaccagcggcatcctgctggagggcttcctgaacatcgtgagaaagaagaaggaggcccagagatacagaaacgaggtgagacacatcttcaccgccttcgacacctactacagaggcttcctgaccctggaggacttcaagaaggccttcagacaggtggcccccaagctgcccgagagaaccgtgctggaggtgttcagagaggtggacagagacagcgacggccacgtgagcttcagagacttcgagtacgccctgaactacggccagaaggaggcctag

SEQ ID NO: 20640 - DNA, 357 bp, Artificial Sequence
  Description of Artificial Sequence: Synthetic coding sequence
atggtgttcaaggcctgcgacgaggaccacaagggctacctgagcagagaggacttcaagaccgccgtggtgatgctgttcggctacaagcccagcaagatcgaggtggacagcgtgatgagcagcatcaaccccaacaccagcggcatcctgctggagggcttcctgaacatcgtgagaaagaagaaggaggcccagagatacagaaacgaggtgagacacatcttcaccgccttcgacacctactacagaggcttcctgaccctggaggacttcaagaaggccttcagacaggtggcccccaagctgcccgagagaaccgtgctggaggtgttcagaggcatcttcagcgcctag

SEQ ID NO: 20641 - DNA, 2355 bp, Artificial Sequence
  Description of Artificial Sequence: Synthetic coding sequence
atggagaccaaggtgcacctgttctgccaggccgaggagaacatcgacctgctggacgacggcagcaacagcttcgccaccgacctgagcagcggcaccatcaaccacaagaagtacatcaagttcagcaagaccatcgagaaggagatcagccccgagatcagaagcctgagccccgagtacaagaagatcttcgagaccagcatcatcttctgcggcgaggagaagagcagcgacttcagcggcgagaagaaggtgggcagaaagagcctgcaggtgcagcagcacagcaagagaaccgagatcatcccccccttcctgaagctgagcaaggagaaggtgaccagaaaggagaacagcctgtgcaagctgcccaaccagtacagcgtgcacaagaccagcagccccctgtgcaccagcagcgccatcaccagagagaaggagatgctgagcaacctgtacatgaccctgtacgacgaggtgacccacggctacctgcacagcaaggagctgagcggcaaccacatggtggacatcggcgacatcatcttcaccctgaacgagctgcaggagcagtacgaggacgtgagcatcaccgagggcagccccctgaacgagatcaccagcgacagaaagctgagcagcgtggccggctgctacctgaagtacaagaagaagaacagcctgagcagcaagctgcccgagcccagcatcagcaagaagctgaacaagaagagcaaccagtactacagcaagatcatggagaacgacgacctggagagcaagagacccaagaacacctggcagatcagaaagttcctgggcggcgtgggcagcagcaacgtgggcgtgcaggagccctacagcaagaacggcatcaacttcaagaagcacagcgagaagggcgagatccacgacagcaagagcaagccccagagcctgaagagcagcaccagcctgagcaagagcctggacaagagcgacatcagcagcatccccaagctgcagaagcccgccgtgagaaagcacagcagcctgcagaagcaggtgagcagcaccgagaagaccgccatcagcaccctggagaacttctgcgaggccatcagcaagctgcaggagaactacatcgccgccgaggagctgcagagcatcctgcccagcaccggcatcaacctgctggacgaggagttccagaagatcgtgaccgacaccagcagaaacgagaacggcatggtggagctggacgacttcgtgaacgccctggccaaggagagaagcttccccgagtgcaacgccctgcccggcgtgatcaaggccatcgacaagatcaaggacaagaacgtggactacgaggacctgaacacctgcctgcagaacttcggcatctacctgagcaagcccgagttcaagaagatcaccgagctgaccgaggccggcgagaccaagaaggtgaacttcaaggagttcatcgacaccatgatgagcaacaccgagtgcttcagcgagaagctggtgctgcccgacgccatcgagaccctggacgacctgagaaaggagaccatgagcgtgagcgacctgtggaacaccctgagcagcctgaacagcaacctgaagaaggacgagttcctggccgccctggagctggtgaccgtggacgagggcgacaaggtgcagttcgaggagttcgccaaggtggtgagaaacatgagagacgccgccagactggaggagctgcaggaggtggtgctggccgccgacctgctggagggcgacatgatcgccggcaagaacctggaggacttcctgagaaacgtgggcatcaagagccccaaggaggaggtggagaagatcctgcagagcgacttcgtgagcgaggacaacatggtgaacatcaaggactgcatgagagccctgagagacacccagaagttcagcaactacatcgacttcagaaaggaggccagcaacctgaagctgcccaaggtgaacgagatcaaggaggccgccaacatcctgagccacgtggacaacggcaagatcggcatccccgacctggagcacgccctgaagtgcctgaacgtgaacctgaccgaggaggacttcaacgaggccctgaactgctgcaacgtgagcgacaacatggaggtggacctgaaggacttcctgatgaagatgaaggagagcccccacttccagaagagcaaggccacccagatcctgctggccaccacccagatcctgcagaacgacctggtggacgtgagcgacctgaagaccctgctgatggacaaggacctgcacaccgccaacgccatcctgaccgtgatgctgagacacgtgcccgagcacggctag

SEQ ID NO: 20642 - DNA, 810 bp, Artificial Sequence
  Description of Artificial Sequence: Synthetic coding sequence
atgctgggccccggccaggtgagactgagacccagagtgtggagagacaaggccggcggcagagtggccgacggcgccagcggcctgccccccgccagaggcagctggagagagaccggcaccggcagagccctgggcgccagcagcccccccagacccgcccagggcagcagcagccccggcatccagagcggccccagcagcagacccggcagccccagaggcgccgagcaggccggcacccccagacccagactgagcctgggcatcagccaggccaccggcagcgccgccagatggagaaccagaagaaccggcaagggcctgggctacaacagcgacgagatcagacccagaaccctgctgatcgagcacctgatggagggcggcagaagagaccaccacaccatgaccgtgctgtggggcacccaggagatcatcgtggccgagttccacaagaagatcaaggaggccttcgaggtgttcgaccacgagagcaacaacaccgtggacgtgagagagatcggcaccatcatcagaagcctgggctgctgccccaccgagggcgagctgcacgacctgatcgccgaggtggaggaggaggagcccaccggctacatcagattcgagaagttcctgcccgtgatgaccgagatcctgctggagagaaagtacagacccatccccgaggacgtgctgctgagagccttcgaggtgctggacagcgccaagagaggcttcctgaccaaggacgagctgatcaagtacatgaccgaggaggacggcgtgagcctgagaagacccggctag

SEQ ID NO: 20643 - DNA, 489 bp, Artificial Sequence
  Description of Artificial Sequence: Synthetic coding sequence
atggccgacgagaaggacagagaggagatcatcgtggccgagttccacaagaagatcaaggaggccttcgaggtgttcgaccacgagagcaacaacaccgtggacgtgagagagatcggcaccatcatcagaagcctgggctgctgccccaccgagggcgagctgcacgacctgatcgccgaggtggaggaggaggagcccaccggctacatcagattcgagaagttcctgcccgtgatgaccgagatcctgctggagagaaagtacagacccatccccgaggacgtgctgctgagagccttcgaggtgctggacagcgccaagagaggcttcctgaccaaggacgagctgatcaagtacatgaccgaggagggcgagcccttcagccaggaggagatggaggagatgctgagcgccgccatcgaccccgagagcaacagcatcaactacaaggactacatcaccatgatggtgatcgacgagaactag

SEQ ID NO: 20644 - DNA, 402 bp, Artificial Sequence
  Description of Artificial Sequence: Synthetic coding sequence
atggccgacgagaaggacagagaggagatcatcgtggccgagttccacaagaagatcaaggaggccttcgaggtgttcgaccacgagagcaacaacaccgtggacgtgagagagatcggcaccatcatcagaagcctgggctgctgccccaccgagggcgagctgcacgacctgatcgccgaggtggaggaggaggagcccaccggctacatcagattcgagaagttcctgcccgtgatgaccgagatcctgctggagagaaagtacagacccatccccgaggacgtgctgctgagagccttcgaggtgctggacagcgccaagagaggcttcctgaccaaggacgagctgatcaagtacatgaccgaggaggacggcgtgagcctgagaagacccggctag

SEQ ID NO: 20645 - DNA, 1317 bp, Artificial Sequence
  Description of Artificial Sequence: Synthetic coding sequence
atggccgtgagcgagatcaagcccaagctgaagctgaaccccctgaccaaggtgcccatcagccacaacaagagagacagagacctgcccggcagcctgcagtgccagctgcagcacaaggagaagaagctgagcgccagccagatggccgccttccaggacgcctacaacttcttctacaaggacaagaccggctgcatcgacttccacggcctgatgtgcaccgtggccaagctgggcatgaacctgaccaagcacgacgtgtacaacgagctgaagtgcgccgacatcgacagagacggcaaggtgaacttcagcgacttcatcaaggtgctgaccgacaagaacctgttcctgaaggccgtggtgcccgagaaggagacctgcctggacctggccggcaaccccggcatcctgctgttcgagatcctgagcagactgctggagaccagcgccctgcccagaaagagcatcatcgagatcgtgagctacttccagagaaagttccagcacaccggccccggcatgctgtggagcccctacaccatgggctacggcaagagaaccctgaagcccgacatctgcaccccccccagcagcagcatggccgccttcgccaacgccgccagaatcgccatcatgaaggagaaggacctgttcaagttcctggaggagctgaagagatgcaacagcggcagcgacagcccctacagcaagatccccatcttccccctgttccccaacgtggacggcgtggtgatgggcaagcccttcaaggacatgcagaagctggagatgctgagaatcaaggagcccctgcacttcttcgaggactacttcttccacaagagagactggaagacccaggccgccaacatcaagagcatggaccccgccagcggctacagcaacaacatcttcaccatcgaccagatgctgaagaagaagcagacctgcaccgtggccgacgccaccgccatcaagcagcacgtgaagagagccaccgacacctacaacctgggcatcgccctggagcacagaaaggagatgctgaacctgtggcagaagatcagaggcgacctgatcggcatggacagcagaaacgagagcttctacgacaccttcagcacctacacctggagctggaacgtgtgccaggagctgctgagccccaaggacctgagactgtacgacgcctacgtgaacagaaacagcagccacaacagcagaagcagcagcagcagcgacaccagcgagtgctacaccgacagcggcagaaagagaaagagaaagggcctgaagggcttccagcagtag

SEQ ID NO: 20646 - DNA, 489 bp, Artificial Sequence
  Description of Artificial Sequence: Synthetic coding sequence
atggccgtgagcgagatcaagcccaagctgaagctgaaccccctgaccaaggtgcccatcagccacaacaagagagacagagacctgcccggcagcctgcagtgccagctgcagcacaaggagaagaagctgagcgccagccagatggccgccttccaggacgcctacaacttcttctacaaggacaagaccggctgcatcgacttccacggcctgatgtgcaccgtggccaagctgggcatgaacctgaccaagcacgacgtgtacaacgagctgaagtgcgccgacatcgacagagacggcaaggtgaacttcagcgacttcatcaaggtgctgaccgacaagaacctgttcctgaaggccgtggtgcccgagaaggagacctgcctggacctggccggcaaccccggcatcctgctgttcgagatcctgagcagactgctggagaccagcgccctgcccagaaagagcatcatcgagatcgtgtag

SEQ ID NO: 20647 - DNA, 525 bp, Artificial Sequence
  Description of Artificial Sequence: Synthetic coding sequence
atggccgtgagcgagatcaagcccaagctgaagctgaaccccctgaccaaggtgcccatcagccacaacaagagagacagagacctgcccggcagcctgcagtgccagctgcagcacaaggagaagaagctgagcgccagccagatggccgccttccaggacgcctacaacttcttctacaaggacaagaccggctgcatcgacttccacggcctgatgtgcaccgtggccaagctgggcatgaacctgaccaagcacgacgtgtacaacgagctgaagtgcgccgacatcgacagagacggcaaggtgaacttcagcgacttcatcaaggtgctgaccgacaagaacctgttcctgaaggccgtggtgcccgagaaggagacctgcctggacctggccggcaaccccggcatcctgctgttcgagatcctgagcagactgctggagaccagcgccctgcccagaaagagcatcatcgagatcgtgagctacttccagagaaagttccagcacaccggcccctag

SEQ ID NO: 20648 - DNA, 1473 bp, Artificial Sequence
  Description of Artificial Sequence: Synthetic coding sequence
atgaaggagctgatgccccacctgaccttcaacggcaacggcaagatcaacgtgaacagcatcatggagggcctgaagaagttcaagcccaagggcatggtgaccctgcacaagctgaagaccgccaacgacatcaaggacagagtgaccggccacatggccgtgagcgagatcaagcccaagctgaagctgaaccccctgaccaaggtgcccatcagccacaacaagagagacagagacctgcccggcagcctgcagtgccagctgcagcacaaggagaagaagctgagcgccagccagatggccgccttccaggacgcctacaacttcttctacaaggacaagaccggctgcatcgacttccacggcctgatgtgcaccgtggccaagctgggcatgaacctgaccaagcacgacgtgtacaacgagctgaagtgcgccgacatcgacagagacggcaaggtgaacttcagcgacttcatcaaggtgctgaccgacaagaacctgttcctgaaggccgtggtgcccgagaaggagacctgcctggacctggccggcaaccccggcatcctgctgttcgagatcctgagcagactgctggagaccagcgccctgcccagaaagagcatcatcgagatcgtgagctacttccagagaaagttccagcacaccggccccggcatgctgtggagcccctacaccatgggctacggcaagagaaccctgaagcccgacatctgcaccccccccagcagcagcatggccgccttcgccaacgccgccagaatcgccatcatgaaggagaaggacctgttcaagttcctggaggagctgaagagatgcaacagcggcagcgacagcccctacagcaagatccccatcttccccctgttccccaacgtggacggcgtggtgatgggcaagcccttcaaggacatgcagaagctggagatgctgagaatcaaggagcccctgcacttcttcgaggactacttcttccacaagagagactggaagacccaggccgccaacatcaagagcatggaccccgccagcggctacagcaacaacatcttcaccatcgaccagatgctgaagaagaagcagacctgcaccgtggccgacgccaccgccatcaagcagcacgtgaagagagccaccgacacctacaacctgggcatcgccctggagcacagaaaggagatgctgaacctgtggcagaagatcagaggcgacctgatcggcatggacagcagaaacgagagcttctacgacaccttcagcacctacacctggagctggaacgtgtgccaggagctgctgagccccaaggacctgagactgtacgacgcctacgtgaacagaaacagcagccacaacagcagaagcagcagcagcagcgacaccagcgagtgctacaccgacagcggcagaaagagaaagagaaagggcctgaagggcttccagcagtag

SEQ ID NO: 20649 - DNA, 4140 bp, Artificial Sequence
  Description of Artificial Sequence: Synthetic coding sequence
atgaacgagagcgccagccaggaggagctgagacccgcccaggagaacagaaaggaggacaaggagagaaagtggaacctgaccgaggtgaaggagctgcacgagaccctgcagagcgtgcccgacgtgcccgtgaaggaggacaccaacagcgtggtggagaaggccatggacgagatcaagagccaggagctgaacctggagggccagagaaagatcagccccggcagcatcaaggacagcaagaccgaggccagcggcaacatcgccatcagaaagagcgccaaggtgatcttcgccctggacgagaccgagctgaagagcaagcccgagcacacctggaagaagaacctgttcgagagaatggaggccagagcccaggccatgcagcagaagatcatcgacaaggagaacctgaagaaggagctggagaagaaggccgagaagaagctgcccagagacaacctggccaaggagtggttcaacaccgacagcatgaccctgaacaacaccgcctacctgctggacaagctgctgcccaccctggtgcccggcgtggagaacatgctgacccaggtggagaagaagaaggtgctgaccgaggccgacacccccagcaagttcgaccccatcaactacctgggcgagtacctgatcagaaacaaccccaactacatcaaggaccccggcatgagcggctaccagagactgatgaaggaggtgaccgaggacctgaagatctacgtgcccgacaccatctgcaacagagtgagcaagatgaaggagaacgtgaagcagaacagaaagcagagagagagcatcgacaagatcatcgtgaaggtggccaacaccagaaagcaggccctgcaggagcagttcgacgagtggatcctggaccccaagggcatgatccccaagagcgtgatccagaacgtgctgcaggagttcttccagaaccccgacttcaagctgggcagccactgcaagcagctggacatcaccgacagcaccgagcccagactgaacaagatggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggaagatgaagtacgtgaccttcgaggacgaggagcaggccaacctgatctacggcaacagcagattcaccgccaagctgcacatccagttccccaagccccaccccggccacgaggtgagactgagcagcaagcagttccagaactacatcgagctggtggtgagcgagctgagaggcaacgaggaccaggtgctggagagcgtggtggagttcctgatgaacgccctggagagaagccacatcgagagcctgagaaacagcgccagaagaaagtggctgcaccagatccagtgcgccgccgagaccagcggcgtgagcctggagcccgtgtacagcgagaccttcaaggccctgatgcaggacgccgaggcccacggcaacaagaagatcagcgcccacatcagcctgctggaggagaacctgctgctgcccgagaagggcaacgtgctgctgagaaacgtggcctgcaccctggacgacgcccagttcgtgctgaacagagtgctgtacagagacatgaagggcatcagcttcaccgtggtggacgagggcaagcccatccacgtgccccaggtgcagtaccacggcaacatcttcttctggaaccagagcagaaacaagcacgactacaacggcagcttcctggccctgcccctgcaggacgcctacatgagaatcttcggcgtgctggccgtggacaccctgagagacccccacgagatcaacatcttcctgccccacgagatcagattctaccagggcgtggccaacgtgttcagcaccgcctaccactacgtgcacagcagagagcacatcctgcacatcgtgatcaccggcatcggctggctgtacgacgtgaccagcagcatcaccagcatcaccacctacttcgtggagcccagccccgcccaggacagcgactacgtgctgagaaacatgatggtgaccggccagctgggcctgaccgagatccacaagaacccccccaccatccacagaaagagctgcatcttcagagacttcctgttcaagtgcaccgacagcagcgaggtggtgctggccagcgcctgcggcgagacccacatcgtggtgcccctgagagagagaaccggcgaggccctgggcgtgctggacttcaacatcggccagaacagaatgctgctgtgccaggagtacaaggacctgcagaagatgatgaaggtggtgcaggtggcctgctacgagatcctgggcgagttcagcggcgagatcaagaagaagtacatcctggagatcgagaacgtgagagaggtgcagagagccggcatcctgttcttcagaatcatgctgctggagctgcaggagagcatccagctgctgaacagcatggagttcgtgagcctgctgctgtacgaccacaccctggtgaccgagcccaacagcccccaggacagcaagagcatggagctggaggccaacgtgaagctggtgagagacatcctgaaggccgtgatcctgttcttccaccccgagctggagttcagcagcgacttcggcagctgggacaagtgcaagttctacgtgaacaagtacctggtgaacaacatctgcgccttcgaccccaccgccaagcacgtggaggtgaacgtgcagctgatcgacgagtacatcagagaccacagcagaaccgaggtgtggaagttcggcaacgtggtgatcgagcacctgtaccactggatccacatctgcagcgccctgatgaagatcaccaagcagctgaacagcggcatcaccccccccctgcccagcaagaccgacaactacatgtacgccaagatgcccggcgagggcctgcaggagaagtag

SEQ ID NO: 20650 - DNA, 2781 bp, Artificial Sequence
  Description of Artificial Sequence: Synthetic coding sequence
atgaacgagagcgccagccaggaggagctgagacccgcccaggagaacagaaaggaggacaaggagagaaagtggaacctgaccgaggtgaaggagctgcacgagaccctgcagagcgtgcccgacgtgcccgtgaaggaggacaccaacagcgtggtggagaaggccatggacgagatcaagagccaggagctgaacctggagggccagagaaagatcagccccggcagcatcaaggacagcaagaccgaggccagcggcaacatcgccatcagaaagagcgccaaggtgatcttcgccctggacgagaccgagctgaagagcaagcccgagcacacctggaagaagaacctgttcgagagaatggaggccagagcccaggccatgcagcagaagatcatcgacaaggagaacctgaagaaggagctggagaagaaggccgagaagaagctgcccagagacaacctggccaaggagtggttcaacaccgacagcatgaccctgaacaacaccgcctacctgctggacaagctgctgcccaccctggtgcccggcgtggagaacatgctgacccaggtggagaagaagaaggtgctgaccgaggccgacacccccagcaagttcgaccccatcaactacctgggcgagtacctgatcagaaacaaccccaactacatcaaggaccccggcatgagcggctaccagagactgatgaaggaggtgaccgaggacctgaagatctacgtgcccgacaccatctgcaacagagtgagcaagatgaaggagaacgtgaagcagaacagaaagcagagagagagcatcgacaagatcatcgtgaaggtggccaacaccagaaagcaggccctgcaggagcagttcgacgagtggatcctggaccccaagggcatgatccccaagagcgtgatccagaacgtgctgcaggagttcttccagaaccccgacttcaagctgggcagccactgcaagcagctggacatcaccgacagcaccgagcccagactgaacaagatggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggaagatgaagtacgtgaccttcgaggacgaggagcaggccaacctgatctacggcaacagcagattcaccgacctgcacagcatcatcagaaacatccagagctgcaaggaggtgaagggcagaaccgccttcaacggcgtgagcttcaacctgctgcagttcgtgcagctgctggagaccttcgtgggcgaggacgcccccctgagcgtgagcgagaccctgaccagcttcttcaaggagggctacgtggagaccgagcaggagaagatgaacgccctggagcagttcagccagaacgccttccaggtgagacagagactgctgctggaggccatcttccagaagtgggacagcgacggcagcggcttcctggacctgaaggaggtggacgagctgctgtacacctacaaggagggcatggagaaggagagcatgaagaagggcctgaccctgagccccggctggagcgccgtggcccagctgtag

SEQ ID NO: 20651 - DNA, 2928 bp, Artificial Sequence
  Description of Artificial Sequence: Synthetic coding sequence
atgaacgagagcgccagccaggaggagctgagacccgcccaggagaacagaaaggaggacaaggagagaaagtggaacctgaccgaggtgaaggagctgcacgagaccctgcagagcgtgcccgacgtgcccgtgaaggaggacaccaacagcgtggtggagaaggccatggacgagatcaagagccaggagctgaacctggagggccagagaaagatcagccccggcagcatcaaggacagcaagaccgaggccagcggcaacatcgccatcagaaagagcgccaaggtgatcttcgccctggacgagaccgagctgaagagcaagcccgagcacacctggaagaagaacctgttcgagagaatggaggccagagcccaggccatgcagcagaagatcatcgacaaggagaacctgaagaaggagctggagaagaaggccgagaagaagctgcccagagacaacctggccaaggagtggttcaacaccgacagcatgaccctgaacaacaccgcctacctgctggacaagctgctgcccaccctggtgcccggcgtggagaacatgctgacccaggtggagaagaagaaggtgctgaccgaggccgacacccccagcaagttcgaccccatcaactacctgggcgagtacctgatcagaaacaaccccaactacatcaaggaccccggcatgagcggctaccagagactgatgaaggaggtgaccgaggacctgaagatctacgtgcccgacaccatctgcaacagagtgagcaagatgaaggagaacgtgaagcagaacagaaagcagagagagagcatcgacaagatcatcgtgaaggtggccaacaccagaaagcaggccctgcaggagcagttcgacgagtggatcctggaccccaagggcatgatccccaagagcgtgatccagaacgtgctgcaggagttcttccagaaccccgacttcaagctgggcagccactgcaagcagctggacatcaccgacagcaccgagcccagactgaacaagatggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggaagatgaagtacgtgaccttcgaggacgaggagcaggccaacctgatctacggcaacagcagattcaccgacctgcacagcatcatcagaaacatccagagctgcaaggaggtgaagggcagaaccgccttcaacggcgtgagcttcaacctgctgcagttcgtgcagctgctggagaccttcgtgggcgaggacgcccccctgagcgtgagcgagaccctgaccagcttcttcaaggagggctacgtggagaccgagcaggagaagatgaacgccctggagcagttcagccagaacgccttccaggtgagacagagactgctgctggaggccatcttccagaagtgggacagcgacggcagcggcttcctggacctgaaggaggtggacgagctgctgtacacctacaaggagggcatggagaaggagagcatgaagaaggaccacagcagaaccgaggtgtggaagttcggcaacgtggtgatcgagcacctgtaccactggatccacatctgcagcgccctgatgaagatcaccaagcagctgaacagcggcatcaccccccccctgcccagcaagaccgacaactacatgtacgccaagatgcccggcgagggcctgcaggagaagtag

SEQ ID NO: 20652 - DNA, 4512 bp, Artificial Sequence
  Description of Artificial Sequence: Synthetic coding sequence
atgaacgagagcgccagccaggaggagctgagacccgcccaggagaacagaaaggaggacaaggagagaaagtggaacctgaccgaggtgaaggagctgcacgagaccctgcagagcgtgcccgacgtgcccgtgaaggaggacaccaacagcgtggtggagaaggccatggacgagatcaagagccaggagctgaacctggagggccagagaaagatcagccccggcagcatcaaggacagcaagaccgaggccagcggcaacatcgccatcagaaagagcgccaaggtgatcttcgccctggacgagaccgagctgaagagcaagcccgagcacacctggaagaagaacctgttcgagagaatggaggccagagcccaggccatgcagcagaagatcatcgacaaggagaacctgaagaaggagctggagaagaaggccgagaagaagctgcccagagacaacctggccaaggagtggttcaacaccgacagcatgaccctgaacaacaccgcctacctgctggacaagctgctgcccaccctggtgcccggcgtggagaacatgctgacccaggtggagaagaagaaggtgctgaccgaggccgacacccccagcaagttcgaccccatcaactacctgggcgagtacctgatcagaaacaaccccaactacatcaaggaccccggcatgagcggctaccagagactgatgaaggaggtgaccgaggacctgaagatctacgtgcccgacaccatctgcaacagagtgagcaagatgaaggagaacgtgaagcagaacagaaagcagagagagagcatcgacaagatcatcgtgaaggtggccaacaccagaaagcaggccctgcaggagcagttcgacgagtggatcctggaccccaagggcatgatccccaagagcgtgatccagaacgtgctgcaggagttcttccagaaccccgacttcaagctgggcagccactgcaagcagctggacatcaccgacagcaccgagcccagactgaacaagatggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggaagatgaagtacgtgaccttcgaggacgaggagcaggccaacctgatctacggcaacagcagattcaccgacctgcacagcatcatcagaaacatccagagctgcaaggaggtgaagggcagaaccgccttcaacggcgtgagcttcaacctgctgcagttcgtgcagctgctggagaccttcgtgggcgaggacgcccccctgagcgtgagcgagaccctgaccagcttcttcaaggagggctacgtggagaccgagcaggagaagatgaacgccctggagcagttcagccagaacgccttccaggtgagacagagactgctgctggaggccatcttccagaagtgggacagcgacggcagcggcttcctggacctgaaggaggtggacgagctgctgtacacctacaaggagggcatggagaaggagagcatgaagaaggccaagctgcacatccagttccccaagccccaccccggccacgaggtgagactgagcagcaagcagttccagaactacatcgagctggtggtgagcgagctgagaggcaacgaggaccaggtgctggagagcgtggtggagttcctgatgaacgccctggagagaagccacatcgagagcctgagaaacagcgccagaagaaagtggctgcaccagatccagtgcgccgccgagaccagcggcgtgagcctggagcccgtgtacagcgagaccttcaaggccctgatgcaggacgccgaggcccacggcaacaagaagatcagcgcccacatcagcctgctggaggagaacctgctgctgcccgagaagggcaacgtgctgctgagaaacgtggcctgcaccctggacgacgcccagttcgtgctgaacagagtgctgtacagagacatgaagggcatcagcttcaccgtggtggacgagggcaagcccatccacgtgccccaggtgcagtaccacggcaacatcttcttctggaaccagagcagaaacaagcacgactacaacggcagcttcctggccctgcccctgcaggacgcctacatgagaatcttcggcgtgctggccgtggacaccctgagagacccccacgagatcaacatcttcctgccccacgagatcagattctaccagggcgtggccaacgtgttcagcaccgcctaccactacgtgcacagcagagagcacatcctgcacatcgtgatcaccggcatcggctggctgtacgacgtgaccagcagcatcaccagcatcaccacctacttcgtggagcccagccccgcccaggacagcgactacgtgctgagaaacatgatggtgaccggccagctgggcctgaccgagatccacaagaacccccccaccatccacagaaagagctgcatcttcagagacttcctgttcaagtgcaccgacagcagcgaggtggtgctggccagcgcctgcggcgagacccacatcgtggtgcccctgagagagagaaccggcgaggccctgggcgtgctggacttcaacatcggccagaacagaatgctgctgtgccaggagtacaaggacctgcagaagatgatgaaggtggtgcaggtggcctgctacgagatcctgggcgagttcagcggcgagatcaagaagaagtacatcctggagatcgagaacgtgagagaggtgcagagagccggcatcctgttcttcagaatcatgctgctggagctgcaggagagcatccagctgctgaacagcatggagttcgtgagcctgctgctgtacgaccacaccctggtgaccgagcccaacagcccccaggacagcaagagcatggagctggaggccaacgtgaagctggtgagagacatcctgaaggccgtgatcctgttcttccaccccgagctggagttcagcagcgacttcggcagctgggacaagtgcaagttctacgtgaacaagtacctggtgaacaacatctgcgccttcgaccccaccgccaagcacgtggaggtgaacgtgcagctgatcgacgagtacatcagagaccacagcagaaccgaggtgtggaagttcggcaacgtggtgatcgagcacctgtaccactggatccacatctgcagcgccctgatgaagatcaccaagcagctgaacagcggcatcaccccccccctgcccagcaagaccgacaactacatgtacgccaagatgcccggcgagggcctgcaggagaagtag

SEQ ID NO: 20653 - DNA, 2571 bp, Artificial Sequence
  Description of Artificial Sequence: Synthetic coding sequence
ctgggccagatgaagtgcaaggagctgaacctggagggccagagaaagatcagccccggcagcatcaaggacagcaagaccgaggccagcggcaacatcgccatcagaaagagcgccaaggtgatcttcgccctggacgagaccgagctgaagagcaagcccgagcacacctggaagaagaacctgttcgagagaatggaggccagagcccaggccatgcagcagaagatcatcgacaaggagaacctgaagaaggagctggagaagaaggccgagaagaagctgcccagagacaacctggccaaggagtggttcaacaccgacagcatgaccctgaacaacaccgcctacctgctggacaagctgctgcccaccctggtgcccggcgtggagaacatgctgacccaggtggagaagaagaaggtgctgaccgaggccgacacccccagcaagttcgaccccatcaactacctgggcgagtacctgatcagaaacaaccccaactacatcaaggaccccggcatgagcggctaccagagactgatgaaggaggtgaccgaggacctgaagatctacgtgcccgacaccatctgcaacagagtgagcaagatgaaggagaacgtgaagcagaacagaaagcagagagagagcatcgacaagatcatcgtgaaggtggccaacaccagaaagcaggccctgcaggagcagttcgacgagtggatcctggaccccaagggcatgatccccaagagcgtgatccagaacgtgctgcaggagttcttccagaaccccgacttcaagctgggcagccactgcaagcagctggacatcaccgacagcaccgagcccagactgaacaagatggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggaagatgaagtacgtgaccttcgaggacgaggagcaggccaacctgatctacggcaacagcagattcaccgacctgcacagcatcatcagaaacatccagagctgcaaggaggtgaagggcagaaccgccttcaacggcgtgagcttcaacctgctgcagttcgtgcagctgctggagaccttcgtgggcgaggacgcccccctgagcgtgagcgagaccctgaccagcttcttcaaggagggctacgtggagaccgagcaggagaagatgaacgccctggagcaggtgagcctgtgcagacaggccggcgtgcagtggagaaactgcagcagcctgcagccccccacccccggcctgaagagaagcagccaccacagactgctgagcaactgggactacagagagagaagaaagttcttccccctggagaccaagttcccctag

SEQ ID NO: 20654 - DNA, 1527 bp, Artificial Sequence
  Description of Artificial Sequence: Synthetic coding sequence
atgaaggagaacgtgaagcagaacagaaagcagagagagagcatcgacaagatcatcgtgaaggtggccaacaccagaaagcaggccctgcaggagcagttcgacgagtggatcctggaccccaagggcatgatccccaagagcgtgctgcagatccagaacgtgctgcaggagttcttccagaaccccgacttcaagctgggcagccactgcaagcagctggacatcaccgacagcaccgagcccagactgaacaagatggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggtag

SEQ ID NO: 20655 - DNA, 2571 bp, Artificial Sequence
  Description of Artificial Sequence: Synthetic coding sequence
atggacgagatcaagagccaggagctgaacctggagggccagagaaagatcagccccggcagcatcaaggacagcaagaccgaggccagcggcaacatcgccatcagaaagagcgccaaggtgatcttcgccctggacgagaccgagctgaagagcaagcccgagcacacctggaagaagaacctgttcgagagaatggaggccagagcccaggccatgcagcagaagatcatcgacaaggagaacctgaagaaggagctggagaagaaggccgagaagaagctgcccagagacaacctggccaaggagtggttcaacaccgacagcatgaccctgaacaacaccgcctacctgctggacaagctgctgcccaccctggtgcccggcgtggagaacatgctgacccaggtggagaagaagaaggtgctgaccgaggccgacacccccagcaagttcgaccccatcaactacctgggcgagtacctgatcagaaacaaccccaactacatcaaggaccccggcatgagcggctaccagagactgatgaaggaggtgaccgaggacctgaagatctacgtgcccgacaccatctgcaacagagtgagcaagatgaaggagaacgtgaagcagaacagaaagcagagagagagcatcgacaagatcatcgtgaaggtggccaacaccagaaagcaggccctgcaggagcagttcgacgagtggatcctggaccccaagggcatgatccccaagagcgtgatccagaacgtgctgcaggagttcttccagaaccccgacttcaagctgggcagccactgcaagcagctggacatcaccgacagcaccgagcccagactgaacaagatggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggaagatgaagtacgtgaccttcgaggacgaggagcaggccaacctgatctacggcaacagcagattcaccgacctgcacagcatcatcagaaacatccagagctgcaaggaggtgaagggcagaaccgccttcaacggcgtgagcttcaacctgctgcagttcgtgcagctgctggagaccttcgtgggcgaggacgcccccctgagcgtgagcgagaccctgaccagcttcttcaaggagggctacgtggagaccgagcaggagaagatgaacgccctggagcaggtgagcctgtgcagacaggccggcgtgcagtggagaaactgcagcagcctgcagccccccacccccggcctgaagagaagcagccaccacagactgctgagcaactgggactacagagagagaagaaagttcttccccctggagaccaagttcccctag

SEQ ID NO: 20656 - DNA, 1710 bp, Artificial Sequence
  Description of Artificial Sequence: Synthetic coding sequence
atggagttcaccgagtacatcagcagccacatcaaggacctgaagagcgagatgttcgaggagctgctgaagcacctgtgccacagcgccgacgagttcagagaggtgatcaaggccgacatgagaagacagatgttcgccgagctgttcctgcactgcgaccacggcaaggtgggcttcctggacagacagagaaccctggccctgctggagctgttctacgaccacagcagccagatgctgagaagcctgctgagaaaccccagacagtggcccttcatcgagttcgaggagatcaacctgaccgagctgtggggcgacatggacaaccagaagcacatctacgagggcttcgacaaggtgctgctggagatgaacaccctgctgagcgccaaccacgccagcaagacccagagcaagctgctggagagccccgaccagcccaagctgaacgagcagagaaccagcacccccagccccaacccccccgagcagcagagaggcgtgaccgccgagcagggcccccagagaatcagcatcgaggagcagcagcagggcaagaagcccaccgccgagcaggagctgtacatcgagagcgtgatcgagcccggcacccacaccgagagcaccctggagcagggcagcagcagaagactgctgaccgagcaggagacccacagagagagcaccaccgagcagggccagcacaagggcagcatcgagggccagggccccagaagagtgagcgtgagcgagcagggcagcagcagagagagcgtggccgagcagggcagcagaagagagagcatcgccgagcaggacagacacaagggcagcgtggccgagcagggcagcagaagaatgagcgccgccgagcagggcagcctgagagagagcgtgatcgaggagccctaccagaagagcgagcagggcccctacggcgagatcatcagcgaggagcaggaggacatcggcagcaccagccagagcagaaaggacagcatcctgaagagcaccaagtacggcgagcccatcaccagcgagtacatcgaggtgcccctgcaggagaagagaagctgggagcagacctacgaggaggagatcttcctgagcagcgagctgcaggaggaggtgcccaccctgagcagaaaggaccacttccccgagaccaccaagaaggaggtgcagaaggacaagccctgcgagcccaagagccagaagatcgagggcaagagctggagcggcgagttcttcacctgcaactggaagatgaagtacgtgaccttcgaggacgaggagcaggccaacctgatctacggcaacagcagattcaccgacctgcacagcatcatcagaaacatccagagctgcaaggaggtgaagggcagaaccgccttcaacggcgtgagcttcaacctgctgcagttcgtgcagctgctggagaccttcgtgggcgaggacgcccccctgagcgtgagcgagaccctgaccagcttcttcaaggagggctacgtggagaccgagcaggagaagatgaacgccctggagcaggtgagcctgtgcagacaggccggcgtgcagtggagaaactgcagcagcctgcagccccccacccccggcctgaagagaagcagccaccacagactgctgagcaactgggactacagagagagaagaaagttcttccccctggagaccaagttcccctag

SEQ ID NO: 20657 - DNA, 1890 bp, Artificial Sequence
  Description of Artificial Sequence: Synthetic coding sequence
atggccatcagccccagaagcgacgccaccttcagcagccagaagagcacccccagcgagagccccagaaccaagaagttccccctgaccgaggaggagatcttctacatgaactgcagagccgcctacctgaccgtgttcaagagcagcctggagaacatcatcagcaaggaccagctgtacctggccctgcagcacgccggcagaaaccccagccagaagaccatcaacaagtactggaccccccagaccgccaagctgaacttcgacgacttctgcatcatcctgagaaaggagaagcccaccagcaaggccgagctgctgaagagcttcaagcagctggacgtgaacgacgacggctgcatcctgcacaccgacctgtacaagttcctgaccaagagaggcgagaagatgaccagagaggaggtgaacgccatcatcaacctggccgacgtgaacgccgacggcaagttcgactacatcaagttctgcaagctgtacatgaccaccaacgagcagtgcctgaagaccaccctggagaagctggaggtggacagcaagctgatgagacaccagttcggcaaccacatcgagggcagccccgagagagaccccagccccgtgcccaagcccagccccaagatcaccagaaagaccgaccccgagaccttcctgaacaagggcgacaccagaagcagcctgctgagcgccaccagaaagttcaagaccagcgtgagcttcaccgtgaccatgggcgccaacggcaacagaaacagcaagctgatggagcccaacctgatcaaggactggcagcacatgcagagcaagggctgcttcttcctggaggaggacggcgagatcatcagccaccagtacagaatgcagatcgcccagagaagcatggtgtacctgaccatcaagcccctgaacctgagccaggtggagggcaagcccagcccctggctgagcgtggacaccgccctgtacatcctgaaggagaacgagagccaggccaacctgcagctggtgtgcttcaccgagctgagaaacagagaggtgttcggctggaccggcgagctgggccccggcatctactggctgatccccagcaccaccggctgcagactgagaaagaagatcaagcccgtgaccgacgaggcccagctggtgtacagagacgagaccggcgagctgttcctgaccaaggagttcaagagcaccctgagcgacatcttcgaggtgatcgacctggacggcaacggcctgctgagcctggaggagtacaacttcttcgagctgagaaccagcggcgagaagtgcgacgaggacgcctgggccgtgtgcagagagaacttcgacaccaagagaaacgagctgaccagacagggcttcatggacctgaacctgatggaggccaacgacagagagggcgacccctgcgacctgtgggtgaccctgcacagcatgggctacaacaaggccctggagctgaccgaggcctgccccttcgtgatcgacatctacgccgagaagtgcaagcccaagatcaaggccgtgcacatggaggcctgcagcggccagctggagaaggccatctgcaagagcgtgctgagcaacggcgacgccaaggtgatggacggctacgagaacatcatcgtgcacacctacagctgcgacacctggatcaccagcgtgatcgagaacaagagcgacgagaaggtgatcatccacatcagcaacgagctgagcaagaactgcatcaacaacagaggcctgaacatcttcgccgtggaggtgggccccaagagcaccatggtgtgccagcacgtgatgcccctgaacgagagacaggagtggatctactactgcatctacagcctgatcagctag

SEQ ID NO: 20658 - DNA, 594 bp, Artificial Sequence
  Description of Artificial Sequence: Synthetic coding sequence
atgagactgaagcagggcagcttcctgtggtacctgtacctggacaagatctactgcctgctgagcgtgagaaacgtgaaggccctggccgagtacttccacatcctggacgtgcacggcaagaacaccctgaacgacgtgctgttctaccacttcctgcaccacgtgaccgacctgaagaaggcccagatcaacatcgtgttcgacatgctggactggaacgccgtgggcgagatcgacttcgagaagttctacatgctggtgtgcatgctgctggcccaccagaaccacctggagggccagttcatgtacagacacagcagacccgtgttcgacctgctggacctgaagggcgacctgagaatcggcgccaagaacttcgagatgtacagattcctgttcaacatccagaagcaggagctgaaggacctgttcagagacttcgacatcaccggcgacaacagactgaactaccaggagttcaagctgtacaccatcatctacaccgacaagctgcagaagagacagaagaccgaggagaaggagaagggcgagagaaagagaagcctgtacagcaagtgccacatcaagtag

SEQ ID NO: 20659 - DNA, 2454 bp, Artificial Sequence
  Description of Artificial Sequence: Synthetic coding sequence
atgtacggcgtgtgcggctgctgcggcgccctgagacccagatacaagagactggtggacaacatcttccccgaggaccccgaggacggcctggtgaagaccaacatggagaagctgaccttctacgccctgagcgcccccgagaagctggacagaatcggcgcctacctgagcgagagactgatcagagacgtgggcagacacagatacggctacgtgtgcatcgccatggaggccctggaccagctgctgatggcctgccactgccagagcatcaacctgttcgtggagagcttcctgaagatggtggccaagctgctggagagcgagaagcccaacctgcagatcctgggcaccaacagcttcgtgaagttcgccaacatcgaggaggacacccccagctaccacagaagctacgacttcttcgtgagcagattcagcgagatgtgccacagcagccacgacgacctggagatcaagaccaagatcagaatgagcggcatcaagggcctgcagggcgtggtgagaaagaccgtgaacgacgagctgcaggccaacatctgggacccccagcacatggacaagatcgtgcccagcctgctgttcaacctgcagcacgtggaggaggccgagagcagaagccccagccccctgcaggcccccgagaaggagaaggagagccccgccgagctggccgagagatgcctgagagagctgctgggcagagccgccttcggcaacatcaagaacgccatcaagcccgtgctgatccacctggacaaccacagcctgtgggagcccaaggtgttcgccatcagatgcttcaagatcatcatgtacagcatccagccccagcacagccacctggtgatccagcagctgctgggccacctggacgccaacagcagaagcgccgccaccgtgagagccggcatcgtggaggtgctgagcgaggccgccgtgatcgccgccaccggcagcgtgggccccaccgtgctggagatgttcaacaccctgctgagacagctgagactgagcatcgactacgccctgaccggcagctacgacggcgccgtgagcctgggcaccaagatcatcaaggagcacgaggagagaatgttccaggaggccgtgatcaagaccgtgggcagcttcgccagcaccctgcccacctaccagagaagcgaggtgatcctgttcatcatgagcaaggtgcccagacccagcctgcaccaggccgtggacaccggcagaaccggcgagaacagaaacagactgacccagatcatgctgctgaagagcctgctgcaggtgagcaccggcttccagtgcaacaacatgatgagcgccctgcccagcaacttcctggacagactgctgagcaccgccctgatggaggacgccgagatcagactgttcgtgctggagatcctgatcagcttcatcgacagacacggcaacagacacaagttcagcaccatcagcaccctgagcgacatcagcgtgctgaagctgaaggtggacaagtgcagcagacaggacaccgtgttcatgaagaagcacagccagcagctgtacagacacatctacctgagctgcaaggaggagaccaacgtgcagaagcactacgaggccctgtacggcctgctggccctgatcagcatcgagctggccaacgaggaggtggtggtggacctgatcagactggtgctggccgtgcaggacgtggcccaggtgaacgaggagaacctgcccgtgtacaacagatgcgccctgtacgccctgggcgccgcctacctgaacctgatcagccagctgaccaccgtgcccgccttctgccagcacatccacgaggtgatcgagaccagaaagaaggaggccccctacatgctgcccgaggacgtgttcgtggagagacccagactgagccagaacctggacggcgtggtgatcgagctgctgttcagacagagcaagatcagcgaggtgctgggcggcagcggctacaacagcgacagactgtgcctgccctacatcccccagctgaccgacgaggacagactgagcaagagaagaagcatcggcgagaccatcagcctgcaggtggaggtggagagcagaaacagccccgagaaggaggagagagtgcccgccgaggagatcacctacgagaccctgaagaaggccatcgtggacagcgtggccgtggaggagcaggagagagagagaagaagacaggtggtggagaagttccagaaggcccccttcgaggagatcgccgcccactgcggcgccagagccagcctgctgcagagcaagctgaaccagatcttcgagatcaccatcagacccccccccagccccagcggcaccatcaccgccgcctacggccagccccagaaccacagcatccccgtgtacgagatgaagttccccgacctgtgcgtgtactag

SEQ ID NO: 20660 - DNA, 2349 bp, Artificial Sequence
  Description of Artificial Sequence: Synthetic coding sequence
atggagaagctgaccttctacgccctgagcgcccccgagaagctggacagaatcggcgcctacctgagcgagagactgatcagagacgtgggcagacacagatacggctacgtgtgcatcgccatggaggccctggaccagctgctgatggcctgccactgccagagcatcaacctgttcgtggagagcttcctgaagatggtggccaagctgctggagagcgagaagcccaacctgcagatcctgggcaccaacagcttcgtgaagttcgccaacatcgaggaggacacccccagctaccacagaagctacgacttcttcgtgagcagattcagcgagatgtgccacagcagccacgacgacctggagatcaagaccaagatcagaatgagcggcatcaagggcctgcagggcgtggtgagaaagaccgtgaacgacgagctgcaggccaacatctgggacccccagcacatggacaagatcgtgcccagcctgctgttcaacctgcagcacgtggaggaggccgagagcagaagccccagccccctgcaggcccccgagaaggagaaggagagccccgccgagctggccgagagatgcctgagagagctgctgggcagagccgccttcggcaacatcaagaacgccatcaagcccgtgctgatccacctggacaaccacagcctgtgggagcccaaggtgttcgccatcagatgcttcaagatcatcatgtacagcatccagccccagcacagccacctggtgatccagcagctgctgggccacctggacgccaacagcagaagcgccgccaccgtgagagccggcatcgtggaggtgctgagcgaggccgccgtgatcgccgccaccggcagcgtgggccccaccgtgctggagatgttcaacaccctgctgagacagctgagactgagcatcgactacgccctgaccggcagctacgacggcgccgtgagcctgggcaccaagatcatcaaggagcacgaggagagaatgttccaggaggccgtgatcaagaccgtgggcagcttcgccagcaccctgcccacctaccagagaagcgaggtgatcctgttcatcatgagcaaggtgcccagacccagcctgcaccaggccgtggacaccggcagaaccggcgagaacagaaacagactgacccagatcatgctgctgaagagcctgctgcaggtgagcaccggcttccagtgcaacaacatgatgagcgccctgcccagcaacttcctggacagactgctgagcaccgccctgatggaggacgccgagatcagactgttcgtgctggagatcctgatcagcttcatcgacagacacggcaacagacacaagttcagcaccatcagcaccctgagcgacatcagcgtgctgaagctgaaggtggacaagtgcagcagacaggacaccgtgttcatgaagaagcacagccagcagctgtacagacacatctacctgagctgcaaggaggagaccaacgtgcagaagcactacgaggccctgtacggcctgctggccctgatcagcatcgagctggccaacgaggaggtggtggtggacctgatcagactggtgctggccgtgcaggacgtggcccaggtgaacgaggagaacctgcccgtgtacaacagatgcgccctgtacgccctgggcgccgcctacctgaacctgatcagccagctgaccaccgtgcccgccttctgccagcacatccacgaggtgatcgagaccagaaagaaggaggccccctacatgctgcccgaggacgtgttcgtggagagacccagactgagccagaacctggacggcgtggtgatcgagctgctgttcagacagagcaagatcagcgaggtgctgggcggcagcggctacaacagcgacagactgtgcctgccctacatcccccagctgaccgacgaggacagactgagcaagagaagaagcatcggcgagaccatcagcctgcaggtggaggtggagagcagaaacagccccgagaaggaggagagagtgcccgccgaggagatcacctacgagaccctgaagaaggccatcgtggacagcgtggccgtggaggagcaggagagagagagaagaagacaggtggtggagaagttccagaaggcccccttcgaggagatcgccgcccactgcggcgccagagccagcctgctgcagagcaagctgaaccagatcttcgagatcaccatcagacccccccccagccccagcggcaccatcaccgccgcctacggccagccccagaaccacagcatccccgtgtacgagatgaagttccccgacctgtgcgtgtactag

SEQ ID NO: 20661 - DNA, 4572 bp, Artificial Sequence
  Description of Artificial Sequence: Synthetic coding sequence
atgaccagcgtgtggaagagactgcagagagtgggcaagagagccgccaagttccagttcgtggcctgctaccacgagctggtgctggagtgcaccaagaagtggcagcccgacaagctggtggtggtgtggaccagaagaaacagaagaatctgcagcaaggcccacagctggcagcccggcatccagaacccctacagaggcaccgtggtgtggatggtgcccgagaacgtggacatcagcgtgaccctgtacagagacccccacgtggaccagtacgaggccaaggagtggaccttcatcatcgagaacgagagcaagggccagagaaaggtgctggccaccgccgaggtggacctggccagacacgccggccccgtgcccgtgcaggtgcccgtgagactgagactgaagcccaagagcgtgaaggtggtgcaggccgagctgagcctgaccctgagcggcgtgctgctgagagagggcagagccaccgacgacgacatgcagagcctggccagcctgatgagcgtgaagcccagcgacgtgggcaacctggacgacttcgccgagagcgacgaggacgaggcccacggccccggcgcccccgaggccagagccagagtgccccagcccgaccccagcagagagctgaagaccctgtgcgaggaggaggaggagggccagggcagaccccagcaggccgtggccagccccagcaacgccgaggacaccagccccgcccccgtgagcgcccccgccccccccgccagaaccagcagaggccagggcagcgagagagccaacgaggccggcggccaggtgggccccgaggcccccagaccccccgagaccagccccgagatgagaagcagcagacagcccgcccaggacaccgcccccacccccgcccccagactgagaaagggcagcgacgccctgagaccccccgtgccccagggcgaggacgaggtgcccaaggccagcggcgccccccccgccggcctgggcagcgccagagagacccaggcccaggcctgcccccaggagggcaccgaggcccacggcgccagactgggccccagcatcgaggacaagggcagcggcgaccccttcggcagacagagactgaaggccgaggagatggacaccgaggacagacccgaggccagcggcgtggacaccgagcccagaagcggcggcagagaggccaacaccaagagaagcggcgtgagagccggcgaggccgaggagagcagcgccgtgtgccaggtggacgccgagcagagaagcaaggtgagacacgtggacaccaagggccccgaggccaccggcgtgatgcccgaggccagatgcagaggcacccccgaggccccccccagaggcagccagggcagactgggcgtgagaaccagagacgaggcccccagcggcctgagcctgccccccgccgagcccgccggccacagcggccagctgggcgacctggagggcgccagagccgccgccggccaggagagagagggcgccgaggtgagaggcggcgcccccggcatcgagggcaccggcctggagcagggccccagcgtgggcgccatcagcaccagaccccaggtgagcagctggcagggcgccctgctgagcaccgcccagggcgccatcagcagaggcctgggcggctgggaggccgaggccggcggcagcggcgacctggagaccgagaccgaggtggtgggcctggaggtgctgggcacccaggagaaggaggtggagggcagcggcttccccgagaccagaaccctggagatcgagatcctgggcgccctggagaaggaggccgccagaagcagagtgctggagagcgaggtggccggcaccgcccagtgcgagggcctggagacccaggagaccgaggtgggcgtgatcgagacccccggcaccgagaccgaggtgctgggcacccagaagaccgaggccggcggcagcggcgtgctgcagaccagaaccaccatcgccgagaccgaggtgctggtgacccaggagatcagcggcgacctgggccccctgaagatcgaggacaccatccagagcgagatgctgggcacccaggagaccgaggtggaggccagcagagtgcccgagagcgaggccgagggcaccgaggccaagatcctgggcacccaggagatcaccgccagagacagcggcgtgagagagatcgaggccgagatcgccgagagcgacatcctggtggcccaggagatcgaggtgggcctgctgggcgtgctgggcatcgagaccggcgccgccgagggcgccatcctgggcacccaggagatcgccagcagagacagcggcgtgcccggcctggaggccgacaccaccggcatccaggtgaaggaggtgggcggcagcgaggtgcccgagatcgccaccggcaccgccgagaccgagatcctgggcacccaggagatcgccagcagaagcagcggcgtgcccggcctggagagcgaggtggccggcgcccaggagaccgaggtgggcggcagcggcatcagcggccccgaggccggcatggccgaggccagagtgctgatgaccagaaagaccgagatcatcgtgcccgaggccgagaaggaggaggcccagaccagcggcgtgcaggaggccgagaccagagtgggcagcgccctgaagtacgaggccctgagagcccccgtgacccagcccagagtgctgggcagccaggaggccaaggccgagatcagcggcgtgcagggcagcgagacccaggtgctgagagtgcaggaggccgaggccggcgtgtggggcatgagcgagggcaagagcggcgcctggggcgcccaggaggccgagatgaaggtgctggagagccccgagaacaagagcggcaccttcaaggcccaggaggccgaggccggcgtgctgggcaacgagaagggcaaggaggccgagggcagcctgaccgaggccagcctgcccgaggcccaggtggccagcggcgccggcgccggcgcccccagagccagcagccccgagaaggccgaggaggacagaagactgcccggcagccaggccccccccgccctggtgagcagcagccagagcctgctggagtggtgccaggaggtgaccaccggctacagaggcgtgagaatcaccaacttcaccaccagctggagaaacggcctggccttctgcgccatcctgcacagattctaccccgacaagatcgactacgccagcctggaccccctgaacatcaagcagaacaacaagcaggccttcgacggcttcgccgccctgggcgtgagcagactgctggagcccgccgacatggtgctgctgagcgtgcccgacaagctgatcgtgatgacctacctgtgccagatcagagccttctgcaccggccaggagctgcagctggtgcagctggagggcggcggcggcgccggcacctacagagtgggcagcgcccagcccagcccccccgacgacctggacgccggcggcctggcccagagactgagaggccacggcgccgagggcccccaggagcccaaggaggccgccgacagagccgacggcgccgcccccggcgtggccagcagaaacgccgtggccggcagagccagcaaggacggcggcgccgaggcccccagagagagcagacccgccgaggtgcccgccgagggcctggtgaacggcgccggcgcccccggcggcggcggcgtgagactgagaagacccagcgtgaacggcgagcccggcagcgtgcccccccccagagcccacggcagcttcagccacgtgagagacgccgacctgctgaagaagagaagaagcagactgagaaacagcagcagcttcagcatggacgaccccgacgccggcgccatgggcgccgccgccgccgagggccaggcccccgaccccagccccgcccccggcccccccaccgccgccgacagccagcagccccccggcggcagcagccccagcgaggagcccccccccagccccggcgaggaggccggcctgcagagattccaggacaccagccagtacgtgtgcgccgagctgcaggccctggagcaggagcagagacagatcgacggcagagccgccgaggtggagatgcagctgagaagcctgatggagagcggcgccaacaagctgcaggaggaggtgctgatccaggagtggttcaccctggtgaacaagaagaacgccctgatcagaagacaggaccagctgcagctgctgatggaggagcaggacctggagagaagattcgagctgctgagcagagagctgagagccatgctggccatcgaggactggcagaagaccagcgcccagcagcacagagagcagctgctgctggaggagctggtgagcctggtgaaccagagagacgagctggtgagagacctggaccacaaggagagaatcgccctggaggaggacgagagactggagagaggcctggagcagagaagaagaaagctgagcagacagctgagcagaagagagagatgcgtgctgagctag

SEQ ID NO: 20662 - DNA, 1005 bp, Artificial Sequence
  Description of Artificial Sequence: Synthetic coding sequence
atgaagcacttcctgagaatgctgatccaggtgtgcctgtacttctactgcaagttcctgtggagatgcctgaagttcgtgatgagaaagctgaccggcagatgcgagctgcagagaatctgctacaacaccaagcccggcgccagcagaaccatgaagatcgagaccagcctgagagacagcaagagcaagctgctgcagaccagcgtgagcgtgcaccccgacgccatcgagaagaccatcgaggacatcatggagctgaagaagatcaaccccgacgtgaacccccagctgggcatcagcctgcaggcctgcctgctgcagatcgtgggctacagaaacctgatcgccgacgtggagaagctgagaagagaggcctacgacagcgacaacccccagcacgaggagatgctgctgaagctgtggaagttcctgaagcccaacacccccctggagagcagaatcagcaagcagtggtgcgagatcggcttccagggcgacgaccccaagaccgacttcagaggcatgggcctgctgggcctgtacaacctgcagtacttcgccgagagagacgccaccgccgcccagcaggtgctgagcgacagcctgcaccccaagtgcagagacatcaccaaggaggagatcagcaagttcagcaaggccgagtgggagaagaagagaatggacaaggccatcggctacagcttcgccatcgtgggcatcaacatcaccgacctggcctacaacctgctggtgagcggcgccctgaagacccacttctacaacatcgcccccgaggcccccaccctgagccacttccagcagaccttctgctacctgatgcacgagttccacaagttctggatcgaggaggaccccatggacatcatggagttcaacagagtgagagagaagttcagaaagagaatcatcaagcagctgcagaaccccgacatggccctgtgcccccacttcgccgccagcgagggcctgatcaacatgtag

SEQ ID NO: 20663 - DNA, 981 bp, Artificial Sequence
  Description of Artificial Sequence: Synthetic coding sequence
atgaagcacttcctgagaatgctgatccaggtgtgcctgtacttctactgcaagttcctgtggagatgcctgaagttcgtgatgagaaagctgaccggcagatgcgagctgcagagaatctgctacaacaccaagcccggcgccagcagaaccatgaagatcgagaccagcctgagagacagcaagagcaagctgctgcagaccagcgtgagcgtgcaccccgacgccatcgagaagaccatcgaggacatcatggagctgaagaagatcaaccccgacgtgaacccccagctgggcatcagcctgcaggcctgcctgctgcagatcgtgggctacagaaacctgatcgccgacgtggagaagctgagaagagaggcctacgacagcgacaacccccagcacgaggagatgctgctgaagctgtggaagttcctgaagcccaacacccccctggagagcagaatcagcaagcagtggtgcgagatcggcttccagggcgacgaccccaagaccgacttcagaggcatgggcctgctgggcctgtacaacctgcagtacttcgccgagagagacgccaccgccgcccagcaggtgctgagcgacagcctgcaccccaagtgcagcaagttcagcaaggccgagtgggagaagaagagaatggacaaggccatcggctacagcttcgccatcgtgggcatcaacatcaccgacctggcctacaacctgctggtgagcggcgccctgaagacccacttctacaacatcgcccccgaggcccccaccctgagccacttccagcagaccttctgctacctgatgcacgagttccacaagttctggatcgaggaggaccccatggacatcatggagttcaacagagtgagagagaagttcagaaagagaatcatcaagcagctgcagaaccccgacatggccctgtgcccccacttcgccgccagcgagggcctgatcaacatgtag

SEQ ID NO: 20664 - DNA, 1176 bp, Artificial Sequence
  Description of Artificial Sequence: Synthetic coding sequence
atgaacgagaagagctgcagcttccacagcaaggaggagctgagagacggccagggcgagagactgagcgccggctacagccccagctacgacaaggacaagagcgtgctggccttcagaggcatccccatcagcgagctgaagaaccacggcatcctgcaggccctgaccaccgaggcctacgagtgggagcccagagtggtgagcaccgaggtggtgagagcccaggaggagtgggaggccgtggacaccatccagcccgagaccggcagccaggccagcagcgagcagcccggccagctgatcagcttcagcgaggccctgcagcacttccagaccgtggacctgagccccttcaagaagagaatccagcccaccatcagaagaaccggcctggccgccctgagacactacctgttcggcccccccaagctgcaccagagactgagagaggagagagacctggtgctgaccatcgcccagtgcggcctggacagccaggaccccgtgcacggcagagtgctgcagaccatctacaagaagctgaccggcagcaagttcgactgcgccctgcacggcaaccactgggaggacctgggcttccagggcgccaaccccgccaccgacctgagaggcgccggcttcctggccctgctgcacctgctgtacctggtgatggacagcaagaccctgcccatggcccaggagatcttcagactgagcagacaccacatccagcagttccccttctgcctgatgagcgtgaacatcacccacatcgccatccaggccctgagagaggagtgcctgagcagagagtgcaacagacagcagaaggtgatccccgtggtgaacagcttctacgccgccaccttcctgcacctggcccacgtgtggagaacccagagaaagaccatcagcgacagcggcttcgtgctgaagggcgtgctgttcctgctgggcagacccagactgaacgcccagtgccccagaagcagagagcccaaggtggtggccagactggtgctggccgccgtgctgccccacccccacttcctgaagttccagctgaccaagatcagcatcacccaccccctggagagcgccagcagccccttcagcgccctgaccgtggccctgttctggagctacacctacgacaagcacatcttctag

SEQ ID NO: 20665 - DNA, 1146 bp, Artificial Sequence
  Description of Artificial Sequence: Synthetic coding sequence
atgaacgagaagagctgcagcttccacagcaaggaggagctgagagacggccagggcgagagactgagcgccggctacagccccagctacgacaaggacaagagcgtgctggccttcagaggcatccccatcagcgagctgaagaaccacggcatcctgcaggccctgaccaccgaggcctacgagtgggagcccagagtggtgagcaccgaggtggtgagagcccaggaggagtgggaggccgtggacaccatccagcccgagaccggcagccaggccagcagcgagcagcccggccagctgatcagcttcagcgaggccctgcagcacttccagaccgtggacctgagccccttcaagaagagaatccagcccaccatcagaagaaccggcctggccgccctgagacactacctgttcggcccccccaagctgcaccagagactgagagaggagagagacctggtgctgaccatcgcccagtgcggcctggacagccaggaccccgtgcacggcagagtgctgcagaccatctacaagaagctgaccggcagcaagttcgactgcgccctgcacggcaaccactgggaggacctgggcttccagggcgccaaccccgccaccgacctgagaggcgccggcttcctggccctgctgcacctgctgtacctggtgatggacagcaagaccctgcccatggcccaggagatcttcagactgagcagacaccacatccagcagttccccttctgcctgatgagcgtgaacatcacccacatcgccatccaggccctgagagaggagtgcctgagcagagagtgcaacagacagcagaaggtgatccccgtggtgaacagcttctacgccgccaccttcctgcacctggcccacgtgtggagaacccagagaaagaccatcagcgacagcggcttcgtgctgaaggagctggaggtgctggccaagaagagccccagaagactgctgaagaccctggagctgtacctggccagagtgagcaagggccaggccagcctgctgggcgcccagaagtgctacggccccgaggccccccccttcaaggacctgaccttcaccggcgagagcgacctgcagagccacagcagcgagggcgtgtggctgatctag

SEQ ID NO: 20666 - DNA, 1146 bp, Artificial Sequence; identical to SEQ ID NO: 20665
  Description of Artificial Sequence: Synthetic coding sequence

SEQ ID NO: 20667 - DNA, 612 bp, Artificial Sequence
  Description of Artificial Sequence: Synthetic coding sequence
atgaacgagaagagctgcagcttccacagcaaggaggagctgagagacggccagggcgagagactgagcgccggctacagccccagctacgacaaggacaagagcgtgctggccttcagaggcatccccatcagcgagctgaagaaccacggcatcctgcaggccctgaccaccgaggcctacgagtgggagcccagagtggtgagcaccgaggtggtgagagcccaggaggagtgggaggccgtggacaccatccagcccgagaccggcagccaggccagcagcgagcagcccggccagctgatcagcttcagcgaggccctgcagcacttccagaccgtggacctgagccccttcaagaagagaatccagcccaccatcagaagaaccggcctggccgccctgagacactacctgttcggcccccccaagctgcaccagagactgagagaggagagagacctggtgctgaccatcgcccagtgcggcctggacagccaggaccccgtgcacggcagagtgctgcagaccatctacaagaagctgaccggcagcaagttcgactgcgccctgcacggcaaccactgggaggacctgggcttccagggctag

SEQ ID NO: 20668 - DNA, 1146 bp, Artificial Sequence; identical to SEQ ID NO: 20665
  Description of Artificial Sequence: Synthetic coding sequence

SEQ ID NO: 20669 - DNA, 1146 bp, Artificial Sequence; identical to SEQ ID NO: 20665
  Description of Artificial Sequence: Synthetic coding sequence

SEQ ID NO: 20670 - DNA, 363 bp, Artificial Sequence
  Description of Artificial Sequence: Synthetic coding sequence
atgaacgagaagagctgcagcttccacagcaaggaggagctgagagacggccagggcgagagactgagcgccggctacagccccagctacgacaaggacaagagcgtgctggccttcagaggcatccccatcagcgagctgaagaaccacggcatcctgcaggccctgaccaccgaggcctacgagtgggagcccagagtggtgagcaccgaggtggtgagagcccaggaggagtgggaggccgtggacaccatccagcccgagaccggcagccaggccagcagcgagcagcccggccagctgatcagcttcagcgaggccctgcagcacttccagaccgtggacctgagccccttcaagtag

SEQ ID NO: 20671 - DNA, 765 bp, Artificial Sequence
  Description of Artificial Sequence: Synthetic coding sequence
atgaacgagaagagctgcagcttccacagcaaggaggagctgagagacggccagggcgagagactgagcgccggctacagccccagctacgacaaggacaagagcgtgctggccttcagaggcatccccatcagcgagctgaagaaccacggcatcctgcaggccctgaccaccgaggcctacgagtgggagcccagagtggtgagcaccgaggtggtgagagcccaggaggagtgggaggccgtggacaccatccagcccgagaccggcagccaggccagcagcgagcagcccggccagctgatcagcttcagcgaggccctgcagcacttccagaccgtggacctgagccccttcaagaagagaatccagcccaccatcagaagaaccggcctggccgccctgagacactacctgttcggcccccccaagctgcaccagagactgagagaggagagagacctggtgctgaccatcgcccagtgcggcctggacagccaggaccccgtgcacggcagagtgctgcagaccatctacaagaagctgaccggcagcaagttcgactgcgccctgcacggcaaccactgggaggacctgggcttccagggcgccaaccccgccaccgacctgagaggcgccggcttcctggccctgctgcacctgctgtacctggtgatggacagcaagaccctgcccatggcccaggagatcttcagactgagcagacaccacatccagatcgagagaaaccagggcaagggctag

SEQ ID NO: 20672 - DNA, 3363 bp, Artificial Sequence
  Description of Artificial Sequence: Synthetic coding sequence
atggtgctgaacagcctggacaagatgatccagctgcagaagaacaccgccaacatcagaaacatctgcgtgctggcccacgtggaccacggcaagaccaccctggccgactgcctgatcagcagcaacggcatcatcagcagcagactggccggcaagctgagatacatggacagcagagaggacgagcagatcagaggcatcaccatgaagagcagcgccatcagcctgcactacgccaccggcaacgaggagtacctgatcaacctgatcgacagccccggccacgtggacttcagcagcgaggtgagcaccgccgtgagaatctgcgacggctgcatcatcgtggtggacgccgtggagggcgtgtgcccccagacccaggccgtgctgagacaggcctggctggagaacatcagacccgtgctggtgatcaacaagatcgacagactgatcgtggagctgaagttcaccccccaggaggcctacagccacctgaagaacatcctggagcagatcaacgccctgaccggcaccctgttcaccagcaaggtgctggaggagagagccgagagagagaccgagagccaggtgaaccccaacagcgagcagggcgagcaggtgtacgactggagcaccggcctggaggacaccgacgacagccacctgtacttcagccccgagcagggcaacgtggtgttcaccagcgccatcgacggctggggcttcggcatcgagcacttcgccagaatctacagccagaagatcggcatcaagaaggaggtgctgatgaagaccctgtggggcgactactacatcaacatgaaggccaagaagatcatgaagggcgaccaggccaagggcaagaagcccctgttcgtgcagctgatcctggagaacatctggagcctgtacgacgccgtgctgaagaaggacaaggacaagatcgacaagatcgtgaccagcctgggcctgaagatcggcgccagagaggccagacacagcgaccccaaggtgcagatcaacgccatctgcagccagtggctgcccatcagccacgccgtgctggccatggtgtgccagaagctgcccagccccctggacatcaccgccgagagagtggagagactgatgtgcaccggcagccagaccttcgacagcttcccccccgagacccaggccctgaaggccgccttcatgaagtgcggcagcgaggacaccgcccccgtgatcatcttcgtgagcaagatgttcgccgtggacgccaaggccctgccccagaacaagcccagacccctgacccaggaggagatcgcccagagaagagagagagccagacagagacacgccgagaagctggccgccgcccagggccaggcccccctggagcccacccaggacggcagcgccatcgagacctgccccaagggcgaggagcccagaggcgacgagcagcaggtggagagcatgacccccaagcccgtgctgcaggaggagaacaaccaggagagcttcatcgccttcgccagagtgttcagcggcgtggccagaagaggcaagaagatcttcgtgctgggccccaagtacagccccctggagttcctgagaagagtgcccctgggcttcagcgccccccccgacggcctgccccaggtgccccacatggcctactgcgccctggagaacctgtacctgctgatgggcagagagctggagtacctggaggaggtgccccccggcaacgtgctgggcatcggcggcctgcaggacttcgtgctgaagagcgccaccctgtgcagcctgcccagctgcccccccttcatccccctgaacttcgaggccacccccatcgtgagagtggccgtggagcccaagcaccccagcgagatgccccagctggtgaagggcatgaagctgctgaaccaggccgacccctgcgtgcagatcctgatccaggagaccggcgagcacgtgctggtgaccgccggcgaggtgcacctgcagagatgcctggacgacctgaaggagagattcgccaagatccacatcagcgtgagcgagcccatcatccccttcagagagaccatcaccaagccccccaaggtggacatggtgaacgaggagatcggcaagcagcagaaggtggccgtgatccaccagatgaaggaggaccagagcaagatccccgagggcatccaggtggacagcgacggcctgatcaccatcaccacccccaacaagctggccaccctgagcgtgagagccatgcccctgcccgaggaggtgacccagatcctggaggagaacagcgacctgatcagaagcatggagcagctgaccagcagcctgaacgagggcgagaacacccacatgatccaccagaagacccaggagaagatctgggagttcaagggcaagctggagcagcacctgaccggcagaagatggagaaacatcgtggaccagatctggagcttcggccccagaaagtgcggccccaacatcctggtgaacaagagcgaggacttccagaacagcgtgtggaccggccccgccgacaaggccagcaaggaggccagcagatacagagacctgggcaacagcatcgtgagcggcttccagctggccaccctgagcggccccatgtgcgaggagcccctgatgggcgtgtgcttcgtgctggagaagtgggacctgagcaagttcgaggagcagggcgccagcgacctggccaaggagggccaggaggagaacgagacctgcagcggcggcaacgagaaccaggagctgcaggacggctgcagcgaggccttcgagaagagaaccagccagaagggcgagagccccctgaccgactgctacggccccttcagcggccagctgatcgccaccatgaaggaggcctgcagatacgccctgcaggtgaagccccagagactgatggccgccatgtacacctgcgacatcatggccaccggcgacgtgctgggcagagtgtacgccgtgctgagcaagagagagggcagagtgctgcaggaggagatgaaggagggcaccgacatgttcatcatcaaggccgtgctgcccgtggccgagagcttcggcttcgccgacgagatcagaaagagaaccagcggcctggccagcccccagctggtgttcagccactgggagatcatccccagcgaccccttctgggtgcccaccaccgaggaggagtacctgcacttcggcgagaaggccgacagcgagaaccaggccagaaagtacatgaacgccgtgagaaagagaaagggcctgtacgtggaggagaagatcgtggagcacgccgagaagcagagaaccctgagcaagaacaagtag

SEQ ID NO: 20673 - DNA, 3210 bp, Artificial Sequence
  Description of Artificial Sequence: Synthetic coding sequence
atggtgctgaacagcctggacaagatgatccagctgcagaagaacaccgccaacatcagaaacatctgcgtgctggcccacgtggaccacggcaacgaggagtacctgatcaacctgatcgacagccccggccacgtggacttcagcagcgaggtgagcaccgccgtgagaatctgcgacggctgcatcatcgtggtggacgccgtggagggcgtgtgcccccagacccaggccgtgctgagacaggcctggctggagaacatcagacccgtgctggtgatcaacaagatcgacagactgatcgtggagctgaagttcaccccccaggaggcctacagccacctgaagaacatcctggagcagatcaacgccctgaccggcaccctgttcaccagcaaggtgctggaggagagagccgagagagagaccgagagccaggtgaaccccaacagcgagcagggcgagcaggtgtacgactggagcaccggcctggaggacaccgacgacagccacctgtacttcagccccgagcagggcaacgtggtgttcaccagcgccatcgacggctggggcttcggcatcgagcacttcgccagaatctacagccagaagatcggcatcaagaaggaggtgctgatgaagaccctgtggggcgactactacatcaacatgaaggccaagaagatcatgaagggcgaccaggccaagggcaagaagcccctgttcgtgcagctgatcctggagaacatctggagcctgtacgacgccgtgctgaagaaggacaaggacaagatcgacaagatcgtgaccagcctgggcctgaagatcggcgccagagaggccagacacagcgaccccaaggtgcagatcaacgccatctgcagccagtggctgcccatcagccacgccgtgctggccatggtgtgccagaagctgcccagccccctggacatcaccgccgagagagtggagagactgatgtgcaccggcagccagaccttcgacagcttcccccccgagacccaggccctgaaggccgccttcatgaagtgcggcagcgaggacaccgcccccgtgatcatcttcgtgagcaagatgttcgccgtggacgccaaggccctgccccagaacaagcccagacccctgacccaggaggagatcgcccagagaagagagagagccagacagagacacgccgagaagctggccgccgcccagggccaggcccccctggagcccacccaggacggcagcgccatcgagacctgccccaagggcgaggagcccagaggcgacgagcagcaggtggagagcatgacccccaagcccgtgctgcaggaggagaacaaccaggagagcttcatcgccttcgccagagtgttcagcggcgtggccagaagaggcaagaagatcttcgtgctgggccccaagtacagccccctggagttcctgagaagagtgcccctgggcttcagcgccccccccgacggcctgccccaggtgccccacatggcctactgcgccctggagaacctgtacctgctgatgggcagagagctggagtacctggaggaggtgccccccggcaacgtgctgggcatcggcggcctgcaggacttcgtgctgaagagcgccaccctgtgcagcctgcccagctgcccccccttcatccccctgaacttcgaggccacccccatcgtgagagtggccgtggagcccaagcaccccagcgagatgccccagctggtgaagggcatgaagctgctgaaccaggccgacccctgcgtgcagatcctgatccaggagaccggcgagcacgtgctggtgaccgccggcgaggtgcacctgcagagatgcctggacgacctgaaggagagattcgccaagatccacatcagcgtgagcgagcccatcatccccttcagagagaccatcaccaagccccccaaggtggacatggtgaacgaggagatcggcaagcagcagaaggtggccgtgatccaccagatgaaggaggaccagagcaagatccccgagggcatccaggtggacagcgacggcctgatcaccatcaccacccccaacaagctggccaccctgagcgtgagagccatgcccctgcccgaggaggtgacccagatcctggaggagaacagcgacctgatcagaagcatggagcagctgaccagcagcctgaacgagggcgagaacacccacatgatccaccagaagacccaggagaagatctgggagttcaagggcaagctggagcagcacctgaccggcagaagatggagaaacatcgtggaccagatctggagcttcggccccagaaagtgcggccccaacatcctggtgaacaagagcgaggacttccagaacagcgtgtggaccggccccgccgacaaggccagcaaggaggccagcagatacagagacctgggcaacagcatcgtgagcggcttccagctggccaccctgagcggccccatgtgcgaggagcccctgatgggcgtgtgcttcgtgctggagaagtgggacctgagcaagttcgaggagcagggcgccagcgacctggccaaggagggccaggaggagaacgagacctgcagcggcggcaacgagaaccaggagctgcaggacggctgcagcgaggccttcgagaagagaaccagccagaagggcgagagccccctgaccgactgctacggccccttcagcggccagctgatcgccaccatgaaggaggcctgcagatacgccctgcaggtgaagccccagagactgatggccgccatgtacacctgcgacatcatggccaccggcgacgtgctgggcagagtgtacgccgtgctgagcaagagagagggcagagtgctgcaggaggagatgaaggagggcaccgacatgttcatcatcaaggccgtgctgcccgtggccgagagcttcggcttcgccgacgagatcagaaagagaaccagcggcctggccagcccccagctggtgttcagccactgggagatcatccccagcgaccccttctgggtgcccaccaccgaggaggagtacctgcacttcggcgagaaggccgacagcgagaaccaggccagaaagtacatgaacgccgtgagaaagagaaagggcctgtacgtggaggagaagatcgtggagcacgccgagaagcagagaaccctgagcaagaacaagtag

SEQ ID NO: 20674 - DNA, 93 bp, Artificial Sequence
  Description of Artificial Sequence: Synthetic coding sequence
atggtgctgaacagcctggacaagatgatccagctgcagaagaacaccgccaacatcagaaacatctgcgtgctggcccacgtggaccactag

SEQ ID NO: 20675 - DNA, 54 bp, Artificial Sequence
  Description of Artificial Sequence: Synthetic coding sequence
atggtgctgaacagcctggacaagatgatccagctgcagaagaacaccgcctag

SEQ ID NO: 20676 - DNA, 420 bp, Artificial Sequence
  Description of Artificial Sequence: Synthetic coding sequence
atgtggcacaccgtgcccagagccggcctgggcagagtgggctgcagaggcctgcccggctgcagagcccacccccccggcgcctgggcctgctgcaccgagcaggcctgggccctggcccccctgaccgtgcccagcagacccagcctgtgcagcggccccagaaccggcagcggccagcaggcccccggcctgcaggacgtgctgagcctgtggagcgtgtgcgacgacgagcacagctggagcttcctgtacgccggcccctgggccagcgagagagccaccggctggagactgagccacgaggtggagggccagagccagggcctgcaggtgaccagctgcagacaccacgccctgctgccctgggccgtgctgggcgcccccagctggccctgggcccagtggcccgtggcctag

SEQ ID NO: 20677 - DNA, 309 bp, Artificial Sequence
  Description of Artificial Sequence: Synthetic coding sequence
atgggcgccgagtgggagctgggcgccgaggccggcggcagcctgctgctgtgcgccgccctgctggccgccggctgcgccctgggcctgagactgggcagaggccagggcgccgccgacagaggcgccctgatctggctgtgctacgacgccctggtgcacttcgccctggccttccccgccgaccaccccgtgagagtgagagccgtgtggctgctggacgacctgccccccagagtggcccaccagaagccccagccccagcaccagcagctggccgtgctgctggccctgcccgtgttcttctag

SEQ ID NO: 20678 - DNA, 387 bp, Artificial Sequence
  Description of Artificial Sequence: Synthetic coding sequence
atgggcgccgagtgggagctgggcgccgaggccggcggcagcctgctgctgtgcgccgccctgctggccgccggctgcgccctgggcctgagactgggcagaggccagggcgccgccgacagaggcgccctgatctggctgtgctacgacgccctggtgcacttcgccctggagggccccttcgtgtacctgagcctggtgggcaacgtggccaacagcgacggcctgatcgccagcctgagcgacgccagatgggtgtacttcgaccccaccatcgtgagcgtggagatcctgaccgtggccctggacggcagcctggccctgttcctgatctacgccatcgtgaaggagaagtactacagagacagagtggcctggggcgagtag

SEQ ID NO: 20679 - DNA, 1815 bp, Artificial Sequence
  Description of Artificial Sequence: Synthetic coding sequence
atgctgggcatgaacatgctgctgatcaccctgttcctgctgctgcccctgagcatgctgaagggcgagccctgggagggctgcctgcactgcacccacaccacctggagcggcaacatcatgaccaagaccctgctgtaccacacctactacgagtgcgccggcacctgcctgggcacctgcacccacaaccagaccacctacagcgtgtgcgaccccggcagaggccagccctacgtgtgctacgaccccaagagcagccccggcacctggttcgagatccacgtgggcagcaaggagggcgacctgctgaaccagaccaaggtgttccccagcggcaaggacgtggtgagcctgtacttcgacgtgtgccagatcgtgagcatgggcagcctgttccccgtgatcttcagcagcatggagtactacagcagctgccacaagaacagatacgcccaccccgcctgcagcaccgacagccccgtgaccacctgctgggactgcaccacctggagcaccaaccagcagagcctgggccccatcatgctgaccaagatccccctggagcccgactgcaagaccagcacctgcaacagcgtgaacctgaccatcctggagcccgaccagcccatctggaccaccggcctgaaggcccccctgggcgccagagtgagcggcgaggagatcggccccggcgcctacgtgtacctgtacatcatcaagaagaccagaaccagaagcacccagcagttcagagtgttcgagagcttctacgagcacgtgaaccagaagctgcccgagcccccccccctggccagcaacctgttcgcccagctggccgagaacatcgccagcagcctgcacgtggccagctgctacgtgtgcggcggcatgaacatgggcgaccagtggccctgggaggccagagagctgatgccccaggacaacttcaccctgaccgccagcagcctggagcccgcccccagcagccagagcatctggttcctgaagaccagcatcatcggcaagttctgcatcgccagatggggcaaggccttcaccgaccccgtgggcgagctgacctgcctgggccagcagtactacaacgagaccctgggcaagaccctgtggagaggcaagagcaacaacagcgagagcccccaccccagccccttcagcagattccccagcctgaaccacagctggtaccagctggaggcccccaacacctggcaggcccccagcggcctgtactggatctgcggcccccaggcctacagacagctgcccgccaagtggagcggcgcctgcgtgctgggcaccatcagacccagcttcttcctgatgcccctgaagcagggcgaggccctgggctaccccatctacgacgagaccaagagaaagagcaagagaggcatcaccatcggcgactggaaggacaacgagtggccccccgagagaatcatccagtactacggccccgccacctgggccgaggacggcatgtggggctacagaacccccgtgtacatgctgaacagaatcatcagactgcaggccgtgctggagatcatcaccaacgagaccgccggcgccctgaacctgctggcccagcaggccaccaagatgagaaacgtgatctaccagaacagactggccctggactacctgctggcccaggaggagggcgtgtgcggcaagttcaacctgaccaactgctgcctggagctggacgacgagggcaaggtgatcaaggagatcaccgccaagatccagaagctggcccacatccccgtgcagacctggaagggctag

SEQ ID NO: 20680 - DNA, 1692 bp, Artificial Sequence
  Description of Artificial Sequence: Synthetic coding sequence
atgggcagcctgagcaactacgccctgctgcagctgaccctgaccgccttcctgaccatcctggtgcagccccagcacctgctggcccccgtgttcagaaccctgagcatcctgaccaaccagagcaactgctggctgtgcgagcacctggacaacgccgagcagcccgagctggtgttcgtgcccgccagcgccagcacctggtggacctacagcggccagtggatgtacgagagagtgtggtacccccaggccgaggtgcagaaccacagcaccagcagctacagaaaggtgacctggcactgggaggccagcatggaggcccagggcctgagcttcgcccaggtgagactgctggagggcaacttcagcctgtgcgtggagaacaagaacggcagcggccccttcctgggcaacatccccaagcagtactgcaaccagatcctgtggttcgacagcaccgacggcaccttcatgcccagcatcgacgtgaccaacgagagcagaaacgacgacgacgacaccagcgtgtgcctgggcaccagacagtgcagctggttcgccggctgcaccaacagaacctggaacagcagcgccgtgcccctgatcggcctgcccaacacccaggactacaagtgggtggacagaaacagcggcctgacctggagcggcaacgacacctgcctgtacagctgccagaaccagaccaagggcctgctgtaccagctgttcagaaacctgttctgcagctacggcctgaccgaggcccacggcaagtggagatgcgccgacgccagcatcaccaacgacaagggccacgacggccacagaacccccacctggtggctgaccggcagcaacctgaccctgagcgtgaacaacagcggcctgttcttcctgtgcggcaacggcgtgtacaagggcttcccccccaagtggagcggcagatgcggcctgggctacctggtgcccagcctgaccagatacctgaccctgaacgccagccagatcaccaacctgagaagcttcatccacaaggtgaccccccacagatgcacccagggcgacaccgacaacccccccctgtactgcaaccccaaggacaacagcaccatcagagccctgttccccagcctgggcacctacgacctggagaaggccatcctgaacatcagcaaggccatggagcaggagttcagcgccaccaagcagaccctggaggcccaccagagcaaggtgagcagcctggccagcgccagcagaaaggaccacgtgctggacatccccaccacccagagacagaccgcctgcggcaccgtgggcaagcagtgctgcctgtacatcaactacagcgaggagatcaagagcaacatccagagactgcacgaggccagcgagaacctgaagaacgtgcccctgctggactggcagggcatcttcgccaaggtgggcgactggttcagaagctggggctacgtgctgctgatcgtgctgttctgcctgttcatcttcgtgctgatctacgtgagagtgttcagaaagagcagaagaagcctgaacagccagcccctgaacctggccctgagcccccagcagagcgcccagctgctggtgagcgagaccagctgccaggtgagcaacagagccatgaagggcctgaccacccaccagtacgacaccagcctgctgtag

SEQ ID NO: 20681 - DNA, 1692 bp, Artificial Sequence; identical to SEQ ID NO: 20680
  Description of Artificial Sequence: Synthetic coding sequence

SEQ ID NO: 20682 - DNA, 1608 bp, Artificial Sequence
  Description of Artificial Sequence: Synthetic coding sequence
atgaccgagaagttcctgttcctgtacctgagcctgctgcccatgcccctgctgagccaggcccagtggaacgagaacagcctggtgagcttcagcaagatcatcgccagcggcaaccacctgagcaactgctggatctgccacaacttcatcaccagaagcagcagctaccagtacatcctggtgagaaacttcagcctgaacctgaccttcggcagcggcatccccgagggccagcacaagagcgtgcccctgcaggtgagcctggccaacagcgcccaccaggtgccctgcctggacctgaccccccccttcaaccagagcagcaagaccagcttctacttctacaactgcagcagcctgaaccagacctgctgcccctgccccgagggccactgcgacagaaagaacaccagcgaggagggcttccccagccccaccatccaccccatgagcttcagccccgccggctgccaccccaacctgacccactggtgccccgccaagcagatgaacgactacagagacaagagcccccagaacagatgcgccgcctgggagggcaaggagctgatcacctggagagtgctgtacagcctgcccaaggcccacaccgtgcccacctggcccaagagcaccgtgcccctgggcggccccctgagccccgcctgcaaccagaccatccccgccggctggaagagccagctgcacaagtggttcgacagccacatccccagatgggcctgcaccccccccggctacgtgttcctgtgcggcccccagaagaacaagctgcccttcgacggcagccccaagatcacctacagcaccccccccgtggccaacctgtacacctgcatcaacaacatccagcacaccggcgagtgcgccgtgggcctgctgggccccagaggcatcggcgtgaccatctacaacaccacccagcccagacagaagagagccctgggcctgatcctggccggcatgggcgccgccatcggcatgatcgccccctggggcggcttcacctaccacgacgtgaccctgagaaacctgagcagacagatcgacaacatcgccaagagcaccagagacagcatcagcaagctgaaggccagcatcgacagcctggccaacgtggtgatggacaacagactggccctggactacctgctggccgagcagggcggcgtgtgcgccgtgatcaacaagagctgctgcgtgtacgtgaacaacagcggcgccatcgaggaggacatcaagaagatctacgacgaggccacctggctgcacgacttcggcaagggcggcgccagcgccagagccatctgggaggccgtgaagagcgccctgcccagcctgaactggttcgtgcccctgctgggccccgccaccgtgatcctgctgctgttcctgttcggcccctgcttcttcaacctgctgatcaagtgcgtgagcagcagaatcaagcagttccacatgaagagcccccagatggagagataccagctgagcgtgatcggcggccccagcacctacaagcacatcagccccctggacgccagcggccagagattcagagagaccatggaggagttcagcctgtag

SEQ ID NO: 20683 - DNA, 795 bp, Artificial Sequence
  Description of Artificial Sequence: Synthetic coding sequence
atggccctggaggccgccggcggcccccccgaggagaccctgagcctgtggaagagagagcaggccagactgaaggcccacgtggtggacagagacaccgaggcctggcagagagaccccgccttcagcggcctgcagagagtgggcggcgtggacgtgagcttcgtgaagggcgacagcgtgagagcctgcgccagcctggtggtgctgagcttccccgagctggaggtgctgctggtggacggcaacggcgtgctgcaccacagaggcttcggcgtggcctgccacctgggcgtgctgaccgacctgccctgcgtgggcgtggccaagaagctgctgcaggtggacggcctggagaacaacgccctgcacaaggagaagatcagactgctgcagaccagaggcgacagcttccccctgctgggcgacagcggcaccgtgctgggcatggccctgagaagccacgacagaagcaccagacccctgtacatcagcgtgggccacagaatgagcctggaggccgccgtgagactgacctgctgctgctgcagattcagaatccccgagcccgtgagacaggccgacatctgcagcagagagcacatcagaaagagcctgggcctgcccggcccccccacccccagaagccccaaggcccagagacccgtggcctgccccaagggcgacagcggcgagagcagcggcgagggccagcccccccaggaccacagccccggccccagaaccgcccccagacccggcagccaggagcaggccggcaaggactggcagtag

SEQ ID NO: 20684 - DNA, 849 bp, Artificial Sequence
  Description of Artificial Sequence: Synthetic coding sequence
atggccctggaggccgccggcggcccccccgaggagaccctgagcctgtggaagagagagcaggccagactgaaggcccacgtggtggacagagacaccgaggcctggcagagagaccccgccttcagcggcctgcagagagtgggcggcgtggacgtgagcttcgtgaagggcgacagcgtgagagcctgcgccagcctggtggtgctgagcttccccgagctggaggtggtgtacgaggagagcagaatggtgagcctgaccgccccctacgtgagcggcttcctggccttcagagaggtgcccttcctgctggagctggtgcagcagctgagagagaaggagcccggcctgatgccccaggtgctgctggtggacggcaacggcgtgctgcaccacagaggcttcggcgtggcctgccacctgggcgtgctgaccgacctgccctgcgtgggcgtggccaagaagctgctgcaggtggacggcctggagaacaacgccctgcacaaggagaagatcagactgctgcagaccagaggcgacagcttccccctgctgggcgacagcggcaccgtgctgggcatggccctgagaagccacgacagaagcaccagacccctgtacatcagcgtgggccacagaatgagcctggaggccgccgtgagactgacctgctgctgctgcagattcagaatccccgagcccgtgagacaggccgacatctgcagcagagagcacatcagaaagagcctgggcctgcccggcccccccacccccagaagccccaaggcccagagacccgtggcctgccccaagggcgacagcggcgagagcagcgccctgtgctag

SEQ ID NO: 20685 - DNA, 714 bp, Artificial Sequence
  Description of Artificial Sequence: Synthetic coding sequence
atggccctggaggccgccggcggcccccccgaggagaccctgagcctgtggaagagagagcaggccagactgaaggcccacgtggtggacagagacaccgaggcctggcagagagaccccgccttcagcggcctgcagagagtgggcggcgtggacgtgagcttcgtgaagggcgacagcgtgagagcctgcgccagcctggtggtgctgagcttccccgagctggaggtgctgctggtggacggcaacggcgtgctgcaccacagaggcttcggcgtggcctgccacctgggcgtgctgaccgacctgccctgcgtgggcgtggccaagaagctgctgcaggtggacggcctggagaacaacgccctgcacaaggagaagatcagactgctgcagaccagaggcgacagcttccccctgctgggcgacagcggcaccgtgctgggcatggccctgagaagccacgacagaagcaccagacccctgtacatcagcgtgggccacagaatgagcctggaggccgccgtgagactgacctgctgctgctgcagattcagaatccccgagcccgtgagacaggccgacatctgcagcagagagcacatcagaaagagcctgggcctgcccggcccccccacccccagaagccccaaggcccagagacccgtggcctgccccaagggcgacagcggcgagagcagcgccctgtgctag

SEQ ID NO: 20686 - DNA, 771 bp, Artificial Sequence
  Description of Artificial Sequence: Synthetic coding sequence
atggaccccacctgcagcagcgagtgcatctacaacctgatccccagcgacctgaaggagcccccccagccccccagatacatcagcatcttcaaggccaccgtgaaggacgacatgcagaaggccaagaccgccatgaagaccatgggccccgccaaggtggaggtgcccagccccaaggacttcctgaagaagcacagcaaggagaagaccctgccccccaagaagaacttcgacagaaacgtgcccaagaagcccgccgtgcccctgaagaccgaccaccccgtgatgggcatccagagcggcaagaacttcatcaacaccaacgccgccgacatcatcatgggcgtggccaagaagcccaagcccatctacgtggacaagagaaccggcgacaagcacgacctggagcccagcggcctggtgcccaagtacatcaacaagaaggactacggcgtgacccccgagtacatctgcaagagaaacgaggagatcaagaaggcccaggaggactacgacagatacatccaggagaacctgaagaaggccgccatgaagagactgagcgacgaggagagagaggccgtgctgcagggcctgaagaagaactgggaggaggtgcacaaggagttccagagcctgagcgtgttcatcgacagcatccccaagaagatcagaaagcagagactggaggaggagatgaagcagctggagcacgacatcggcatcatcgagaagcacaagatcatctacatcgccaacaacgcctag

SEQ ID NO: 20687 - DNA, 768 bp, Artificial Sequence
  Description of Artificial Sequence: Synthetic coding sequence
atggaccccacctgcagcagcgagtgcatctacaacctgatccccagcgacctgaaggagcccccccagccccccagatacatcagcatcttcaaggccaccgtgaaggacgacatgcagaaggccaagaccgccatgaagaccatgggccccgccaaggtggaggtgcccagccccaaggacttcctgaagaagcacagcaaggagaagaccctgccccccaagaagaacttcgacagaaacgtgcccaagaagcccgccgtgcccctgaagaccgaccaccccgtgatgggcatccagagcggcaagaacttcatcaacaccaacgccgccgacatcatcatgggcgtggccaagaagcccaagcccatctacgtggacaagagaaccggcgacaagcacgacctggagcccagcggcctggtgcccaagtacatcaacaagaaggactacggcgtgacccccgagtacatctgcaagagaaacgaggagatcaagaaggcccaggaggactacgacagatacatccaggagaacctgaagaaggccgccatgaagagactgagcgacgaggagagagaggccgtgctgcagggcctgaagaagaactgggaggaggtgcacaaggagttccagagcctgagcgtgttcatcgacagcatccccaagaagatcagaaagcagagactggaggaggagatgaagcagctggagcacgacatcggcatcatcgagaagcacaagatcatctacatcgccaacaagtag

SEQ ID NO: 20688 - DNA, 771 bp, Artificial Sequence; identical to SEQ ID NO: 20686
  Description of Artificial Sequence: Synthetic coding sequence

SEQ ID NO: 20689 - DNA, 1305 bp, Artificial Sequence
  Description of Artificial Sequence: Synthetic coding sequence
atgagcatcgagaagatctgggccagagagatcctggacagcagaggcaaccccaccgtggaggtggacctgtacaccgccaagggcctgttcagagccgccgtgcccagcggcgccagcaccggcatctacgaggccctggagctgagagacggcgacaagcagagatacctgggcaagggcgtgctgaaggccgtggaccacatcaacagcaccatcgcccccgccctgatcagcagcggcctgagcgtggtggagcaggagaagctggacaacctgatgctggagctggacggcaccgagaacaagagcaagttcggcgccaacgccatcctgggcgtgagcctggccgtgtgcaaggccggcgccgccgagagagagctgcccctgtacagacacatcgcccagctggccggcaacagcgacctgatcctgcccgtgcccgccttcaacgtgatcaacggcggcagccacgccggcaacaagctggccatgcaggagttcatgatcctgcccgtgggcgccgagagcttcagagacgccatgagactgggcgccgaggtgtaccacaccctgaagggcgtgatcaaggacaagtacggcaaggacgccaccaacgtgggcgacgagggcggcttcgcccccaacatcctggagaacagcgaggccctggagctggtgaaggaggccatcgacaaggccggctacaccgagaagatcgtgatcggcatggacgtggccgccagcgagttctacagagacggcaagtacgacctggacttcaagagccccaccgaccccagcagatacatcaccggcgaccagctgggcgccctgtaccaggacttcgtgagagactaccccgtggtgagcatcgaggaccccttcgaccaggacgactgggccgcctggagcaagttcaccgccaacgtgggcatccagatcgtgggcgacgacctgaccgtgaccaaccccaagagaatcgagagagccgtggaggagaaggcctgcaactgcctgctgctgaaggtgaaccagatcggcagcgtgaccgaggccatccaggcctgcaagctggcccaggagaacggctggggcgtgatggtgagccacagaagcggcgagaccgaggacaccttcatcgccgacctggtggtgggcctgtgcaccggccagatcaagaccggcgccccctgcagaagcgagagactggccaagtacaaccagctgatgagaatcgaggaggagctgggcgacgaggccagattcgccggccacaacttcagaaaccccagcgtgctgtag

SEQ ID NO: 20690 - DNA, 1887 bp, Artificial Sequence
  Description of Artificial Sequence: Synthetic coding sequence
atggaggaggagggcggcggcagaagctgcggcaccaccagagagctgcagaagctgaagcagcaggccatggagtactacagagagaacgacgtgcccagaagactggaggagctgctgaacagcaccttctacctgcagcccgccgacgtgtacggccacctgaaggccaactgcttcagcaagctggccaagccccccaccatctgcaagatcgtgggcaaggacgtgctggacggcctgggcctgcccaccctgcaggtggacatcttctgcaccatccagaacttccccaagaacgtgtgcagcgtggtgatcagcacccacttcgaggtgcacgagaacgccctgcccgagctggccaaggccgaggaggccgagagagccagcgccgtgagcaccgccgtgcagtgggtgaacagcaccatcacccacgagctgcagggcatggcccccagcgaccaggccgaggtggaccacctgctgagaatcttcttcgccagcaaggtgcaggaggacaagggcagaaaggagctggagaagagcctggagtacagcaccgtgcccacccccctgccccccgtgcccccccccccccccccccccccccccaccaagaagaagggccagaagcccggcagaaaggacaccatcaccgagaagcccatcgcccccgccgagcccgtggagcccgtgctgagcggcagcatggccatcggcgccgtgagcctggccgtggccaaggcctgcgccatgctgctgaacaagcccctgtacctgaacatcgccctgctgaagcacaaccaggagcagcccaccaccctgagcatgcccctgctgatggtgagcctggtgagctgcggcaagagcagcagcggcaagctgaacctgatgaaggaggtgatctgcatcccccaccccgagctgaccaccaagcagggcgtggagatgctgatggagatgcagaagcacatcaacaagatcatcgagatggtgagccccagcccccccaaggccgagaccaagaagggccacgacggcagcaagagaggccagcagcagatcaccggcaagatgagccacctgggctgcctgaccatcaactgcgacagcatcgagcagcccctgctgctgatccaggagatctgcgccaacctgggcctggagctgggcaccaacctgcacctggccatcaactgcgccggccacgagctgatggactacaacaagggcaagtacgaggtgatcatgggcacctacaagaacgccgccgagatggtggacctgtacgtggacctgatcaacaagtaccccagcatcatcgccctgatcgaccccttcagaaaggaggacagcgagcagtgggacagcatctaccacgccctgggcagcagatgctacatcatcgccggcaccgccagcaagagcatcagcaagctgctggagcagggcaacatcagcatccccaagagcaacggcctgatcatcaagcacaccaaccagaccaccatgagcgacctggtggagatcaccaacctgatcgacagcaagaagcacatcaccgtgttcggcagcaccgagggcgagagcagcgacgacagcctggtggacctggccgtgggcctgggcgtgagattcatcaagctgggcggcctgagcagaggcgagagagtgaccaagtacaacagactgctgaccatcgaggaggagctggtgcagaacggcaccctgggcttcaaggaggagcacaccttcttctacttcaacgaggaggccgagaaggccgccgaggccctggaggccgccgccgccagagagcccctggtgcccaccttccccacccagggcgtggaggagagcgccgagaccggcgccagcagcggctag

SEQ ID NO: 20691 - DNA, 1824 bp, Artificial Sequence
  Description of Artificial Sequence: Synthetic coding sequence
atggccttcagaagacaggtgaagaacttcgtgaagaactacagcgacgccgagatcaaggtgagagaggccaccagcaacgacccctggggccccagcagcagcctgatgctggacatcagcgacctgaccttcaacaccatcagcctgagcgagatcatgaacatgctgtggcacagactgaacgaccacggcaagaactggagacacgtgtacaagagcctgaccctgatggactacctgatcaagaacggcagcaagaaggtgatccagcactgcagagagggcttctgcaacctgcagaccctgaaggacttccagcacatcgacgaggccggcaaggaccagggctactacatcagagagaagagcaagcaggtgatcaccctgctgatggacgagcccctgctgtgcaaggagagagaggtggcctgcagaaccagacagagaaccagccacagcatcctgttcagcaagagacagctgggcagcagcaacagcctgaccgcctgcaccagcgcccccacccccgacatcagcgccagcgagaagaagtacaagctgcccaagttcggcagactgcacaacaagagaaacgtgtgcaaggccggcctgaagcaggagcactgccaggacgtgcacctgcccaccgagaccatgctgagccaggagaccctgcccctgaagatccacggctggaagagcaccgaggacctgatgaccttcctggacgacgaccccgagctgcccctgctggccaccccccccagcatcgtgagccccatcacctgcctgagcgaggccgaggaggtgtgcaacctgagcggcgccgacgccgtgcccaccctgagcgagaacagccccagcggccagagagacgtgagcctggacaagagaagcgacggcatcttcaccaacaccgtgaccgagaacctgctggagacccccctggagaagcagagcgccgccgagggcctgaagaccctgaccatcctgcccgcctgctggagcagcaaggaggagttcatcagccccgacctgagagtgagcaagagcgacagcaccttccacaaccaggccagcgtggagaccctgtgcctgagccccagcttcaagatcttcgacagagtgaaggagatcgtgatcaacaaggcctaccagaagcccgcccagagcagcatccagatggacgacaagatcctgaagaccaccaccagagtgagcaccgccagcgagggcgccagcagcttcagccccctgagcatgagcagccccgacctggccagccccgagaagagcgcccacctgctgagccccatcctggccggccccagcttctggaccctgagccaccagcagctgagcagcaccagcttcaaggacgaggacaagaccgccaagctgcaccacagcttcgccagcagaggccccgtgagcagcgacgtggaggagaacgacagcctgaacctgctgggcatcctgcccaacaacagcgacagcgccaagaagaacatcagccacatcagcagcagccactggggcgagttcagcacccagaacgtggaccagttcatccccctgagctgcagcggcttccagagcaccaaggacttcccccaggagcccgaggccaagaacagcatcagcgtgctgctgagagaggtgaagagagccatcgccagactgcacgaggacctgagcaccgtgatccaggagctgaacgtgatcaacaacatcctgatgagcatgagcctgaacagcagccagatcagccagagcagccaggtgccccagagcagcgagggcagcagcgaccagatctag

SEQ ID NO: 20692 - DNA, 906 bp, Artificial Sequence
  Description of Artificial Sequence: Synthetic coding sequence
atgcaggccagcgccgaccaggtggagagagacatcctggagacccagaagagactgcagcaggacagactgaacagcgagcagagccaggccctgcagcaccagcaggagaccggcagcagcctgaaggaggccgaggtgctgctgaaggacctgttcctggacgtggacaaggccagaagactgaagcacccccaggccgaggagaccgagaaggacatcgagcagctgcacgagagagtgacccaggagtgcgccgagtactgcgccctgtacgagaagatggtgctgccccccagaagaggcatccagggcagactgggcaccagagccggcgccgagaccgaggccggcctgagaagacccgtgtgggccggccacggcggcgccggcggcaccgacagaggcgcccagcacagagccgagggcgaccagagacccagaagagccgccgccgagcccggcggcgccggctgcagacaccaccccgagcccatccccagacccaccgagggcggcgtggtggccagagccgagcccggccagcccgtgcacgccctgcagggctgcacctggcagctgagcgccctggccgagcagcagagaagaatcctgcagcaggactggagcgacctgatggccgaccccgccggcgtgagaagagagtacgagcacttcaagcagcacgagctgctgagccaggagcagagcgtgaaccagctggaggaggacggcaagagaatggtggagctgagacaccccgccgtgggccccatccaggcccaccaggaggccctgaagatggagtggcagaacttcctgaacctgtgcatctgccaggagacccagctgcagcacgtggaggactacagcagaatcctgtgccccagcagcagcccccactag

SEQ ID NO: 20693 - DNA, 1038 bp, Artificial Sequence
  Description of Artificial Sequence: Synthetic coding sequence
atgcagcacgtgagcagcagccagagcagccagagacacgtgcagtggcccggcgcctgccccggcgccggcgaggagcagcccgcctgcagccagcccagcctgcccctgaccctgcccagccccagccaccagctgcagcagctgatggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccaccaccaggagatgcaggccctgaaggaggtgttcaaggagtacctgatcgagctgttcttcctgcagcacttccagggcaacatgatggacttcctggccttcaaggagagactgtacggccccctgcaggcctacctgagacagaacgacctggacatcgaggaggaggaggaggagcacttcgaggtgatcaacgacgaggtgaaggtggtggccagaaagcacggccagcccggcacccccgtggccatcgccacccagctgccccccagaaccagcgccgccttccccgcccagcagcagcccctgcagcccctggcccccaccaccgtgctgagcgtgagcgccgactggaacgccctgctgcagagacccaacaagtacatctggggcctgcagtacctggagatgtag

SEQ ID NO: 20694 - DNA, 1467 bp, Artificial Sequence
  Description of Artificial Sequence: Synthetic coding sequence
atgcagcacgtgagcagcagccagagcagccagagacacgtgcagtggcccggcgcctgccccggcgccggcgaggagcagcccgcctgcagccagcccagcctgcccctgaccctgcccagccccagccaccagctgcagcagctgatggtgagaggcggccccgccggcggccagaacatgaacgtggacctgcagggcgtgggccccggcctgcagggcagcccccaggtgaccctggcccccctgcccctgcccagccccaccagccccggcttccagttcagcgcccagcccagaagattcgagcacggcagccccagctacatccaggtgaccagccccctgagccagcaggtgcagacccagagccccacccagcccagccccggccccggccaggccctgcagaacgtgagagccggcgcccccggccccggcctgggcctgtgcagcagcagccccaccggcgacttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccaccaccaggagatgcaggccctgaaggaggtgttcaaggagtacctgatcgagctgttcttcctgcagcacttccagggcaacatgatggacttcctggccttcaaggagagactgtacggccccctgcaggcctacctgagacagaacgacctggacatcgaggaggaggaggaggagcacttcgaggtgatcaacgacgaggtgaaggtggtggccagaaagcacggccagcccggcacccccgtggccatcgccacccagctgccccccagaaccagcgccgccttccccgcccagcagcagcccctgcagcagatccacatgggcacccccgtgcccggcgacgtgaacagcatcaagatggaggccagcaagagacagtag

SEQ ID NO: 20695 - DNA, 1260 bp, Artificial Sequence
  Description of Artificial Sequence: Synthetic coding sequence
atgcagcacgtgagcagcagccagagcagccagagacacgtgcagtggcccggcgcctgccccggcgccggcgaggagcagcccgcctgcagccagcccagcctgcccctgaccctgcccagccccagccaccagctgcagcagctgatggtgcagacccagagccccacccagcccagccccggccccggccaggccctgcagaacgtgagagccggcgcccccggccccggcctgggcctgtgcagcagcagccccaccggcgacttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccaccaccaggagatgcaggccctgaaggaggtgttcaaggagtacctgatcgagctgttcttcctgcagcacttccagggcaacatgatggacttcctggccttcaaggagagactgtacggccccctgcaggcctacctgagacagaacgacctggacatcgaggaggaggaggaggagcacttcgaggtgatcaacgacgaggtgaaggtggtggccagaaagcacggccagcccggcacccccgtggccatcgccacccagctgccccccagaaccagcgccgccttccccgcccagcagcagcccctgcaggtgctgagcgacggcagcaccgtgcagctgcccagactgagcagcctgggcttcgaggacagcatgtgctag

SEQ ID NO: 20696 - DNA, 1071 bp, Artificial Sequence
  Description of Artificial Sequence: Synthetic coding sequence
atgcagcacgtgagcagcagccagagcagccagagacacgtgcagtggcccggcgcctgccccggcgccggcgaggagcagcccgcctgcagccagcccagcctgcccctgaccctgcccagccccagccaccagctgcagcagctgatggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccaccaccaggagatgcaggccctgaaggaggtgttcaaggagtacctgatcgagctgttcttcctgcagcacttccagggcaacatgatggacttcctggccttcaaggagagactgtacggccccctgcaggcctacctgagacagaacgacctggacatcgaggaggaggaggaggagcacttcgaggtgatcaacgacgaggtgaaggtggtggccagaaagcacggccagcccggcacccccgtggccatcgccacccagctgccccccagaaccagcgccgccttccccgcccagcagcagcccctgcaggtgctgagcgacggcagcaccgtgcagctgcccagactgagcagcctgggcttcgaggacagcatgtgctag

SEQ ID NO: 20697 - DNA, 654 bp, Artificial Sequence
  Description of Artificial Sequence: Synthetic coding sequence
atgcagcacgtgagcagcagccagagcagccagagacacgtgcagtggcccggcgcctgccccggcgccggcgaggagcagcccgcctgcagccagcccagcctgcccctgaccctgcccagccccagccaccagctgcagcagctgatggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagtag

SEQ ID NO: 20698 - DNA, 1071 bp, Artificial Sequence; identical to SEQ ID NO: 20696
  Description of Artificial Sequence: Synthetic coding sequence

SEQ ID NO: 20699 - DNA, 672 bp, Artificial Sequence
  Description of Artificial Sequence: Synthetic coding sequence
atgcagcacgtgagcagcagccagagcagccagagacacgtgcagtggcccggcgcctgccccggcgccggcgaggagcagcccgcctgcagccagcccagcctgcccctgaccctgcccagccccagccaccagctgcagcagctgatggtgcagacccagagccccacccagcccagccccggccccggccaggccctgcagaacgtgagagccggcgcccccggccccggcctgggcctgtgcagcagcagccccaccggcgacttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgccctag

SEQ ID NO: 20700 - DNA, 471 bp, Artificial Sequence
  Description of Artificial Sequence: Synthetic coding sequence
atgcagcacgtgagcagcagccagagcagccagagacacgtgcagtggcccggcgcctgccccggcgccggcgaggagcagcccgcctgcagccagcccagcctgcccctgaccctgcccagccccagccaccagctgcagcagctgatggtgcagacccagagccccacccagcccagccccggccccggccaggccctgcagaacgtgagagccggcgcccccggccccggcctgggcctgtgcagcagcagccccaccggcgacttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccactag

SEQ ID NO: 20701 - DNA, 3393 bp, Artificial Sequence
  Description of Artificial Sequence: Synthetic coding sequence
atgcagttccccagcccccccgccgccagaagcagccccgccccccaggccgccagcagcagcgaggccgccgcccccgccaccggccagcccggccccagctgccccgtgcccggcaccagcagaagaggcagacccggcaccccccccgccggcagagtggaggaggaggaggaggaggaggaggaggacgtggacaaggacccccaccccacccagaacacctgcctgagatgcagacacttcagcctgagagagagaaagagagagcccagaagaaccatgggcggctgcgaggtgagagagttcctgctgcagttcggcttcttcctgcccctgctgaccgcctggcccggcgactgcagccacgtgagcaacaaccaggtggtgctgctggacaccaccaccgtgctgggcgagctgggctggaagacctaccccctgaacggctgggacgccatcaccgagatggacgagcacaacagacccatccacacctaccaggtgtgcaacgtgatggagcccaaccagaacaactggctgagaaccaactggatcagcagagacgccgcccagaagatctacgtggagatgaagttcaccctgagagactgcaacagcatcccctgggtgctgggcacctgcaaggagaccttcaacctgttctacatggagagcgacgagagccacggcatcaagttcaagcccaaccagtacaccaagatcgacaccatcgccgccgacgagagcttcacccagatggacctgggcgacagaatcctgaagctgaacaccgagatcagagaggtgggccccatcgagagaaagggcttctacctggccttccaggacatcggcgcctgcatcgccctggtgagcgtgagagtgttctacaagaagtgccccttcaccgtgagaaacctggccatgttccccgacaccatccccagagtggacagcagcagcctggtggaggtgagaggcagctgcgtgaagagcgccgaggagagagacacccccaagctgtactgcggcgccgacggcgactggctggtgcccctgggcagatgcatctgcagcaccggctacgaggagatcgagggcagctgccacgcctgcagacccggcttctacaaggccttcgccggcaacaccaagtgcagcaagtgccccccccacagcctgacctacatggaggccaccagcgtgtgccagtgcgagaagggctacttcagagccgagaaggacccccccagcatggcctgcaccagaccccccagcgcccccagaaacgtggtgttcaacatcaacgagaccgccctgatcctggagtggagcccccccagcgacaccggcggcagaaaggacctgacctacagcgtgatctgcaagaagtgcggcctggacaccagccagtgcgaggactgcggcggcggcctgagattcatccccagacacaccggcctgatcaacaacagcgtgatcgtgctggacttcgtgagccacgtgaactacaccttcgagatcgaggccatgaacggcgtgagcgagctgagcttcagccccaagcccttcaccgccatcaccgtgaccaccgaccaggacgcccccagcctgatcggcgtggtgagaaaggactgggccagccagaacagcatcgccctgagctggcaggcccccgccttcagcaacggcgccatcctggactacgagatcaagtactacgagaaggagcacgagcagctgacctacagcagcaccagaagcaaggcccccagcgtgatcatcaccggcctgaagcccgccaccaagtacgtgttccacatcagagtgagaaccgccaccggctacagcggctacagccagaagttcgagttcgagaccggcgacgagaccagcgacatggccgccgagcagggccagatcctggtgatcgccaccgccgccgtgggcggcttcaccctgctggtgatcctgaccctgttcttcctgatcaccggcagatgccagtggtacatcaaggccaagatgaagagcgaggagaagagaagaaaccacctgcagaacggccacctgagattccccggcatcaagacctacatcgaccccgacacctacgaggaccccagcctggccgtgcacgagttcgccaaggagatcgaccccagcagaatcagaatcgagagagtgatcggcgccggcgagttcggcgaggtgtgcagcggcagactgaagacccccggcaagagagagatccccgtggccatcaagaccctgaagggcggccacatggacagacagagaagagacttcctgagagaggccagcatcatgggccagttcgaccaccccaacatcatcagactggagggcgtggtgaccaagagaagcttccccgccatcggcgtggaggccttctgccccagcttcctgagagccggcttcctgaacagcatccaggccccccaccccgtgcccggcggcggcagcctgccccccagaatccccgccggcagacccgtgatgatcgtggtggagtacatggagaacggcagcctggacagcttcctgagaaagcacgacggccacttcaccgtgatccagctggtgggcatgctgagaggcatcgccagcggcatgaagtacctgagcgacatgggctacgtgcacagagacctggccgccagaaacatcctggtgaacagcaacctggtgtgcaaggtgagcgacttcggcctgagcagagtgctggaggacgaccccgaggccgcctacaccaccaccggcggcaagatccccatcagatggaccgcccccgaggccatcgcctacagaaagttcagcagcgccagcgacgcctggagctacggcatcgtgatgtgggaggtgatgagctacggcgagagaccctactgggagatgagcaaccaggacgtgatcctgagcatcgaggagggctacagactgcccgcccccatgggctgccccgccagcctgcaccagctgatgctgcactgctggcagaaggagagaaaccacagacccaagttcaccgacatcgtgagcttcctggacaagctgatcagaaaccccagcgccctgcacaccctggtggaggacatcctggtgatgcccgagagccccggcgaggtgcccgagtaccccctgttcgtgaccgtgggcgactggctggacagcatcaagatgggccagtacaagaacaacttcgtggccgccggcttcaccaccttcgacctgatcagcagaatgagcatcgacgacatcagaagaatcggcgtgatcctgatcggccaccagagaagaatcgtgagcagcatccagaccctgagactgcacatgatgcacatccaggagaagggcttccacgtgtag

SEQ ID NO: 20702 - DNA, 726 bp, Artificial Sequence
  Description of Artificial Sequence: Synthetic coding sequence
atggccgccgagcagggccagatcctggtgatcgccaccgccgccgtgggcggcttcaccctgctggtgatcctgaccctgttcttcctgatcaccggcagatgccagtggtacatcaaggccaagatgaagagcgaggagaagagaagaaaccacctgcagaacggccacctgagattccccggcatcaagacctacatcgaccccgacacctacgaggaccccagcctggccgtgcacgagttcgccaaggagatcgaccccagcagaatcagaatcgagagagtgatcggcgccggcgagttcggcgaggtgtgcagcggcagactgaagacccccggcaagagagagatccccgtggccatcaagaccctgaagggcggccacatggacagacagagaagagacttcctgagagaggccagcatcatgggccagttcgaccaccccaacatcatcagactggagggcgtggtgaccaagagaagcttccccgccatcggcgtggaggccttctgccccagcttcctgagagccggcttcctgaacagcatccaggccccccaccccgtgcccggcggcggcagcctgccccccagaatccccgccggcagacccgtgatgatcgtggtggagtacatggagaacggcagcctggacagcttcctgagactgtaccccaaggccgagtacaacggcaagcagtgcagcagatacagcatctag

SEQ ID NO: 20703 - DNA, 1005 bp, Artificial Sequence
  Description of Artificial Sequence: Synthetic coding sequence
atgaaggacagccccttccaggtgaccaagctgtactggctgaacgagaagtgggacttcatcgccagcgccagcgacatggccgccgagcagggccagatcctggtgatcgccaccgccgccgtgggcggcttcaccctgctggtgatcctgaccctgttcttcctgatcaccggcagatgccagtggtacatcaaggccaagatgaagagcgaggagaagagaagaaaccacctgcagaacggccacctgagattccccggcatcaagacctacatcgaccccgacacctacgaggaccccagcctggccgtgcacgagttcgccaaggagatcgaccccagcagaatcagaatcgagagagtgatcggcgccggcgagttcggcgaggtgtgcagcggcagactgaagacccccggcaagagagagatccccgtggccatcaagaccctgaagggcggccacatggacagacagagaagagacttcctgagagaggccagcatcatgggccagttcgaccaccccaacatcatcagactggagggcgtggtgaccaagagaagcttccccgccatcggcgtggaggccttctgccccagcttcctgagagccggcttcctgaacagcatccaggccccccaccccgtgcccggcggcggcagcctgccccccagaatccccgccggcagacccgtgatgatcgtggtggagtacatggagaacggcagcctggacagcttcctgagaaagcacgacggccacttcaccgtgatccagctggtgggcatgctgagaggcatcgccagcggcatgaagtacctgagcgacatgggctacgtgcacagagacctggccgccagaaacatcctggtgaacagcaacctggtgtgcaaggtgagcgacttcggcctgagcagagtgctggaggacgaccccgaggccgcctacaccaccaccgacctgttccagaccctgaccctgaacctgtgctacagcgcctag

SEQ ID NO: 20704 - DNA, 858 bp, Artificial Sequence
  Description of Artificial Sequence: Synthetic coding sequence
atgggcggctgcgaggtgagagagttcctgctgcagttcggcttcttcctgcccctgctgaccgcctggcccggcgactgcagccacgtgagcaacaaccaggtggtgctgctggacaccaccaccgtgctgggcgagctgggctggaagacctaccccctgaacggctgggacgccatcaccgagatggacgagcacaacagacccatccacacctaccaggtgtgcaacgtgatggagcccaaccagaacaactggctgagaaccaactggatcagcagagacgccgcccagaagatctacgtggagatgaagttcaccctgagagactgcaacagcatcccctgggtgctgggcacctgcaaggagaccttcaacctgttctacatggagagcgacgagagccacggcatcaagttcaagcccaaccagtacaccaagatcgacaccatcgccgccgacgagagcttcacccagatggacctgggcgacagaatcctgaagctgaacaccgagatcagagaggtgggccccatcgagagaaagggcttctacctggccttccaggacatcggcgcctgcatcgccctggtgagcgtgagagtgttctacaagaagtgccccttcaccgtgagaaacctggccatgttccccgacaccatccccagagtggacagcagcagcctggtggaggtgagaggcagctgcgtgaagagcgccgaggagagagacacccccaagctgtactgcggcgccgacggcgactggctggtgcccctgggcagatgcatctgcagcaccggctacgaggagatcgagggcagctgccacggcgccagcaagggcagatgcttctag

SEQ ID NO: 20705 - DNA, 7263 bp, Artificial Sequence
  Description of Artificial Sequence: Synthetic coding sequence
atgagcggccacaccctgccccccctgcccgtgcccggcaccaacagcaccgagcaggccagcgtgcccagagccatggccgccaccctgggcgccggcaccccccccagaccccaggccagaagcatcgccggcgtgtacgtggaggccagcggccaggcccagagcgtgtacgccgccatggagcagggcctgctgcccgccggcctgggccaggccctgctggaggcccaggccgccaccggcggcctggtggacctggccagaggccagctgctgcccgtgagcaaggccctgcagcagggcctggtgggcctggagctgaaggagaagctgctggccgccgagagagccaccaccggctaccccgacccctacggcggcgagaagctggccctgttccaggccatcggcaaggaggtggtggacagagccctgggccagagctggctggaggtgcagctggccaccggcggcctggtggaccccgcccagggcgtgctggtggcccccgagcccgcctgccaccagggcctgctggacagagagacctggcacaagctgagcgagctggagcccggcaccggcgacctgagattcctggaccccaacaccctggagagactgacctaccaccagctgctggagagatgcgtgagagcccccggcagcggcctggccctgctgcccctgaagatcaccttcagaagcatgggcggcgccgtgagcgccgccgagctgctggaggtgggcatcctggacgagcaggccgtgcagggcctgagagagggcagactggccgccgtggacgtgagcgccagagccgaggtgagaagatacctggagggcaccggcagcgtggccggcgtggtgctgctgcccgagggccacaagaagagcttcttccaggccgccaccgagcacctgctgcccatgggcaccgccctgcccctgctggaggcccaggccgccacccacaccctggtggaccccatcaccggccagagactgtgggtggacgaggccgtgagagccggcctggtgagccccgagctgcacgagcagctgctggtggccgagcaggccgtgaccggccaccacgaccccttcagcggcagccagatccccctgttccaggccatgaagaagggcctggtggacagacccctggccctgagactgctggacgcccagctggccaccggcggcctggtgtgccccgccagaagactgagactgcccctggaggccgccctgagatgcggctgcctggacgaggacacccagagacagctgagccaggccggcagcttcagcgacggcacccacggcggcctgagatacgagcagctgctggccctgtgcgtgaccgaccccgagaccggcctggccttcctgcccctgagcggcggccccagaggcggcgagccccagggcccccccttcatcaagtacagcaccagacaggccctgagcaccgccaccgccaccgtgagcgtgggcaagttcagaggcagacccgtgagcctgtgggagctgctgttcagcgaggccatcagcagcgagcagagagccatgctggcccagcagtaccaggagggcaccctgagcgtggagaagctggccgccaagctgagcgccaccctggagcaggccgccgccaccgccagagtgaccttcagcggcctgagagacaccgtgacccccggcgagctgctgaaggccgagatcatcgaccaggacctgtacgagagactggagcacggccaggccaccgccaaggacgtgggcagcctggccagcgtgcagagatacctgcagggcaccggctgcatcgccggcctgctgctgcccggcagccaggagagactgagcatctacgaggccagatgcaagggcctgctgagacccggcaccgccctgatcctgctggaggcccaggccgccaccggcttcatcatcgaccccaaggccaacaagggccacagcgtggaggaggccctgagagccgccgtgatcggccccgacgtgttcgccaagctgctgagcgccgagagagccgtgaccggctacaccgacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgaccagatgctgaacctgatcctgctggaccccagcgacgacaccaagggcttcttcgaccccaacacccacgagaacctgacctacctgcagctgctggagagatgcgtgagagaccccgagaccggcctgtacctgctgcccctgagcagcacccagagccccctggtggacagcgccacccagcaggccttccagaacctgctgctgagcgtgaagtacggcagattccagggccagagagtgagcgcctgggagctgatcaacagcgagtacttcagcgagggcagaagaagacagctgctgagaagatacagacagagagaggtgaccctgggccaggtggccaagctgctggaggccgagacccagagacaggccgacatcatgctgcccgccctgagaagcagagtgaccgtgcaccagctgctggaggccggcatcatcgaccagcagctgctggaccaggtgctggccggcaccatcagccccgaggccctgctgctgatggacggcgtgagaagatacctgtgcggcctgggcgccgtgggcggcgtgagactgctgcccagcggccagagactgagcctgtaccaggccatgagacagaagctgctgggccccagagtggccctggccctgctggaggcccaggccgccaccggcaccatcatggacccccacagccccgagagcctgagcgtggacgaggccgtgagaagaggcgtggtgggccccgagctgtacggcagactgaagagagccgagggcgccatcgccggcttcagagaccccttcagcggcaagcaggtgagcgtgttccaggccatgaagaagggcctgatcccctgggagcaggccgccagactgctggaggcccaggtggccaccggcggcatcatcgaccccaccagccaccaccacctgcccatgcccgtggccatccagagaggctacgtggaccaggagatggagaccgccctgagcagcagcagcgagaccttccccacccccgacggccagggcagaaccagctacgcccagctgctggaggagtgccccagagacgagaccagcggcctgcacctgctgcccctgcccgagagcgcccccgccctgcccaccgaggagcaggtgcagagaagcctgcaggccgtgcccggcgccaaggacggcaccagcctgtgggacctgctgagcagctgccacttcaccgaggagcagagaagaggcctgctggaggacgtgcaggagggcagaaccaccgtgccccagctgctggccagcgtgcagagatgggtgcaggagaccaagctgctggcccaggccagagtgatggtgcccggccccagaggcgaggtgcccgccgtgtggctgctggacgccggcatcatcacccaggagaccctggaggccctggcccagggcacccagagccccgcccaggtggccgagcagcccgccgtgaaggcctgcctgtggggcaccggctgcgtggccggcgtgctgctgcagcccagcggcgccaaggccagcatcgcccaggccgtgagagacggcctgctgcccaccggcctgggccagagactgctggaggcccaggtggccagcggcttcctggtggaccccctgaacaaccagagactgagcgtggaggacgccgtgaaggtgggcctggtgggcagagagctgagcgagcagctgggccaggccgagagagccgccgccggctaccccgacccctacagcagagccagcctgagcctgtggcaggccatggagaagggcctggtgccccagaacgagggcctgcccctgctgcaggtgcagctggccaccggcggcgtggtggaccccgtgcacggcgtgcacctgccccaggccgccgcctgcagactgggcctgctggacacccagaccagccaggtgctgaccgccgtggacaaggacaacaagttcttcttcgaccccagcgccagagaccaggtgacctaccagcagctgagagagagatgcgtgtgcgacagcgagaccggcctgctgctgctgcccctgcccagcgacaccgtgctggaggtggacgaccacaccgccgtggccctgagagccatgaaggtgcccgtgagcaccggcagattcaagggctgcagcgtgagcctgtgggacctgctgctgagcgagtacgtgggcgccgacaagagaagagagctggtggccctgtgcagaagcggcagagccgccgccctgagacaggtggtgagcgccgtgaccaccctggtggaggccgccgagagacagcccctgcaggccaccttcagaggcctgagaaagcaggtgagcgccagagacctgttcagagcccagctgatcagcagaaagaccctggacgagctgagccagggcaccaccaccgtgaaggaggtggccgagatggacagcgtgaagagaagcctggagggcggcaacttcatcgccggcgtgctgatccagggcacccaggagagaatgagcatccccgaggccctgagaagacacatcctgagacccggcaccgccctggtgctgctggaggcccaggccgccaccggcttcatcatcgaccccgtggagaacagaaagctgaccgtggaggaggccttcaaggccggcatgttcggcaaggagacctacgtgaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcatcatcgaccccgtgcacagccacagagtgcccgtggacgtggcctacagatgcggctacttcgacgaggagatgaacagaatcctggccgaccccagcgacgacaccaagggcttcttcgaccccaacacccacgagaacctgacctacctgcagctgctggagagatgcgtggaggaccccgagaccggcctgtacctgctgcagatcatcaagaagggcgagaactacgtgtacatcaacgaggccaccagacacgtgctgcagagcagaaccgccaagatgagagtgggcagattcgccgaccaggtggtgagcttctgggacctgctgagcagcccctacttcaccgaggacagaaagagagagctgatccaggagtacggcgcccagagcggcggcctggagaagctgctggagatcatcaccaccaccatcgaggagaccgagacccagaaccagggcatcaaggtggccgccatcagaggcgaggtgaccgccgccgacctgttcaacagcagagtgatcgaccagaagaccctgcacaccctgagagtgggcagaaccggcggccaggccctgagcaccctggagtgcgtgaagccctacctggagggcagcggctgcatcgccggcgtgaccgtgcccagcaccagagaggtgatgagcctgcacgaggccagcagaaaggagctgatccccgccgccttcgccacctggctgctggaggcccaggccgccaccggcttcctgctggacccctgcaccagacagaagctgagcgtggacgaggccgtggacgtgggcctggtgaacgaggagctgagagagagactgctgaaggccgagagagccgccaccggctacagagaccccgccaccggcgacaccatccccctgttccaggccatgcagaagcagctgatcgagaaggccgaggccctgagactgctggaggtgcaggtggccaccggcggcgtgatcgacccccagcaccaccacagactgcccctggagaccgcctacagaagaggctgcctgcacaaggacatctacgccctgatcagcgaccagaagcacatgagaaagagattcgtggaccccaacacccaggagaaggtgagctacagagagctgcaggagagatgcagaccccaggaggacaccggctggctgctgttccccgtgaacaaggccgccagagacagcgagcacatcgacgacgagaccagaagagccctggaggccgagcaggtggagatcaccgtgggcagattcagaggccagaagcccaccctgtgggccctgctgaacagcgagtacgtgaccgaggagaagaagctgcagctggtgagaatgtacagaacccacaccagaagagccctgcagaccgtggcccagctgatcctggagctgatcgagaagcaggagaccagcaacaagcacctgtggttccagggcatcagaagacagatcaccgccagcgagctgctgagcagcgccatcatcaccgaggagatgctgcaggacctggagaccggcagaagcaccacccaggagctgatggaggacgacagagtgaagagatacctggagggcaccagctgcatcgccggcgtgctggtgcccgccaaggaccagcccggcagacaggagaagatgagcatctaccaggccatgtggaagggcgtgctgagacccggcaccgccctggtgctgctggaggcccaggccgccaccggcttcgtgatcgaccccgtgagaaacctgagactgagcgtggaggaggccgtggccgccggcgtggtgggcggcgagatccaggagaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctgcagagagccaccctggaccccgagaccggcctgctgttcctgagcctgagcctgcagtag

SEQ ID NO: 20706 - DNA, 15267 bp, Artificial Sequence
  Description of Artificial Sequence: Synthetic coding sequence
atgagcggccacaccctgccccccctgcccgtgcccggcaccaacagcaccgagcaggccagcgtgcccagagccatggccgccaccctgggcgccggcaccccccccagaccccaggccagaagcatcgccggcgtgtacgtggaggccagcggccaggcccagagcgtgtacgccgccatggagcagggcctgctgcccgccggcctgggccaggccctgctggaggcccaggccgccaccggcggcctggtggacctggccagaggccagctgctgcccgtgagcaaggccctgcagcagggcctggtgggcctggagctgaaggagaagctgctggccgccgagagagccaccaccggctaccccgacccctacggcggcgagaagctggccctgttccaggccatcggcaaggaggtggtggacagagccctgggccagagctggctggaggtgcagctggccaccggcggcctggtggaccccgcccagggcgtgctggtggcccccgagcccgcctgccaccagggcctgctggacagagagacctggcacaagctgagcgagctggagcccggcaccggcgacctgagattcctggaccccaacaccctggagagactgacctaccaccagctgctggagagatgcgtgagagcccccggcagcggcctggccctgctgcccctgaagatcaccttcagaagcatgggcggcgccgtgagcgccgccgagctgctggaggtgggcatcctggacgagcaggccgtgcagggcctgagagagggcagactggccgccgtggacgtgagcgccagagccgaggtgagaagatacctggagggcaccggcagcgtggccggcgtggtgctgctgcccgagggccacaagaagagcttcttccaggccgccaccgagcacctgctgcccatgggcaccgccctgcccctgctggaggcccaggccgccacccacaccctggtggaccccatcaccggccagagactgtgggtggacgaggccgtgagagccggcctggtgagccccgagctgcacgagcagctgctggtggccgagcaggccgtgaccggccaccacgaccccttcagcggcagccagatccccctgttccaggccatgaagaagggcctggtggacagacccctggccctgagactgctggacgcccagctggccaccggcggcctggtgtgccccgccagaagactgagactgcccctggaggccgccctgagatgcggctgcctggacgaggacacccagagacagctgagccaggccggcagcttcagcgacggcacccacggcggcctgagatacgagcagctgctggccctgtgcgtgaccgaccccgagaccggcctggccttcctgcccctgagcggcggccccagaggcggcgagccccagggcccccccttcatcaagtacagcaccagacaggccctgagcaccgccaccgccaccgtgagcgtgggcaagttcagaggcagacccgtgagcctgtgggagctgctgttcagcgaggccatcagcagcgagcagagagccatgctggcccagcagtaccaggagggcaccctgagcgtggagaagctggccgccaagctgagcgccaccctggagcaggccgccgccaccgccagagtgaccttcagcggcctgagagacaccgtgacccccggcgagctgctgaaggccgagatcatcgaccaggacctgtacgagagactggagcacggccaggccaccgccaaggacgtgggcagcctggccagcgtgcagagatacctgcagggcaccggctgcatcgccggcctgctgctgcccggcagccaggagagactgagcatctacgaggccagatgcaagggcctgctgagacccggcaccgccctgatcctgctggaggcccaggccgccaccggcttcatcatcgaccccaaggccaacaagggccacagcgtggaggaggccctgagagccgccgtgatcggccccgacgtgttcgccaagctgctgagcgccgagagagccgtgaccggctacaccgacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgaccagatgctgaacctgatcctgctggaccccagcgacgacaccaagggcttcttcgaccccaacacccacgagaacctgacctacctgcagctgctggagagatgcgtgagagaccccgagaccggcctgtacctgctgcccctgagcagcacccagagccccctggtggacagcgccacccagcaggccttccagaacctgctgctgagcgtgaagtacggcagattccagggccagagagtgagcgcctgggagctgatcaacagcgagtacttcagcgagggcagaagaagacagctgctgagaagatacagacagagagaggtgaccctgggccaggtggccaagctgctggaggccgagacccagagacaggccgacatcatgctgcccgccctgagaagcagagtgaccgtgcaccagctgctggaggccggcatcatcgaccagcagctgctggaccaggtgctggccggcaccatcagccccgaggccctgctgctgatggacggcgtgagaagatacctgtgcggcctgggcgccgtgggcggcgtgagactgctgcccagcggccagagactgagcctgtaccaggccatgagacagaagctgctgggccccagagtggccctggccctgctggaggcccaggccgccaccggcaccatcatggacccccacagccccgagagcctgagcgtggacgaggccgtgagaagaggcgtggtgggccccgagctgtacggcagactgaagagagccgagggcgccatcgccggcttcagagaccccttcagcggcaagcaggtgagcgtgttccaggccatgaagaagggcctgatcccctgggagcaggccgccagactgctggaggcccaggtggccaccggcggcatcatcgaccccaccagccaccaccacctgcccatgcccgtggccatccagagaggctacgtggaccaggagatggagaccgccctgagcagcagcagcgagaccttccccacccccgacggccagggcagaaccagctacgcccagctgctggaggagtgccccagagacgagaccagcggcctgcacctgctgcccctgcccgagagcgcccccgccctgcccaccgaggagcaggtgcagagaagcctgcaggccgtgcccggcgccaaggacggcaccagcctgtgggacctgctgagcagctgccacttcaccgaggagcagagaagaggcctgctggaggacgtgcaggagggcagaaccaccgtgccccagctgctggccagcgtgcagagatgggtgcaggagaccaagctgctggcccaggccagagtgatggtgcccggccccagaggcgaggtgcccgccgtgtggctgctggacgccggcatcatcacccaggagaccctggaggccctggcccagggcacccagagccccgcccaggtggccgagcagcccgccgtgaaggcctgcctgtggggcaccggctgcgtggccggcgtgctgctgcagcccagcggcgccaaggccagcatcgcccaggccgtgagagacggcctgctgcccaccggcctgggccagagactgctggaggcccaggtggccagcggcttcctggtggaccccctgaacaaccagagactgagcgtggaggacgccgtgaaggtgggcctggtgggcagagagctgagcgagcagctgggccaggccgagagagccgccgccggctaccccgacccctacagcagagccagcctgagcctgtggcaggccatggagaagggcctggtgccccagaacgagggcctgcccctgctgcaggtgcagctggccaccggcggcgtggtggaccccgtgcacggcgtgcacctgccccaggccgccgcctgcagactgggcctgctggacacccagaccagccaggtgctgaccgccgtggacaaggacaacaagttcttcttcgaccccagcgccagagaccaggtgacctaccagcagctgagagagagatgcgtgtgcgacagcgagaccggcctgctgctgctgcccctgcccagcgacaccgtgctggaggtggacgaccacaccgccgtggccctgagagccatgaaggtgcccgtgagcaccggcagattcaagggctgcagcgtgagcctgtgggacctgctgctgagcgagtacgtgggcgccgacaagagaagagagctggtggccctgtgcagaagcggcagagccgccgccctgagacaggtggtgagcgccgtgaccaccctggtggaggccgccgagagacagcccctgcaggccaccttcagaggcctgagaaagcaggtgagcgccagagacctgttcagagcccagctgatcagcagaaagaccctggacgagctgagccagggcaccaccaccgtgaaggaggtggccgagatggacagcgtgaagagaagcctggagggcggcaacttcatcgccggcgtgctgatccagggcacccaggagagaatgagcatccccgaggccctgagaagacacatcctgagacccggcaccgccctggtgctgctggaggcccaggccgccaccggcttcatcatcgaccccgtggagaacagaaagctgaccgtggaggaggccttcaaggccggcatgttcggcaaggagacctacgtgaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcatcatcgaccccgtgcacagccacagagtgcccgtggacgtggcctacagatgcggctacttcgacgaggagatgaacagaatcctggccgaccccagcgacgacaccaagggcttcttcgaccccaacacccacgagaacctgacctacctgcagctgctggagagatgcgtggaggaccccgagaccggcctgtacctgctgcagatcatcaagaagggcgagaactacgtgtacatcaacgaggccaccagacacgtgctgcagagcagaaccgccaagatgagagtgggcagattcgccgaccaggtggtgagcttctgggacctgctgagcagcccctacttcaccgaggacagaaagagagagctgatccaggagtacggcgcccagagcggcggcctggagaagctgctggagatcatcaccaccaccatcgaggagaccgagacccagaaccagggcatcaaggtggccgccatcagaggcgaggtgaccgccgccgacctgttcaacagcagagtgatcgaccagaagaccctgcacaccctgagagtgggcagaaccggcggccaggccctgagcaccctggagtgcgtgaagccctacctggagggcagcggctgcatcgccggcgtgaccgtgcccagcaccagagaggtgatgagcctgcacgaggccagcagaaaggagctgatccccgccgccttcgccacctggctgctggaggcccaggccgccaccggcttcctgctggacccctgcaccagacagaagctgagcgtggacgaggccgtggacgtgggcctggtgaacgaggagctgagagagagactgctgaaggccgagagagccgccaccggctacagagaccccgccaccggcgacaccatccccctgttccaggccatgcagaagcagctgatcgagaaggccgaggccctgagactgctggaggtgcaggtggccaccggcggcgtgatcgacccccagcaccaccacagactgcccctggagaccgcctacagaagaggctgcctgcacaaggacatctacgccctgatcagcgaccagaagcacatgagaaagagattcgtggaccccaacacccaggagaaggtgagctacagagagctgcaggagagatgcagaccccaggaggacaccggctggctgctgttccccgtgaacaaggccgccagagacagcgagcacatcgacgacgagaccagaagagccctggaggccgagcaggtggagatcaccgtgggcagattcagaggccagaagcccaccctgtgggccctgctgaacagcgagtacgtgaccgaggagaagaagctgcagctggtgagaatgtacagaacccacaccagaagagccctgcagaccgtggcccagctgatcctggagctgatcgagaagcaggagaccagcaacaagcacctgtggttccagggcatcagaagacagatcaccgccagcgagctgctgagcagcgccatcatcaccgaggagatgctgcaggacctggagaccggcagaagcaccacccaggagctgatggaggacgacagagtgaagagatacctggagggcaccagctgcatcgccggcgtgctggtgcccgccaaggaccagcccggcagacaggagaagatgagcatctaccaggccatgtggaagggcgtgctgagacccggcaccgccctggtgctgctggaggcccaggccgccaccggcttcgtgatcgaccccgtgagaaacctgagactgagcgtggaggaggccgtggccgccggcgtggtgggcggcgagatccaggagaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacgtgcagctgctgagaagatgcgtgcccgaccccgacaccggcctgtacatgctgcagctggccggcagaggcagcgccgtgcaccagctgagcgaggagctgagatgcgccctgagagacgccagagtgacccccggcagcggcgccctgcagggccagagcgtgagcgtgtgggagctgctgttctacagagaggtgagcgaggacagaagacaggacctgctgagcagatacagagccggcaccctgaccgtggaggagctgggcgccaccctgaccagcctgctggcccaggcccaggcccaggccagagccgaggccgaggccggcagccccagacccgaccccagagaggccctgagagccgccaccatggaggtgaaggtgggcagactgagaggcagagccgtgcccgtgtgggacgtgctggccagcggctacgtgagcagagccgccagagaggagctgctggccgagttcggcagcggcaccctggacctgcccgccctgaccagaagactgaccgccatcatcgaggaggccgaggaggcccccggcgccagaccccagctgcaggacgcctggagaggccccagagagcccggccccgccggcagaggcgacggcgacagcggcagaagccagagagagggccagggcgagggcgagacccaggaggccgccgccgccgccgccgccgccgccgccagaagacaggagcagaccctgagagacgccaccatggaggtgcagagaggccagttccagggcagacccgtgagcgtgtgggacgtgctgttcagcagctacctgagcgaggccagaagagacgagctgctggcccagcacgccgccggcgccctgggcctgcccgacctggtggccgtgctgaccagagtgatcgaggagaccgaggagagactgagcaaggtgagcttcagaggcctgagaagacaggtgagcgccagcgagctgcacaccagcggcatcctgggccccgagaccctgagagacctggcccagggcaccaagaccctgcaggaggtgaccgagatggacagcgtgaagagatacctggagggcaccagctgcatcgccggcgtgctggtgcccgccaaggaccagcccggcagacaggagaagatgagcatctaccaggccatgtggaagggcgtgctgagacccggcaccgccctggtgctgctggaggcccaggccgccaccggcttcgtgatcgaccccgtgagaaacctgagactgagcgtggaggaggccgtggccgccggcgtggtgggcggcgagatccaggagaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcgtgatcgaccccgtgcacagccacagagtgcccgtggacgtggcctaccagagaggctacttcgacgaggagatgaacagagtgctggccgaccccagcgacgacaccaagggcttcttcgaccccaacacccacgagaacctgacctacgtgcagctgctgagaagatgcgtgcccgaccccgacaccggcctgtacatgctgcagctggccggcagaggcagcgccgtgcaccagctgagcgaggagctgagatgcgccctgagagacgccagagtgacccccggcagcggcgccctgcagggccagagcgtgagcgtgtgggagctgctgttctacagagaggtgagcgaggacagaagacaggacctgctgagcagatacagagccggcaccctgaccgtggaggagctgggcgccaccctgaccagcctgctggcccaggcccaggcccaggccagagccgaggccgaggccggcagccccagacccgaccccagagaggccctgagagccgccaccatggaggtgaaggtgggcagactgagaggcagagccgtgcccgtgtgggacgtgctggccagcggctacgtgagcagagccgccagagaggagctgctggccgagttcggcagcggcaccctggacctgcccgccctgaccagaagactgaccgccatcatcgaggaggccgaggaggcccccggcgccagaccccagctgcaggacgcctggagaggccccagagagcccggccccgccggcagaggcgacggcgacagcggcagaagccagagagagggccagggcgagggcgagacccaggaggccgccgccgccgccagaagacaggagcagaccctgagagacgccaccatggaggtgcagagaggccagttccagggcagacccgtgagcgtgtgggacgtgctgttcagcagctacctgagcgaggccagaagagacgagctgctggcccagcacgccgccggcgccctgggcctgcccgacctggtggccgtgctgaccagagtgatcgaggagaccgaggagagactgagcaaggtgagcttcagaggcctgagatgccaggtgagcgccagcgagctgcacaccagcggcatcctgggccccgagaccctgagagacctggcccagggcaccaagaccctgcaggaggtgaccgagatggacagcgtgaagagatacctggagggcaccagctgcatcgccggcgtgctggtgcccgccaaggaccagcccggcagacaggagaagatgagcatctaccaggccatgtggaagggcgtgctgagacccggcaccgccctggtgctgctggaggcccaggccgccaccggcttcgtgatcgaccccgtgagaaacctgagactgagcgtggaggaggccgtggccgccggcgtggtgggcggcgagatccaggagaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacgtgcagctgctgagaagatgcgtgcccgaccccgacaccggcctgtacatgctgcagctggccggcagaggcagcgccgtgcaccagctgagcgaggagctgagatgcgccctgagagacgccagagtgacccccggcagcggcgccctgcagggccagagcgtgagcgtgtgggagctgctgttctacagagaggtgagcgaggacagaagacaggacctgctgagcagatacagagccggcaccctgaccgtggaggagctgggcgccaccctgaccagcctgctggcccaggcccaggcccaggccagagccgaggccgaggccggcagccccagacccgaccccagagaggccctgagagccgccaccatggaggtgaaggtgggcagactgagaggcagagccgtgcccgtgtgggacgtgctggccagcggctacgtgagcagagccgccagagaggagctgctggccgagttcggcagcggcaccctggacctgcccgccctgaccagaagactgaccgccatcatcgaggaggccgaggaggcccccggcgccagaccccagctgcaggacgcctggagaggccccagagagcccggccccgccggcagaggcgacggcgacagcggcagaagccagagagagggccagggcgagggcgagacccaggaggccgccgccgccaccgccgccgccagaagacaggagcagaccctgagagacgccaccatggaggtgcagagaggccagttccagggcagacccgtgagcgtgtgggacgtgctgttcagcagctacctgagcgaggccagaagagacgagctgctggcccagcacgccgccggcgccctgggcctgcccgacctggtggccgtgctgaccagagtgatcgaggagaccgaggagagactgagcaaggtgagcttcagaggcctgagaagacaggtgagcgccagcgagctgcacaccagcggcatcctgggccccgagaccctgagagacctggcccagggcaccaagaccctgcaggaggtgaccgagatggacagcgtgaagagatacctggagggcaccagctgcatcgccggcgtgctggtgcccgccaaggaccagcccggcagacaggagaagatgagcatctaccaggccatgtggaagggcgtgctgagacccggcaccgccctggtgctgctggaggcccaggccgccaccggcttcgtgatcgaccccgtgagaaacctgagactgagcgtggaggaggccgtggccgccggcgtggtgggcggcgagatccaggagaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacgtgcagctgctgagaagatgcgtgcccgaccccgacaccggcctgtacatgctgcagctggccggcagaggcagcgccgtgcaccagctgagcgaggagctgagatgcgccctgagagacgccagagtgacccccggcagcggcgccctgcagggccagagcgtgagcgtgtgggagctgctgttctacagagaggtgagcgaggacagaagacaggacctgctgagcagatacagagccggcaccctgaccgtggaggagctgggcgccaccctgaccagcctgctggcccaggcccaggcccaggccagagccgaggccgaggccggcagccccagacccgaccccagagaggccctgagagccgccaccatggaggtgaaggtgggcagactgagaggcagagccgtgcccgtgtgggacgtgctggccagcggctacgtgagcagagccgccagagaggagctgctggccgagttcggcagcggcaccctggacctgcccgccctgaccagaagactgaccgccatcatcgaggaggccgaggaggcccccggcgccagaccccagctgcaggacgcctggagaggccccagagagcccggccccgccggcagaggcgacggcgacagcggcagaagccagagagagggccagggcgagggcgagacccaggaggccgccgccgccaccgccgccgccagaagacaggagcagaccctgagagacgccaccatggaggtgcagagaggccagttccagggcagacccgtgagcgtgtgggacgtgctgttcagcagctacctgagcgaggccagaagagacgagctgctggcccagcacgccgccggcgccctgggcctgcccgacctggtggccgtgctgaccagagtgatcgaggagaccgaggagagactgagcaaggtgagcttcagaggcctgagaagacaggtgagcgccagcgagctgcacaccagcggcatcctgggccccgagaccctgagagacctggcccagggcaccaagaccctgcaggaggtgaccgagatggacagcgtgaagagatacctggagggcaccagctgcatcgccggcgtgctggtgcccgccaaggaccagcccggccaccaggagaagatgagcatctaccaggccatgtggaagggcgtgctgagacccggcaccgccctggtgctgctggaggcccaggccgccaccggcttcgtgatcgaccccgtgagaaacctgagactgagcgtggaggaggccgtggccgccggcgtggtgggcggcgagatccaggagaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggcccaccccagcgacgacaccaagggcttcttcgaccccaacacccacgagaacctgacctacgtgcagctgctgagaagatgcgtgcccgaccccgacaccggcctgtacatgctgcagctggccggcagaggcagcgccgtgcaccagctgagcgaggagctgagatgcgccctgagagacgccagagtgatgcccggcagcggcgccctgcagggccagagcgtgagcgtgtgggagctgctgttctacagagaggtgagcgaggacagaagacaggacctgctgagcagatacagagccggcaccctgaccgtggaggagctgggcgccaccctgaccagcctgctggcccaggcccaggcccaggccagagccgaggccgaggccgaggccggcagccccagacccgaccccagagaggccctgagagccgccaccatggaggtgaaggtgggcagactgagaggcagagccgtgcccgtgtgggacgtgctggccagcggctacgtgagcggcgccgccagagaggagctgctggccgagttcggcagcggcaccctggacctgcccgccctgaccagaagactgaccgccatcatcgaggaggccgaggaggcccccggcgccagaccccagctgcaggacgcctggagaggccccagagagcccggccccgccggcagaggcgacggcgacagcggcagaagccagagagagggccagggcgagggcgagacccaggaggccgccgccgccgccagaagacaggagcagaccctgagagacgccaccatggaggtgcagagaggccagttccagggcagacccgtgagcgtgtgggacgtgctgttcagcagctacctgagcgaggcccacagagacgagctgctggcccagcacgccgccggcgccctgggcctgcccgacctggtggccgtgctgaccagagtgatcgaggagaccgaggagagactgagcaaggtgagcttcagaggcctgagaagacaggtgagcgccagcgagctgcacaccagcggcatcctgggccccgagaccctgagagacctggcccagggcaccaagaccctgcaggaggtgaccgagatggacagcgtgaagagatacctggagggcaccagctgcatcgccggcgtgctggtgcccgccaaggaccagcccggcagacaggagaagatgagcatctaccaggccatgtggaagggcgtgctgagacccggcaccgccctggtgctgctggaggcccaggccgccaccggcttcgtgatcgaccccgtgagaaacctgagactgagcgtggaggaggccgtggccgccggcgtggtgggcggcgagatccaggagaagctgctgagcgccgagagagccgtgaccggctacaccgacccctacaccggccagcagatcagcctgttccaggccatgcagaaggacctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctgcagagagccaccctggaccccgagaccggcctgctgttcctgagcctgagcctgcagtag

SEQ ID NO: 20707 - DNA, 2715 bp, Artificial Sequence
  Description of Artificial Sequence: Synthetic coding sequence
atggagagcttccacaccagattcagcgcctggacccccttcagcaacaagagcctgaacagacagctgttccaggagagagtggccctgatcagccactggttcgacctgtggaccaacaagcagagacaggagttcctgttcgccatcttcctgagatgcaccaagagccagctgagattcgtgcaggactggttcagcgagagaatgcaggtggccaaggtggacttcagcaccgtgctgcccagattcatcagcctgtacatcttcagcttcctgagccccaaggacctgtgcgccgccgcccaggtgagctggccctggaagttcctgaccgagcaggactgcctgtggatgcccaagtgcgtgaagttcggctggttcctgccctacacccccaccgacaacgagtacggcgcctggaagagacactacatcgcctgcgtgagccacctggactggctgacccccagagaggccgccgccacctacggcaccctgaacgagcccaagaccgaggacgaggagctgctggagagacagagagagaagtgcctgagaaagagaatctgggagaagatcgccctgagaaagaaggagctgttcaaggtgagacccccctgggtgagcggcacctgctgcagcagcgtgctgaagcccagatgccagcccagactgagccagaccgtgagagagagagtgggcctgcacgaggccctggagaagcagctggtgctgaccagcctggagaccctgcccaagagaagcaacatcagcggcagccacagctaccccctgctgagcaagaagaactggcacggcgtgcacaagaacgacgacagaagcagctacgccctgagaccccacttcatgctgatcagcagcagaatccccgcctacgagatggtgatggagagcgtgaaggccggcgtggtgagcgtggtgtacgagcacagcgtgaccctggagagcctgctgtacctgatcgagaaggccctggacggccagaaggcccagagcatcggcatcttcagcgacggcgacagcagagagatcaacctgctgcagggctacaagatcggcgtgaagaacctgctgagacccgaggtgagagacttctgggagaagctgggcagctacgtggccaccgaggaggagggcggccacgtggacttcttcgtgcccctgggcgccagcgaggccggcatcgaggtgctgagccagctgagccagctgaccggcaccttcttcaccgcccccaccggcatcgccaccggcagctaccagcacatcctgagcgactggctgggcagccagtggggcaaggcccccagcagcatctacttctgcgagagcaagctgcagacctggagcagcttcaccgacttcctggaggagaccctgaagaccgtgagaaagcagctgtaccccttcttcaaggagctgcagaagagcatcagcggcagaatgatcggccagttcatgttcgacaccatgggcatgaccaacatcctgaacaaccaggacaccgcccaggccctggccgacggcctgatggagctgagcaaggaggacagcgagagaaacgtggtggaggacaacagctgggacaccaagagcagactgagcaagaacgacctgaacttcgaggccctgatcaacctggagagaatcctgcagaaggacagcgccgagaagagagccagagtggtgagagagctgctgcagagcgagagaaagtacgtgcagatcctggagatcgtgagagacgtgtacgtggcccccctgaaggccgccctgagcagcaacagagccatcctgagcgccgccaacatccagatcatcttctgcgacatcctgcagatcctgagcctgaacagacagttcctggacaacctgagagacagactgcaggagtggggccccgcccactgcgtgggcgagatcgtgaccaagttcggcagccagctgaacacctacaccaacttcttcaacaactaccccgtgatcctgaagaccatcgagaagtgcagagagatgatccccgccttcagaaccttcctgaagagacacgacaagaccatcgtgaccaagatgctgagcctgcccgagctgctgctgtaccccagcagaagattcgaggagtacctgaacctgctgtacgccgtgagactgcacacccccgccgagcacgtggacagaggcgacctgaccaccgccatcgaccagatcaagaagtacaagggctacatcgaccagatgaagcagaacatcaccatgaaggaccacctgagcgacatccagagaatcatctggggctgccccaccctgagcgaggtgaacagatacctgatcagagtgcaggacgtggcccagctgcactgctgcgacgaggagatcagcttcagcctgagactgtacgagcacatccacgacctgagcctgttcctgttcaacgacgccctgctggtgagcagcagaggcaccagccacacccccttcgagagaaccagcaagaccacctaccagttcatcgccagcgtggccctgcacagactgctgatcgagaacatccccgacagcaagtacgtgaagaacgccttcatcctgcagggccccaagtacaagtggatctgcgccaccgagatcgaggacgacaagttcctgtggctgagcgtgctgagaaacgccatcaagagcagcatggagaagtag

SEQ ID NO: 20708 - DNA, 234 bp, Artificial Sequence
  Description of Artificial Sequence: Synthetic coding sequence
atggagagcttccacaccagattcagcgcctggacccccttcagcaacaagagcctgaacagacagctgttccaggagagagtggccctgatcagccactggttcgacctgtggaccaacaagcagagacaggagttcctgttcgccatcttcctgagatgcaccaagagccagctgagattcgtgcaggactggttcagcgagagaatgcaggtggccaaggtggacttctag

SEQ ID NO: 20709 - DNA, 2715 bp, Artificial Sequence; identical to SEQ ID NO: 20707
  Description of Artificial Sequence: Synthetic coding sequence

SEQ ID NO: 20710 - DNA, 2277 bp, Artificial Sequence
  Description of Artificial Sequence: Synthetic coding sequence
atgcaggtggccaaggtggacttcagcaccgtgctgcccagattcatcagcctgtacatcttcagcttcctgagccccaaggacctgtgcgccgccgcccaggtgagctggccctggaagttcctgaccgagcaggactgcctgtggatgcccaagtgcgtgaagttcggctggttcctgccctacacccccaccgacaacgagtacggcgcctggaagagacactacatcgcctgcgtgagccacctggactggctgacccccagagaggccgccgccacctacggcaccctgaacgagcccaagaccgaggacgaggagctgctggagagacagagagagaagtgcctgagaaagagaatctgggagaagatcgccctgagaaagaaggagctgttcaaggtgagacccccctgggtgagcggcacctgctgcagcagcgtgctgaagcccagatgccagcccagactgagccagaccgtgagagagagagtgggcctgcacgaggccctggagaagcagctggtgctgaccagcctggagaccctgcccaagagaagcaacatcagcggcagccacagctaccccctgctgagcaagaagaactggcacggcgtgcacaagaacgacgacagaagcagctacgccctgagaccccacttcatgctgatcagcagcagaatccccgcctacgagatggtgatggagagcgtgaaggccggcgtggtgagcgtggtgtacgagcacagcgtgaccctggagagcctgctgtacctgatcgagaaggccctggacggccagaaggcccagagcatcggcatcttcagcgacggcgacagcagagagatcaacctgctgcagggctacaagatcggcgtgaagaacctgctgagacccgaggtgagagacttctgggagaagctgggcagctacgtggccaccgaggaggagggcggccacgtggacttcttcgtgcccctgggcgccagcgaggccggcatcgaggtgctgagccagctgagccagctgaccggcaccttcttcaccgcccccaccggcatcgccaccggcagctaccagcacatcctgagcgactggctgggcagccagtggggcaaggcccccagcagcatctacttctgcgagagcaagctgcagacctggagcagcttcaccgacttcctggaggagaccctgaagaccgtgagaaagcagctgtaccccttcttcaaggagctgcagaagagcatcagcggcagaatgatcggccagttcatgttcgacaccatgggcatgaccaacatcctgaacaaccaggacaccgcccaggccctggccgacggcctgatggagctgagcaaggaggacagcgagagaaacgtggtggaggacaacagctgggacaccaagagcagactgagcaagaacgacctgaacttcgaggccctgatcaacctggagagaatcctgcagaaggacagcgccgagaagagagccagagtggtgagagagctgctgcagagcgagagaaagtacgtgcagatcctggagatcgtgagagacgtgtacgtggcccccctgaaggccgccctgagcagcaacagagccatcctgagcgccgccaacatccagatcatcttctgcgacatcctgcagatcctgagcctgaacagacagttcctggacaacctgagagacagactgcaggagtggggccccgcccactgcgtgggcgagatcgtgaccaagttcggcagccagctgaacacctacaccaacttcttcaacaactaccccgtgatcctgaagaccatcgagaagatgaagcagaacatcaccatgaaggaccacctgagcgacatccagagaatcatctggggctgccccaccctgagcgaggtgaacagatacctgatcagagtgcaggacgtggcccagctgcactgctgcgacgaggagatcagcttcagcctgagactgtacgagcacatccacgacctgagcctgttcctgttcaacgacgccctgctggtgagcagcagaggcaccagccacacccccttcgagagaaccagcaagaccacctaccagttcatcgccagcgtggccctgcacagactgctgatcgagaacatccccgacagcaagtacgtgaagaacgccttcatcctgcagggccccaagtacaagtggatctgcgccaccgagatcgaggacgacaagttcctgtggctgagcgtgctgagaaacgccatcaagagcagcatggagaagtag

SEQ ID NO: 20711 - DNA, 987 bp, Artificial Sequence
  Description of Artificial Sequence: Synthetic coding sequence
atggccaccaagagactggccagacagctgggcctgatcagaagaaagagcatcgcccccgccaacggcaacctgggcagaagcaagagcaagcagctgttcgactacctgatcgtgatcgacttcgagagcacctgctggaacgacggcaagcaccaccacagccaggagatcatcgagttccccgccgtgctgctgaacaccagcaccggccagatcgacagcgagttccaggcctacgtgcagccccaggagcaccccatcctgagcgagttctgcatggagctgaccggcatcaagcaggcccaggtggacgagggcgtgcccctgaagatctgcctgagccagttctgcaagtggatccacaagatccagcagcagaagaacatcatcttcgccaccggcatcagcgagcccagcgccagcgaggtgaagctgtgcgccttcgtgacctggagcgactgggacctgggcgtgtgcctggagtacgagtgcaagagaaagcagctgctgaagcccgtgttcctgaacagctggatcgacctgagagccacctacaagctgttctacagaagaaagcccaagggcctgagcggcgccctgcaggaggtgggcatcgagttcagcggcagagagcacagcggcctggacgacagcagaaacaccgccctgctggcctggaagatgatcagagacggctgcgtgatgaagatcaccagaagcctgaacaagggccccttcctgctgcccagctggacctggaacagcgacctggccagcggcgaccagcacgccttcctgcagcaggagttcggctgcggcacctacagaaccctgctgcagaagcccaacatgagcaagcaggagaagggcaacatcctgtggctgaccatggtgtggctgagcctggcctgcctgcagagaaagaactacaacgactgcatgctgaacaccgccagccagaccgtgaccaccgagaagttctag

SEQ ID NO: 20712 - DNA, 2076 bp, Artificial Sequence
  Description of Artificial Sequence: Synthetic coding sequence
atggccaccaagagactggccagacagctgggcctgatcagaagaaagagcatcgcccccgccaacggcaacctgggcagaagcaagagcaagcagctgttcgactacctgatcgtgatcgacttcgagagcacctgctggaacgacggcaagcaccaccacagccaggagatcatcgagttccccgccgtgctgctgaacaccagcaccggccagatcgacagcgagttccaggcctacgtgcagccccaggagcaccccatcctgagcgagttctgcatggagctgaccggcatcaagcaggcccaggtggacgagggcgtgcccctgaagatctgcctgagccagttctgcaagtggatccacaagatccagcagcagaagaacatcatcttcgccaccggcatcagcgagcccagcgccagcgaggtgaagctgtgcgccttcgtgacctggagcgactgggacctgggcgtgtgcctggagtacgagtgcaagagaaagcagctgctgaagcccgtgttcctgaacagctggatcgacctgagagccacctacaagctgttctacagaagaaagcccaagggcctgagcggcgccctgcaggaggtgggcatcgagttcagcggcagagagcacagcggcctggacgacagcagaaacaccgccctgctggcctggaagatgatcagagacggctgcgtgatgaagatcaccagaagcctgaacaaggtgcccaccaagaagaacttcagcatcctggccagaaacctgaacaccatccaggtggaggagatgagcgcctgcaacatcagcatccagggccccagcatctacaacaaggagcccaagaacatcatcaacccccacgagaaggtgcagatgaagagcatctgcgccaacagccccatcaaggcccagcaggaccagctgcaggtgaagaacaacatcaaggccagcctgcacaacgtgaagagcagcctgcccctgttcaacaccaagagcagcaccagcgtgggccagctgcagagccccaccctgaacagccccatctacatgcagaagcagggcaagaacgagcacctggccttcaacaccaagagcaaggccagcaccgtgggcagcgagctggtgctggtgagcaccaccgtgcccaccgtgcaccacgtgagcgacctggagatgagcagcaccctggactgcctgcccgtgctggccgactgggaggacgtggtgctgctgcccgccagccagcccgaggagaacgtggactgcaccgtgcccatcagcgacagcgacctggagatcagcttcaacagcggcgagagactgatggtgctgaaggagctggagatgagcagccacgagaacttcggcgacatcgaggagaccccccagaagagcgagaccagcaagagcatcgtgtacaagagcccccacaccaccatctacaacgtgaaggaggccaaggaccccggcagcgacatcagcgccttcaagctgcccgagcacaagagcagcaccttcaacagagtgaacgccaacatgagccaccccctggtgctgggcaagcaccccctgctgagcggcggcaccaagagaaacccctgcagcccccaggccttcccccccgccaagaagcagcccttcaccatccacgaggagaagcccaccagcagcgactgcagccccgtgagaagcagcagctggagaagactgcccagcatcctgaccagcaccgtgaacctgcaggagccctggaagagcggcaagatgaccccccccctgtgcaagtgcggcagaagaagcaagagactggtggtgagcaacaacggccccaaccacggcaaggtgttctactgctgccccatcggcaagtaccaggagaacagaaagtgctgcggctacttcaagtgggagcagaccctgcagaaggagagagccaacagcatggtgcccagccacagcaccggcggcctgaccttcagcagccccgagaccagccacatctgcgacagaaacctgagcatcagcaccaagaacagcctgagactgagacccagcatgagaaactag

SEQ ID NO: 20713 - DNA, 1281 bp, Artificial Sequence
  Description of Artificial Sequence: Synthetic coding sequence
atgagcgcctgcaacatcagcatccagggccccagcatctacaacaaggagcccaagaacatcatcaacccccacgagaaggtgcagatgaagagcatctgcgccaacagccccatcaaggcccagcaggaccagctgcaggtgaagaacaacatcaaggccagcctgcacaacgtgaagagcagcctgcccctgttcaacaccaagagcagcaccagcgtgggccagctgcagagccccaccctgaacagccccatctacatgcagaagcagggcaagaacgagcacctggccttcaacaccaagagcaaggccagcaccgtgggcagcgagctggtgctggtgagcaccaccgtgcccaccgtgcaccacgtgagcgacctggagatgagcagcaccctggactgcctgcccgtgctggccgactgggaggacgtggtgctgctgcccgccagccagcccgaggagaacgtggactgcaccgtgcccatcagcgacagcgacctggagatcagcttcaacagcggcgagagactgatggtgctgaaggagctggagatgagcagccacgagaacttcggcgacatcgaggagaccccccagaagagcgagaccagcaagagcatcgtgtacaagagcccccacaccaccatctacaacgtgaaggaggccaaggaccccggcagcgacatcagcgccttcaagctgcccgagcacaagagcagcaccttcaacagagtgaacgccaacatgagccaccccctggtgctgggcaagcaccccctgctgagcggcggcaccaagagaaacccctgcagcccccaggccttcccccccgccaagaagcagcccttcaccatccacgaggagaagcccaccagcagcgactgcagccccgtgagaagcagcagctggagaagactgcccagcatcctgaccagcaccgtgaacctgcaggagccctggaagagcggcaagatgaccccccccctgtgcaagtgcggcagaagaagcaagagactggtggtgagcaacaacggccccaaccacggcaaggtgttctactgctgccccatcggcaagtaccaggagaacagaaagtgctgcggctacttcaagtgggagcagaccctgcagaaggagagagccaacagcatggtgcccagccacagcaccggcggcctgaccttcagcagccccgagaccagccacatctgcgacagaaacctgagcatcagcaccaagaacagcctgagactgagacccagcatgagaaactag

SEQ ID NO: 20714 - DNA, 696 bp, Artificial Sequence
  Description of Artificial Sequence: Synthetic coding sequence
atggtgagcttccccccccagagataccactacttcctggtgctggacttcgaggccacctgcgacaagccccagatccacccccaggagatcatcgagttccccatcctgaagctgaacggcagaaccatggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgatgctgcccggccagtgccagtacctgggcctgcccgtggccgactacttcaagcagtggatcaacctgaagaagggcagcagccccggcaccgccagcggcaccagctgctaccagagcgaggaggcccagagaaaggagaacacccccggcgtgaaggcctacagcttcgccatgggctgctggcccaagaacggcctgctggacatgaacaagggcctgagcctgcagcacatcggcagaccccacagcggcatcgacgactgcaagaacatcgccaacatcatgaagaccctggcctacagaggcttcatcttcaagcagaccagcaagcccttctag

SEQ ID NO: 20715 - DNA, 1014 bp, Artificial Sequence
  Description of Artificial Sequence: Synthetic coding sequence
atggccaccgccagccccgccgccgacggcggcagaggcagaccctgggagggcggcctggtgagctggccccccgccccccccctgaccctgccctggacctggatgggccccagctggggccagcaccccggccactggggcttccccgccctgaccgagcccagcgccagccccgccgccggcctgggcatcttcgaggtgagaagagtgctggacgccagcggctgcagcatgctggcccccctgcagaccggcgccgccagattcagcagctacctgctgagcagagccagaaaggtgctgggcagccacctgttcagcccctgcggcgtgcccgagttctgcagcatcagcaccagaaagctggccgcccacggcttcggcgccagcatggccgccatggtgagcttccccccccagagataccactacttcctggtgctggacttcgaggccacctgcgacaagccccagatccacccccaggagatcatcgagttccccatcctgaagctgaacggcagaaccatggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgatgctgcccggccagtgccagtacctgggcctgcccgtggccgactacttcaagcagtggatcaacctgaagaaggcctacagcttcgccatgggctgctggcccaagaacggcctgctggacatgaacaagggcctgagcctgcagcacatcggcagaccccacagcggcatcgacgactgcaagaacatcgccaacatcatgaagaccctggcctacagaggcttcatcttcaagcagaccagcaagcccttctag

SEQ ID NO: 20716 - DNA, 669 bp, Artificial Sequence
  Description of Artificial Sequence: Synthetic coding sequence
atgttcgtgatgctgcaggtgccctggctgcagagctgcgccaacctggtgcagatcggcgcccccctgcccctgctgggctgcctgggccagtacttcgaggtgctgggcagcatggaggtgctggccggccagtacggcatggagatcatcgagttccccatcctgaagctgaacggcagaaccatggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgatgctgcccggccagtgccagtacctgggcctgcccgtggccgactacttcaagcagtggatcaacctgaagaaggcctacagcttcgccatgggctgctggcccaagaacggcctgctggacatgaacaagggcctgagcctgcagcacatcggcagaccccacagcggcatcgacgactgcaagaacatcgccaacatcatgaagaccctggcctacagaggcttcatcttcaagcagaccagcaagcccttctag

SEQ ID NO: 20717 - DNA, 660 bp, Artificial Sequence
  Description of Artificial Sequence: Synthetic coding sequence
atggccaccgccagccccgccgccgacggcggcagaggcagaccctgggagggcggcctggtgagctggccccccgccccccccctgaccctgccctggacctggatgggccccagctggggccagcaccccggcgagatcatcgagttccccatcctgaagctgaacggcagaaccatggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgatgctgcccggccagtgccagtacctgggcctgcccgtggccgactacttcaagcagtggatcaacctgaagaaggcctacagcttcgccatgggctgctggcccaagaacggcctgctggacatgaacaagggcctgagcctgcagcacatcggcagaccccacagcggcatcgacgactgcaagaacatcgccaacatcatgaagaccctggcctacagaggcttcatcttcaagcagaccagcaagcccttctag

SEQ ID NO: 20718 - DNA, 531 bp, Artificial Sequence
  Description of Artificial Sequence: Synthetic coding sequence
atggccaccgccagccccgccgccgacggcggcagaggcagaccctgggagggcggcctggtgagctggccccccgccccccccctgaccctgccctggacctggatgggccccagctggggccagcaccccggcgagatcatcgagttccccatcctgaagctgaacggcagaaccatggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgatgctgcccggccagtgccagtacctgggcctgcccgtggccgactacttcaagcagtggatcaacctgaagaaggcctacagcttcgccatgggctgctggcccaagaacggcctgctggacatgtag

SEQ ID NO: 20719 - DNA, 615 bp, Artificial Sequence
  Description of Artificial Sequence: Synthetic coding sequence
ctgcaggagatcatcgagttccccatcctgaagctgaacggcagaaccatggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgatgctgcccggccagtgccagtacctgggcctgcccgtggccgactacttcaagcagtggatcaacctgaagaagggcagcagccccggcaccgccagcggcaccagctgctaccagagcgaggaggcccagagaaaggagaacacccccggcgtgaaggcctacagcttcgccatgggctgctggcccaagaacggcctgctggacatgaacaagggcctgagcctgcagcacatcggcagaccccacagcggcatcgacgactgcaagaacatcgccaacatcatgaagaccctggcctacagaggcttcatcttcaagcagaccagcaagcccttctag

SEQ ID NO: 20720 - DNA, 753 bp, Artificial Sequence
  Description of Artificial Sequence: Synthetic coding sequence
atggccaccgccagccccgccgccgacggcggcagaggcagaccctgggagggcggcctggtgagctggccccccgccccccccctgaccctgccctggacctggatgggccccagctggggccagcaccccggccactggggcttccccgccctgaccgagcccagcgccagccccgccgccggcctgggcatcttcgaggtgagaagagacgccagcggctgcagcatgctggcccccctgcagaccggcgccgccagattcagcagctacctgctgagcagagccagaaaggtgctgggcagccacctgttcagcccctgcggcgtgcccgagttctgcagcatcagcaccagaaagctggccgcccacggcttcggcgccagcatggccgccatggtgagcttccccccccagagataccactacttcctggtgctggacttcgaggccacctgcgacaagccccagatccacccccaggagatcatcgagttccccatcctgaagctgaacggcagaaccatggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgtag

SEQ ID NO: 20721 - DNA, 483 bp, Artificial Sequence
  Description of Artificial Sequence: Synthetic coding sequence
atggagatcgagagcaccttccacatgtacgtgcagcccgtggtgcacccccagctgacccccttctgcaccgagctgaccggcatcatccaggccatggtggacggccagcccagcctgcagcaggtgctggagagagtggacgagtggatggccaaggagggcctgctggaccccaacgtgaagagcatcttcgtgacctgcggcgactgggacctgaaggtgatgctgcccggccagtgccagtacctgggcctgcccgtggccgactacttcaagcagtggatcaacctgaagaaggcctacagcttcgccatgggctgctggcccaagaacggcctgctggacatgaacaagggcctgagcctgcagcacatcggcagaccccacagcggcatcgacgactgcaagaacatcgccaacatcatgaagaccctggcctacagaggcttcatcttcaagcagaccagcaagcccttctag

SEQ ID NO: 20722 - DNA, 3018 bp, Artificial Sequence
  Description of Artificial Sequence: Synthetic coding sequence
atggagaagcagagagccctggtggccgccaaggacggcgacgtggccaccctggagagactgctggaggccggcgccctgggccccggcatcaccgacgccctgggcgccggcctggtgcaccacgccaccagagccggccacctggactgcgtgaagttcctggtgcagagagcccagctgcccggcaaccagagagcccacaacggcgccacccccgcccacgacgccgccgccaccggcagcctggccgagctgtgctggctggtgagagagggcggctgcggcctgcaggaccaggacgccagcggcgtgagccccctgcacctggccgccagattcggccaccccgtgctggtggagtggctgctgcacgagggccacagcgccaccctggagaccagagagggcgccagacccctgcaccacgccgccgtgagcggcgacctgacctgcctgaagctgctgaccgccgcccacggcagcagcgtgaacagaagaaccagaagcggcgccagccccctgtacctggcctgccaggagggccacctgcacctggcccagttcctggtgaaggactgcggcgccgacgtgcacctgagagccctggacggcatgagcgccctgcacgccgccgccgccagaggccactacagcctggtggtgtggctggtgaccttcaccgacatcggcctgaccgccagagacaacgagggcgccaccgccctgcacttcgccgccagaggcggccacacccccatcctggacagactgctgctgatgggcacccccatcctgagagacagctggggcggcacccccctgcacgacgccgccgagaacggccagatggagtgctgccagaccctggtgagccaccacgtggaccccagcctgagagacgaggacggctacaccgccgccgacctggccgagtaccacggccacagagactgcgcccagtacctgagagaggtggcccagcccgtgcccctgctgatgacccccccccccccccccttcccccccccccccctgctggccaccagaagaagcctggaggacggcagaagaggcggccccggccccggcaaccccagccccatgagcctgagccccgcctggcccggccaccccgaccagcccctgcccagagagcagatgaccagccccgccccccccagaatcatcaccagcgccaccgccgaccccgagggcaccgagaccgccctggccggcgacaccagcgacggcctggccgccctgcagctggacggcctgcccagcggcgacatcgacggcctggtgcccaccagagacgagagaggccagcccatccccgagtggaagagacaggtgatggtgagaaagctgcaggccagactgggcgccgagagcagcgccgaggcccaggacaacggcggcagcagcggccccaccgagcaggccgcctggagatacagccagacccaccaggccatcctgggccccttcggcgagctgctgaccgaggacgacctggtgtacctggagaagcagatcgccgacctgcagctgagaagaagatgccaggagtacgagagcgagctgggcagactggccgccgagctgcaggccctgctgcccgagcccctggtgagcatcaccgtgaacagccacttcctgcccagagcccccggcctggaggtggaggaggccagcatccccgccgccgagcccgccggcagcgccgaggccagcgaggtggcccccggcgtgcagcccctgcccttctggtgcagccacatcagcagactggtgagaagcctgagcctgctgctgaagggcgtgcacggcctggtgcagggcgacgagaagcccagcaccagacccctgcaggacacctgcagagaggccagcgccagcccccccagaagcgaggcccagagacagatccaggagtggggcgtgagcgtgagaaccctgagaggcaacttcgagagcgccagcggccccctgtgcggcttcaaccccggcccctgcgagcccggcgcccagcacagacagtgcctgagcggctgctggcccgccctgcccaagcccagaagcggcctggccagcggcgagcccagacccggcgacaccgaggaggccagcgacagcggcatcagctgcgaggaggtgcccagcgaggccggcgccgccgccggccccgacctggccagcctgagaaaggagagaatcatcatgctgttcctgagccactggagaagaagcgcctacacccccgccctgaagaccgtggcctgcagaaccctgggcgccagacacgccggcctgagaggccaggaggccgccagaagccccggcccccccagcccccccagcgagggccccagactgggccacctgtggcagcagagaagcaccatcacccacctgctgggcaactggaaggccatcatggcccacgtgcccgccagacagctgagaagactgagcagacagcccagaggcgccctgagccccgagcagttcctgccccacgtggacggcgcccccgtgccctacagcagcctgagcctggacctgttcatgctgggctacttccagctgctggagtgcgacctgcccgccgaggagagaaagctgagacacctgctgtgcttcgaggtgttcgagcacctgggcacccacggctgggaggccgtgagagccttccacaaggccgtgaccgacgaggtggccgccggcagaagagcctggaccgacggcttcgaggacatcaaggccagattcttcggcagcagccagagacccgcctgggacaccgagcccggcagaaagagcggcctgaccctgctgggccccctgccccacgccgccgtgccctgcagcggccccgagcccaccgcccagagactgggcagcagaagccagcagggcagcttcaacggcgaggacatctgcggctacatcaacagaagcttcgccttctggaaggagaaggaggccgagatgttcaacttcggcgagtag

SEQ ID NO: 20723 - DNA, 2886 bp, Artificial Sequence
  Description of Artificial Sequence: Synthetic coding sequence
atggagaagcagagagccctggtggccgccaaggacggcgacgtggccaccctggagagactgctggaggccggcgccctgggccccggcatcaccgacgccctgggcgccggcctggtgcaccacgccaccagagccggccacctggactgcgtgaagttcctggtgcagagagcccagctgcccggcaaccagagagcccacaacggcgccacccccgcccacgacgccgccgccaccggcagcctggccgagctgtgctggctggtgagagagggcggctgcggcctgcaggaccaggacgccagcggcgtgagccccctgcacctggccgccagattcggccaccccgtgctggtggagtggctgctgcacgagggccacagcgccaccctggagaccagagagggcgccagacccctgcaccacgccgccgtgagcggcgacctgacctgcctgaagctgctgaccgccgcccacggcagcagcgtgaacagaagaaccagaagcggcgccagccccctgtacctggcctgccaggagggccacctgcacctggcccagttcctggtgaaggactgcggcgccgacgtgcacctgagagccctggacggcatgagcgccctgcacgccgccgccgccagaggccactacagcctggtggtgtggctggtgaccttcaccgacatcggcctgaccgccagagacaacgagggcgccaccgccctgcacttcgccgccagaggcggccacacccccatcctggacagactgctgctgatgggcacccccatcctgagagacagctggggcggcacccccctgcacgacgccgccgagaacggccagatggaggtgcccctgctgatgacccccccccccccccccttcccccccccccccctgctggccaccagaagaagcctggaggacggcagaagaggcggccccggccccggcaaccccagccccatgagcctgagccccgcctggcccggccaccccgaccagcccctgcccagagagcagatgaccagccccgccccccccagaatcatcaccagcgccaccgccgaccccgagggcaccgagaccgccctggccggcgacaccagcgacggcctggccgccctgcagctggacggcctgcccagcggcgacatcgacggcctggtgcccaccagagacgagagaggccagcccatccccgagtggaagagacaggtgatggtgagaaagctgcaggccagactgggcgccgagagcagcgccgaggcccaggacaacggcggcagcagcggccccaccgagcaggccgcctggagatacagccagacccaccaggccatcctgggccccttcggcgagctgctgaccgaggacgacctggtgtacctggagaagcagatcgccgacctgcagctgagaagaagatgccaggagtacgagagcgagctgggcagactggccgccgagctgcaggccctgctgcccgagcccctggtgagcatcaccgtgaacagccacttcctgcccagagcccccggcctggaggtggaggaggccagcatccccgccgccgagcccgccggcagcgccgaggccagcgaggtggcccccggcgtgcagcccctgcccttctggtgcagccacatcagcagactggtgagaagcctgagcctgctgctgaagggcgtgcacggcctggtgcagggcgacgagaagcccagcaccagacccctgcaggacacctgcagagaggccagcgccagcccccccagaagcgaggcccagagacagatccaggagtggggcgtgagcgtgagaaccctgagaggcaacttcgagagcgccagcggccccctgtgcggcttcaaccccggcccctgcgagcccggcgcccagcacagacagtgcctgagcggctgctggcccgccctgcccaagcccagaagcggcctggccagcggcgagcccagacccggcgacaccgaggaggccagcgacagcggcatcagctgcgaggaggtgcccagcgaggccggcgccgccgccggccccgacctggccagcctgagaaaggagagaatcatcatgctgttcctgagccactggagaagaagcgcctacacccccgccctgaagaccgtggcctgcagaaccctgggcgccagacacgccggcctgagaggccaggaggccgccagaagccccggcccccccagcccccccagcgagggccccagactgggccacctgtggcagcagagaagcaccatcacccacctgctgggcaactggaaggccatcatggcccacgtgcccgccagacagctgagaagactgagcagacagcccagaggcgccctgagccccgagcagttcctgccccacgtggacggcgcccccgtgccctacagcagcctgagcctggacctgttcatgctgggctacttccagctgctggagtgcgacctgcccgccgaggagagaaagctgagacacctgctgtgcttcgaggtgttcgagcacctgggcacccacggctgggaggccgtgagagccttccacaaggccgtgaccgacgaggtggccgccggcagaagagcctggaccgacggcttcgaggacatcaaggccagattcttcggcagcagccagagacccgcctgggacaccgagcccggcagaaagagcggcctgaccctgctgggccccctgccccacgccgccgtgccctgcagcggccccgagcccaccgcccagagactgggcagcagaagccagcagggcagcttcaacggcgaggacatctgcggctacatcaacagaagcttcgccttctggaaggagaaggaggccgagatgttcaacttcggcgagtag

SEQ ID NO: 20724 - DNA, 1914 bp, Artificial Sequence
  Description of Artificial Sequence: Synthetic coding sequence
atgagcctgagccccgcctggcccggccaccccgaccagcccctgcccagagagcagatgaccagccccgccccccccagaatcatcaccagcgccaccgccgaccccgagggcaccgagaccgccctggccggcgacaccagcgacggcctggccgccctgcagctggacggcctgcccagcggcgacatcgacggcctggtgcccaccagagacgagagaggccagcccatccccgagtggaagagacaggtgatggtgagaaagctgcaggccagactgggcgccgagagcagcgccgaggcccaggacaacggcggcagcagcggccccaccgagcaggccgcctggagatacagccagacccaccaggccatcctgggccccttcggcgagctgctgaccgaggacgacctggtgtacctggagaagcagatcgccgacctgcagctgagaagaagatgccaggagtacgagagcgagctgggcagactggccgccgagctgcaggccctgctgcccgagcccctggtgagcatcaccgtgaacagccacttcctgcccagagcccccggcctggaggtggaggaggccagcatccccgccgccgagcccgccggcagcgccgaggccagcgaggtggcccccggcgtgcagcccctgcccttctggtgcagccacatcagcagactggtgagaagcctgagcctgctgctgaagggcgtgcacggcctggtgcagggcgacgagaagcccagcaccagacccctgcaggacacctgcagagaggccagcgccagcccccccagaagcgaggcccagagacagatccaggagtggggcgtgagcgtgagaaccctgagaggcaacttcgagagcgccagcggccccctgtgcggcttcaaccccggcccctgcgagcccggcgcccagcacagacagtgcctgagcggctgctggcccgccctgcccaagcccagaagcggcctggccagcggcgagcccagacccggcgacaccgaggaggccagcgacagcggcatcagctgcgaggaggtgcccagcgaggccggcgccgccgccggccccgacctggccagcctgagaaaggagagaatcatcatgctgttcctgagccactggagaagaagcgcctacacccccgccctgaagaccgtggcctgcagaaccctgggcgccagacacgccggcctgagaggccaggaggccgccagaagccccggcccccccagcccccccagcgagggccccagactgggccacctgtggcagcagagaagcaccatcacccacctgctgggcaactggaaggccatcatggcccacgtgcccgccagacagctgagaagactgagcagacagcccagaggcgccctgagccccgagcagttcctgccccacgtggacggcgcccccgtgccctacagcagcctgagcctggacctgttcatgctgggctacttccagctgctggagtgcgacctgcccgccgaggagagaaagctgagacacctgctgtgcttcgaggtgttcgagcacctgggcacccacggctgggaggccgtgagagccttccacaaggccgtgaccgacgaggtggccgccggcagaagagcctggaccgacggcttcgaggacatcaaggccagattcttcggcagcagccagagacccgcctgggacaccgagcccggcagaaagagcggcctgaccctgctgggccccctgccccacgccgccgtgccctgcagcggccccgagcccaccgcccagagactgggcagcagaagccagcagggcagcttcaacggcgaggacatctgcggctacatcaacagaagcttcgccttctggaaggagaaggaggccgagatgttcaacttcggcgagtag

SEQ ID NO: 20725 - DNA, 249 bp, Artificial Sequence
  Description of Artificial Sequence: Synthetic coding sequence
atgagcctgagccccgcctggcccggccaccccgaccagcccctgcccagagagcagatgaccagccccgccccccccagaatcatcaccagcgccaccgccgaccccgagggcaccgagaccgccctggccggcgacaccagcgacggcctggccgccctgcagctggacggcctgcccagcggcgacatcgacggcctggtgcccaccagagacgagagaggccagcccatccccgagtggaagtag

SEQ ID NO: 20726 - DNA, 1194 bp, Artificial Sequence
  Description of Artificial Sequence: Synthetic coding sequence
  Description of Combined DNA/RNA Molecule: Synthetic coding sequence
atggccggctacgagtacgtgagccccgagcagctggccggcttcgacaagtacaagtacagcgccgtggacaccaaccccctgagcctgtacgtgatgcaccccttctggaacaccatcgtgaaggtgttccccacctggctggcccccaacctgatcaccttcagcggcttcctgctggtggtgttcaacttcctgctgatggcctacttcgaccccgacttctacgccagcgcccccggccacaagcacgtgcccgactgggtgtggatcgtggtgggcatcctgaacttcgtggcctacaccctggacggcgtggacggcaagcaggccagaagaaccaacagcagcacccccctgggcgagctgttcgaccacggcctggacagctggagctgcgtgtacttcgtggtgaccgtgtacagcatcttcggcagaggcagcaccggcgtgagcgtgttcgtgctgtacctgctgctgtgggtggtgctgttcagcttcatcctgagccactgggagaagtacaacaccggcatcctgttcctgccctggggctacgacatcagccaggtgaccatcagcttcgtgtacatcgtgaccgccgtggtgggcgtggaggcctggtacgagcccttcctgttcaacttcctgtacagagacctgttcaccgccatgatcatcggctgcgccctgtgcgtgaccctgcccatgagcctgctgaacttcttcagaagctacaagaacaacaccctgaagctgaacagcgtgtacgaggccatggtgcccctgttcagcccctgcctgctgttcatcctgagcaccgcctggatcctgtggagccccagcgacatcctggagctgcaccccagagtgttctacttcatggtgggcaccgccttcgccaacagcacctgccagctgatcgtgtgccagatgagcagcaccagatgccccaccctgaactggctgctggtgcccctgttcctggtggtgctggtggtgaacctgggcgtggccagctacgtggagagcatcctgctgtacaccctgaccaccgccttcaccctggcccacatccactacggcgtgagagtggtgaagcagctgagcagccacttccagatctaccccttcagcctgagaaagcccaacagcgacugactgggcatggaggagaagaacatcggcctgtag

SEQ ID NO: 20727 - DNA, 357 bp, Artificial Sequence
  Description of Artificial Sequence: Synthetic coding sequence
atgcaccccttctggaacaccatcgtgaaggtgttccccacctggctggcccccaacctgatcaccttcagcggcttcctgctggtggtgttcaacttcctgctgatggcctacttcgaccccgacttctacgccagcgcccccggccacaagcacgtgcccgactgggtgtggatcgtggtgggcatcctgaacttcgtggcctacaccctggacggcgtggacggcaagcaggccagaagaaccaacagcagcacccccctgggcgagctgttcgaccacggcctggacagctggagctgcgtgtacttcgtggtgaccgtgtacagcatcttcggcagaggcagcaccggctag

SEQ ID NO: 20728 - DNA, 1200 bp, Artificial Sequence
  Description of Artificial Sequence: Synthetic coding sequence
atgggcagaaagagcctgtacctgctgatcgtgggcatcctgatcgcctactacatctacacccccctgcccgacaacgtggaggagccctggagaatgatgtggatcaacgcccacctgaagaccatccagaacctggccaccttcgtggagctgctgggcctgcaccacttcatggacagcttcaaggtggtgggcagcttcgacgaggtgccccccaccagcgacgagaacgtgaccgtgaccgagaccaagttcaacaacatcctggtgagagtgtacgtgcccaagagaaagagcgaggccctgagaagaggcctgttctacatccacggcggcggctggtgcgtgggcagcgccgccctgagcggctacgacctgctgagcagatggaccgccgacagactggacgccgtggtggtgagcaccaactacagactggcccccaagtaccacttccccatccagttcgaggacgtgtacaacgccctgagatggttcctgagaaagaaggtgctggccaagtacggcgtgaaccccgagagaatcggcatcagcggcgacagcgccggcggcaacctggccgccgccgtgacccagcagctgctggacgaccccgacgtgaagatcaagctgaagatccagagcctgatctaccccgccctgcagcccctggacgtggacctgcccagctaccaggagaacagcaacttcctgttcctgagcaagagcctgatggtgagattctggagcgagtacttcaccaccgacagaagcctggagaaggccatgctgagcagacagcacgtgcccgtggagagcagccacctgttcaagttcgtgaactggagcagcctgctgcccgagagattcatcaagggccacgtgtacaacaaccccaactacggcagcagcgagctggccaagaagtaccccggcttcctggacgtgagagccgcccccctgctggccgacgacaacaagctgagaggcctgcccctgacctacgtgatcacctgccagtacgacctgctgagagacgacggcctgatgtacgtgaccagactgagaaacaccggcgtgcaggtgacccacaaccacgtggaggacggcttccacggcgccttcagcttcctgggcctgaagatcagccacagactgatcaaccagtacatcgagtggctgaaggagaacctgtag

SEQ ID NO: 20729 - DNA, 2745 bp, Artificial Sequence
  Description of Artificial Sequence: Synthetic coding sequence
atgagcagattcttcaccaccggcagcgacagcgagagcgagagcagcctgagcggcgaggagctggtgaccaagcccgtgggcggcaactacggcaagcagcccctgctgctgagcgaggacgaggaggacaccaagagagtggtgagaagcgccaaggacaagagattcgaggagctgaccaacctgatcagaaccatcagaaacgccatgaagatcagagacgtgaccaagtgcctggaggagttcgagctgctgggcaaggcctacggcaaggccaagagcatcgtggacaaggagggcgtgcccagattctacatcagaatcctggccgacctggaggactacctgaacgagctgtgggaggacaaggagggcaagaagaagatgaacaagaacaacgccaaggccctgagcaccctgagacagaagatcagaaagtacaacagagacttcgagagccacatcaccagctacaagcagaaccccgagcagagcgccgacgaggacgccgagaagaacgaggaggacagcgagggcagcagcgacgaggacgaggacgaggacggcgtgagcgccgccaccttcctgaagaagaagagcgaggcccccagcggcgagagcagaaagttcctgaagaagatggacgacgaggacgaggacagcgaggacagcgaggacgacgaggactgggacaccggcagcaccagcagcgacagcgacagcgaggaggaggagggcaagcagaccgccctggccagcagattcctgaagaaggcccccaccaccgacgaggacaagaaggccgccgagaagaagagagaggacaaggccaagaagaagcacgacagaaagagcaagagactggacgaggaggaggaggaggacaacgagggcggcgagtgggagagagtgagaggcggcgtgcccctggtgaaggagaagcccaagatgttcgccaagggcaccgagatcacccacgccgtggtgatcaagaagctgaacgagatcctgcaggccagaggcaagaagggcaccgacagagccgcccagatcgagctgctgcagctgctggtgcagatcgccgccgagaacaacctgggcgagggcgtgatcgtgaagatcaagttcaacatcatcgccagcctgtacgactacaaccccaacctggccacctacatgaagcccgagatgtggggcaagtgcctggactgcatcaacgagctgatggacatcctgttcgccaaccccaacatcttcgtgggcgagaacatcctggaggagagcgagaacctgcacaacgccgaccagcccctgagagtgagaggctgcatcctgaccctggtggagagaatggacgaggagttcaccaagatcatgcagaacaccgacccccacagccaggagtacgtggagcacctgaaggacgaggcccaggtgtgcgccatcatcgagagagtgcagagatacctggaggagaagggcaccaccgaggaggtgtgcagaatctacctgctgagaatcctgcacacctactacaagttcgactacaaggcccaccagagacagctgaccccccccgagggcagcagcaagagcgagcaggaccaggccgagaacgagggcgaggacagcgccgtgctgatggagagactgtgcaagtacatctacgccaaggacagaaccgacagaatcagaacctgcgccatcctgtgccacatctaccaccacgccctgcacagcagatggtaccaggccagagacctgatgctgatgagccacctgcaggacaacatccagcacgccgacccccccgtgcagatcctgtacaacagaaccatggtgcagctgggcatctgcgccttcagacagggcctgaccaaggacgcccacaacgccctgctggacatccagagcagcggcagagccaaggagctgctgggccagggcctgctgctgagaagcctgcaggagagaaaccaggagcaggagaaggtggagagaagaagacaggtgcccttccacctgcacatcaacctggagctgctggagtgcgtgtacctggtgagcgccatgctgctggagatcccctacatggccgcccacgagagcgacgccagaagaagaatgatcagcaagcagttccaccaccagctgagagtgggcgagagacagcccctgctgggcccccccgagagcatgagagagcacgtggtggccgccagcaaggccatgaagatgggcgactggaagacctgccacagcttcatcatcaacgagaagatgaacggcaaggtgtgggacctgttccccgaggccgacaaggtgagaaccatgctggtgagaaagatccaggaggagagcctgagaacctacctgttcacctacagcagcgtgtacgacagcatcagcatggagaccctgagcgacatgttcgagctggacctgcccaccgtgcacagcatcatcagcaagatgatcatcaacgaggagctgatggccagcctggaccagcccacccagaccgtggtgatgcacagaaccgagcccaccgcccagcagaacctggccctgcagctggccgagaagctgggcagcctggtggagaacaacgagagagtgttcgaccacaagcagggcacctacggcggctacttcagagaccagaaggacggctacagaaagaacgagggctacatgagaagaggcggctacagacagcagcagagccagaccgcctactag

SEQ ID NO: 20730 - DNA, 2745 bp, Artificial Sequence; identical to SEQ ID NO: 20729
  Description of Artificial Sequence: Synthetic coding sequence

SEQ ID NO: 20731 - DNA, 2745 bp, Artificial Sequence; identical to SEQ ID NO: 20729
  Description of Artificial Sequence: Synthetic coding sequence

SEQ ID NO: 20732 - DNA, 2289 bp, Artificial Sequence
  Description of Artificial Sequence: Synthetic coding sequence
atgagcagattcttcaccaccggcagcgacagcgagagcgagagcagcctgagcggcgaggagctggtgaccaagcccgtgggcggcaactacggcaagcagcccctgctgctgagcgaggacgaggaggacaccaagagagtggtgagaagcgccaaggacaagagattcgaggagctgaccaacctgatcagaaccatcagaaacgccatgaagatcagagacgtgaccaagtgcctggaggagttcgagctgctgggcaaggcctacggcaaggccaagagcatcgtggacaaggagggcgtgcccagattctacatcagaatcctggccgacctggaggactacctgaacgagctgtgggaggacaaggagggcaagaagaagcacgacagaaagagcaagagactggacgaggaggaggaggaggacaacgagggcggcgagtgggagagagtgagaggcggcgtgcccctggtgaaggagaagcccaagatgttcgccaagggcaccgagatcacccacgccgtggtgatcaagaagctgaacgagatcctgcaggccagaggcaagaagggcaccgacagagccgcccagatcgagctgctgcagctgctggtgcagatcgccgccgagaacaacctgggcgagggcgtgatcgtgaagatcaagttcaacatcatcgccagcctgtacgactacaaccccaacctggccacctacatgaagcccgagatgtggggcaagtgcctggactgcatcaacgagctgatggacatcctgttcgccaaccccaacatcttcgtgggcgagaacatcctggaggagagcgagaacctgcacaacgccgaccagcccctgagagtgagaggctgcatcctgaccctggtggagagaatggacgaggagttcaccaagatcatgcagaacaccgacccccacagccaggagtacgtggagcacctgaaggacgaggcccaggtgtgcgccatcatcgagagagtgcagagatacctggaggagaagggcaccaccgaggaggtgtgcagaatctacctgctgagaatcctgcacacctactacaagttcgactacaaggcccaccagagacagctgaccccccccgagggcagcagcaagagcgagcaggaccaggccgagaacgagggcgaggacagcgccgtgctgatggagagactgtgcaagtacatctacgccaaggacagaaccgacagaatcagaacctgcgccatcctgtgccacatctaccaccacgccctgcacagcagatggtaccaggccagagacctgatgctgatgagccacctgcaggacaacatccagcacgccgacccccccgtgcagatcctgtacaacagaaccatggtgcagctgggcatctgcgccttcagacagggcctgaccaaggacgcccacaacgccctgctggacatccagagcagcggcagagccaaggagctgctgggccagggcctgctgctgagaagcctgcaggagagaaaccaggagcaggagaaggtggagagaagaagacaggtgcccttccacctgcacatcaacctggagctgctggagtgcgtgtacctggtgagcgccatgctgctggagatcccctacatggccgcccacgagagcgacgccagaagaagaatgatcagcaagcagttccaccaccagctgagagtgggcgagagacagcccctgctgggcccccccgagagcatgagagagcacgtggtggccgccagcaaggccatgaagatgggcgactggaagacctgccacagcttcatcatcaacgagaagatgaacggcaaggtgtgggacctgttccccgaggccgacaaggtgagaaccatgctggtgagaaagatccaggaggagagcctgagaacctacctgttcacctacagcagcgtgtacgacagcatcagcatggagaccctgagcgacatgttcgagctggacctgcccaccgtgcacagcatcatcagcaagatgatcatcaacgaggagctgatggccagcctggaccagcccacccagaccgtggtgatgcacagaaccgagcccaccgcccagcagaacctggccctgcagctggccgagaagctgggcagcctggtggagaacaacgagagagtgttcgaccacaagcagggcacctacggcggctacttcagagaccagaaggacggctacagaaagaacgagggctacatgagaagaggcggctacagacagcagcagagccagaccgcctactag

SEQ ID NO: 20733 - DNA, 2700 bp, Artificial Sequence
  Description of Artificial Sequence: Synthetic coding sequence
atgagcagattcttcaccaccggcagcgacagcgagagcgagagcagcctgagcggcgaggagctggtgaccaagcccgtgggcggcaactacggcaagcagcccctgctgctgagcgaggacgaggaggacaccaagagagtggtgagaagcgccaaggacaagagattcgaggagctgaccaacctgatcagaaccatcagaaacgccatgaagatcagagacgtgaccaagtgcctggaggagttcgagctgctgggcaaggcctacggcaaggccaagagcatcgtggacaaggagggcgtgcccagattctacatcagaatcctggccgacctggaggactacctgaacgagctgtgggaggacaaggagggcaagaagaagatcagaaagtacaacagagacttcgagagccacatcaccagctacaagcagaaccccgagcagagcgccgacgaggacgccgagaagaacgaggaggacagcgagggcagcagcgacgaggacgaggacgaggacggcgtgagcgccgccaccttcctgaagaagaagagcgaggcccccagcggcgagagcagaaagttcctgaagaagatggacgacgaggacgaggacagcgaggacagcgaggacgacgaggactgggacaccggcagcaccagcagcgacagcgacagcgaggaggaggagggcaagcagaccgccctggccagcagattcctgaagaaggcccccaccaccgacgaggacaagaaggccgccgagaagaagagagaggacaaggccaagaagaagcacgacagaaagagcaagagactggacgaggaggaggaggaggacaacgagggcggcgagtgggagagagtgagaggcggcgtgcccctggtgaaggagaagcccaagatgttcgccaagggcaccgagatcacccacgccgtggtgatcaagaagctgaacgagatcctgcaggccagaggcaagaagggcaccgacagagccgcccagatcgagctgctgcagctgctggtgcagatcgccgccgagaacaacctgggcgagggcgtgatcgtgaagatcaagttcaacatcatcgccagcctgtacgactacaaccccaacctggccacctacatgaagcccgagatgtggggcaagtgcctggactgcatcaacgagctgatggacatcctgttcgccaaccccaacatcttcgtgggcgagaacatcctggaggagagcgagaacctgcacaacgccgaccagcccctgagagtgagaggctgcatcctgaccctggtggagagaatggacgaggagttcaccaagatcatgcagaacaccgacccccacagccaggagtacgtggagcacctgaaggacgaggcccaggtgtgcgccatcatcgagagagtgcagagatacctggaggagaagggcaccaccgaggaggtgtgcagaatctacctgctgagaatcctgcacacctactacaagttcgactacaaggcccaccagagacagctgaccccccccgagggcagcagcaagagcgagcaggaccaggccgagaacgagggcgaggacagcgccgtgctgatggagagactgtgcaagtacatctacgccaaggacagaaccgacagaatcagaacctgcgccatcctgtgccacatctaccaccacgccctgcacagcagatggtaccaggccagagacctgatgctgatgagccacctgcaggacaacatccagcacgccgacccccccgtgcagatcctgtacaacagaaccatggtgcagctgggcatctgcgccttcagacagggcctgaccaaggacgcccacaacgccctgctggacatccagagcagcggcagagccaaggagctgctgggccagggcctgctgctgagaagcctgcaggagagaaaccaggagcaggagaaggtggagagaagaagacaggtgcccttccacctgcacatcaacctggagctgctggagtgcgtgtacctggtgagcgccatgctgctggagatcccctacatggccgcccacgagagcgacgccagaagaagaatgatcagcaagcagttccaccaccagctgagagtgggcgagagacagcccctgctgggcccccccgagagcatgagagagcacgtggtggccgccagcaaggccatgaagatgggcgactggaagacctgccacagcttcatcatcaacgagaagatgaacggcaaggtgtgggacctgttccccgaggccgacaaggtgagaaccatgctggtgagaaagatccaggaggagagcctgagaacctacctgttcacctacagcagcgtgtacgacagcatcagcatggagaccctgagcgacatgttcgagctggacctgcccaccgtgcacagcatcatcagcaagatgatcatcaacgaggagctgatggccagcctggaccagcccacccagaccgtggtgatgcacagaaccgagcccaccgcccagcagaacctggccctgcagctggccgagaagctgggcagcctggtggagaacaacgagagagtgttcgaccacaagcagggcacctacggcggctacttcagagaccagaaggacggctacagaaagaacgagggctacatgagaagaggcggctacagacagcagcagagccagaccgcctactag

SEQ ID NO: 20734 - DNA, 729 bp, Artificial Sequence
  Description of Artificial Sequence: Synthetic coding sequence
atgctggccgtggaggtgagcgaggccgagggcggcatcagagagtgggaggaggaggagaaggaggaggaggccgccgagagaacccccaccggcgagaagagccccaacagccccagaaccctgctgagcctgagaggcaaggccagaaccggcggccccatggaggtgaagctggagctgcaccccctgcagaacagatgggccctgtggttcttcaagaacgacagaagcagagcctggcaggacaacctgcacctggtgaccaaggtggacaccgtggaggacttctgggccctgtacagccacatccagctggccagcaagctgagcagcggctgcgactacgccctgttcaaggacggcatccagcccatgtgggaggacagcagaaacaagagaggcggcagatggctggtgagcctggccaagcagcagagacacatcgagctggacagactgtggctggagaccctgctgtgcctgatcggcgagagcttcgaggagcacagcagagaggtgtgcggcgccgtggtgaacatcagaaccaagggcgacaagatcgccgtgtggaccagagaggccgagaaccaggccggcgtgctgcacgtgggcagagtgtacaaggagagactgggcctgagccccaagaccatcatcggctaccaggcccacgccgacaccgccaccaagagcaacagcctggccaagaacaagttcgtggtgtag

SEQ ID NO: 20735 - DNA, 729 bp, Artificial Sequence; identical to SEQ ID NO: 20734
  Description of Artificial Sequence: Synthetic coding sequence

SEQ ID NO: 20736 - DNA, 273 bp, Artificial Sequence
  Description of Artificial Sequence: Synthetic coding sequence
atgctggccgtggaggtgagcgaggccgagggcggcatcagagagtgggaggaggaggagaaggaggaggaggccgccgagagaacccccaccggcgagaagagccccaacagccccagaaccctgctgagcctgagaggcaaggccagaaccggcggccccatggaggtgaagctggagctgcaccccctgcagaacagatgggccctgtggttcttcaagaacgacagaagcagagcctggcaggacaacctgcacctggtgaccaagtag

SEQ ID NO: 20737 - DNA, 525 bp, Artificial Sequence
  Description of Artificial Sequence: Synthetic coding sequence
atggccgccgccatggtgcccggcagaagcgagagctgggagagaggcgagcccggcagacccgccctgtacttctgcggcagcatcagaggcggcagagaggacagaaccctgtacgagagaatcgtgagcagactgagaagattcggcaccgtgctgaccgagcacgtggccgccgccgagctgggcgccagaggcgaggaggccgccggcggcgacagactgatccacgagcaggacctggagtggctgcagcaggccgacgtggtggtggccgaggtgacccagcccagcctgggcgtgggctacgagctgggcagagccgtggccttcaacaagagaatcctgtgcctgttcagaccccagagcggcagagtgctgagcgccatgatcagaggcgccgccgacggcagcagattccaggtgtgggactacgaggagggcgaggtggaggccctgctggacagatacttcgaggccgacccccccggccaggtggccgccagccccgaccccaccacctag

SEQ ID NO: 20738 - DNA, 423 bp, Artificial Sequence
  Description of Artificial Sequence: Synthetic coding sequence
atgagcagaagcagacagccccccctggtgaccggcatcagccccaacgagggcatcccctggaccaaggtgaccatcagaggcgagaacctgggcaccggccccaccgacctgatcggcctgaccatctgcggccacaactgcctgctgaccgccgagtggatgagcgccagcaagatcgtgtgcagagtgggccaggccaagaacgacaagggcgacatcatcgtgaccaccaagagcggcggcagaggcaccagcaccgtgagcttcaagctgctgaagcccgagaagatcggcatcctggaccagagcgccgtgtgggtggacgagatgaactactacgacatgagaaccgacagaaacaagggcatcccccccctgagcctgagacccgccaaccccctgggcatcgagatcgagtag

SEQ ID NO: 20739 - DNA, 1560 bp, Artificial Sequence
  Description of Artificial Sequence: Synthetic coding sequence
atgctggacctggacaacgacaccagacccagcgtgctgggccacctgagccagaccgccagcctgaagagaggcagcagcttccagagcggcagagacgacacctggagatacaagaccccccacagagtggccttcgtggagaagctgaccaagctggtgctgagccagctgcccaacttctggaagctgtggatcagctacgtgaacggcagcctgttcagcgagaccgccgagaagagcggccagatcgagagaagcaagaacgtgagacagagacagaacgacttcaagaagatgatccaggaggtgatgcacagcctggtgaagctgaccagaggcgccctgctgcccctgagcatcagagacggcgaggccaagcagtacggcggctgggaggtgaagtgcgagctgagcggccagtggctggcccacgccatccagaccgtgagactgacccacgagagcctgaccgccctggagatccccaacgacctgctgcagaccatccaggacctgatcctggacctgagagtgagatgcgtgatggccaccctgcagcacaccgccgaggagatcaagagactggccgagaaggaggactggatcgtggacaacgagggcctgaccagcctgccctgccagttcgagcagtgcatcgtgtgcagcctgcagagcctgaagggcgtgctggagtgcaagcccggcgaggccagcgtgttccagcagcccaagacccaggaggaggtgtgccagctgagcatcaacatcatgcaggtgttcatctactgcctggagcagctgagcaccaagcccgacgccgacatcgacaccacccacctgagcgtggacgtgagcagccccgacctgttcggcagcatccacgaggacttcagcctgaccagcgagcagagactgctgatcgtgctgagcaactgctgctacctggagagacacaccttcctgaacatcgccgagcacttcgagaagcacaacttccagggcatcgagaagatcacccaggtgagcatggccagcctgaaggagctggaccagagactgttcgagaactacatcgagctgaaggccgaccccatcgtgggcagcctggagcccggcatctacgccggctacttcgactggaaggactgcctgccccccaccggcgtgagaaactacctgaaggaggccctggtgaacatcatcgccgtgcacgccgaggtgttcaccatcagcaaggagctggtgcccagagtgctgagcaaggtgatcgaggccgtgagcgaggagctgagcagactgatgcagtgcgtgagcagcttcagcaagaacggcgccctgcaggccagactggagatctgcgccctgagagacaccgtggccgtgtacctgacccccgagagcaagagcagcttcaagcaggccctggaggccctgccccagctgagcagcggcgccgacaagaagctgctggaggagctgctgaacaagttcaagagcagcatgcacctgcagctgacctgcttccaggccgccagcagcaccatgatgaagacctag

SEQ ID NO: 20740 - DNA, 1230 bp, Artificial Sequence
  Description of Artificial Sequence: Synthetic coding sequence
atggccgccctggagaacggcgagctgggccccctgctgagccccggcaccctgagaggcctggaggacgagtgcgtgaccgacgtgaaggcccagaccagagccgccctgctgagagtgctgcaggaggacgaggagcactggggcagcctggaggaccagcccagcagcctggcccaggacgtgtgcgagctgctggaggagcacaccgagagagcccccagaatcagccaggagttcggcgagagaatggcccactgctgcctgggcggcctggccgagttcctgcagagcttccagcagagagtggagagattccacgagaaccccgccgtgagagagatgctgcccgacacctacatcagcaagaccatcgccctggtgaactgcggcccccccctgagagccctggccgagagactggccagagtgggcccccccgagagcgagcccgccagagaggccagcgccagcgccctggaccacgtgaccagactgtgccacagagtggtggccaacctgctgttccaggagctgcagccccacttcaacaagctgatgagaagaaagtggctgagcagccccgaggccctggacggcatcgtgggcaccctgggcgcccaggccctggccctgagaagaatgcaggacgagccctaccaggccctggtggccgagctgcacagaagagccctggtggagtacgtgagacccctgctgagaggcagactgagatgcagcagcgccagaaccagaagcagagtggccggcagactgagagaggacgccgcccagctgcagagactgttcagaagactggagagccaggccagctggctggacgccgtggtgccccacctggccgaggtgatgcagctggaggacacccccagcatccaggtggaggtgggcgtgctggtgagagactaccccgacatcagacagaagcacgtggccgccctgctggacatcagaggcctgagaaacaccgccgccagacaggagatcctggccgtggccagagacctggagctgagcgaggagggcgccctgagcccccccagagacagagccttcttcgccgacatccccgtgcccagacccagcttctgcctgagcctgcccctgttcctgggcagactgcccctgagcagactggccagacccagcctggcctgcctgcccagacccagaccccccagcctggccagacccagagcccagagatag

SEQ ID NO: 20741 - DNA, 1230 bp, Artificial Sequence; identical to SEQ ID NO: 20740
  Description of Artificial Sequence: Synthetic coding sequence

SEQ ID NO: 20742 - DNA, 2169 bp, Artificial Sequence
  Description of Artificial Sequence: Synthetic coding sequence
atgcccagcccccagaccgacacccccggccccgagctgcagagccccaaggaggccgaggagccccagacccccgcccagggcagcagaagaaccagcagcagaaaggagcccaacgcccacagaaaggacggcaccagactgggcctgggcagcctgagacaggccttcagcagagccagccagagagccctgacccaggtgagcaaggaggacaccggcctgttcagaagaagcagctgcagcctgttcagaagcttcagacaggccctgaacgacggccccgccaccggccacagccaggccacccccgaggtgcccagcggcgtgatgaacggcgtgagccagcaggccagcaccggcgccgccagcgaggagctgaagcccgaggccgagggcaagagcgtggccgacctgatcaccgagagacagctgctggccgccttcgagcagctgctgagactggagaccctgctggtggccgagaaggccagcagaaccttcgagcaggaccccaccgccttcgccagaagagccatggacgtgtgcctgctgtacgacggcctggccgccgagatcggcgccatcgtgagagagaccctggacagcgacggcgtggacgccgccgccctggccgagctggccagagtggtgagcgccgaggaggaggcccaccccagcccccccgacgacggcgacttcctgagaacccccagaagatggagacagcactgggaggaggccgtgagaagaagcgcccaggagagagtgagaagacccggcgccggctgggccttcggcgaggccgagggcgccagcggcctggcccagctgctggccgagctgggcggcctggtgagaagagacctgcagaaggtgagacaggaggtgcagcccgcctacgccgccgccggcttccccgcctgggaggtgtacctgagagccttccacagcgccgtggcccagagactgcaggagctggccagagacgccagaggctgcgagcagctgtacatcctgctggactgggccgccaacgtgtacggcagccccgacttcctgggcgcccccggcctggccctgcccgccgagcccctgccccccctgctggcccccgacgtgtgggccagactggagagcgactacaccagcttcctggaggccaagatcgccagctgcttcgacagcatcctgcagctggagcagagccactgggccgccgccgaggtgcccgaggtgctgcagggcctgtaccaggcccccctgagcatggacgtgcacatgctggtggccgagcacgtgaaggccgccggcgccatcagcgccgagctggaggccaccaccctgagaatctgcaccagagccctgggcctgttcgtgcccagattcgagaaggccttcctggccagcgaggccgtgagcgagccccacctgggcgcctacatcaacgcctgcgaggagctgagaaccagcctgctgagcagattccccggcacccaggaggagctggagaagcccctggtgaccgccacctgcagcttccagaagcacctgctgcagggcctgcagagagagctgcagcccctgttcagagtggtgtgcaccagagactggctgacccaggactggctgcaccccctgatggacaaggtggtgaccttcgccggccacctgcagagagtggccagacccagagcccaggagaccctgcaggaggtgcacagattcgtggtgagagagtacctggccagagccctgagacccagagagagattcagaggcatggagagaatgcacggcagccagaagatgagcctggacgcccaggccatcagcgacaccttccagggcctgggcagcgaggccacctggctggaccaggccatccagtgcgtggccgagatcctgggcgagacctacaaggacgacatccagagacacctggagaccctgatcagaagctaccccgacatcagaagagaccacatcctggccatcctggccctgagaagactgggcagacagagaaaccagcacctgctgcagcacacccaggacctgctgagagccgccgccggcgccgccggcgccgaggcccccagaggcagagtgctgttcgaggagatcaaggtgcccagcgccatggccgtgctgatcacctgcgtgtag

SEQ ID NO: 20743 - DNA, 1545 bp, Artificial Sequence
  Description of Artificial Sequence: Synthetic coding sequence
atggaggacagcgagttcctggcctacgtggagctgctggacgaggtggagcagggcagcgtgagagccaaggccagcagcgtgagcctgcacgccgagagaacctggatggagaagatgaaggtggaggacctgaacgtgtgcgagcccgccagccccgcccccgaggcccccgccaccagcctgctgaacgacctgaagtacagccccagcgaggaggaggaggtgacctacaccgtgatcaaccagttccagcagaagttcggcgccgccatcctgcacatcaagaagcagaacgtgctgagcgtggccgccgagggcgccaacgtgtgcagacacggcaagctgtgctggctgcaggtggccaccaactgcagagtgtacctgttcgacatcttcctgctgggcagcagagccttccacaacggcctgcagatgatcctggaggacaagagaatcctgaaggtgatccacgactgcagatggctgagcgactgcctgagccaccagtacggcatcctgctgaacaacgtgttcgacacccaggtggccgacgtgctgcagttcagcatggagaccggcggctacctgcccaactgcatcaccaccctgcaggagagcctgatcaagcacctgcaggtggcccccaagtacctgagcttcctggagaagagacagaagctgatccaggagaaccccgaggtgtggttcatcagacccgtgagccccagcctgctgaagatcctggccctggaggccacctacctgctgcccctgagactggccctgctggacgagatgatgagcgacctgaccaccctggtggacggctacctgaacacctacagagagggcagcgccgacagactgggcggcaccgagcccacctgcatggagctgcccgaggagctgctgcagctgaaggacttccagaagcagagaagagagaaggccgccagagagtacagagtgaacgcccagggcctgctgatcagaaccgtgctgcagcccaagaagctggtgaccgagaccgccggcaaggaggagaaggtgaagggcttcctgttcggcaagaacttcagaatcgacaaggcccccagcttcaccagccaggacttccacggcgacgtgaacctgctgaaggaggagagcctgaacaagcaggccaccaacccccagcacctgccccccaccgaggagggcgagaccagcgaggacagcagcaacaagctgatctgcaccaagagcaagggcagcgaggaccagagaatcacccagaaggagcacttcatgacccccaagcacgagttccaggccagcctgagcctgaaggaggagaccgagcagctgctgatggtggagaacaaggaggacctgaagtgcaccaagcaggccgtgagcatgagcagcttcccccaggagaccagagtgagccccagcgacaccttctaccccatcagaaagaccgtggtgagcaccctgcccccctgccccgccctggagaagatcgacagctggatcagccccttcctgaacctgccctag

SEQ ID NO: 20744 - DNA, 1719 bp, Artificial Sequence
  Description of Artificial Sequence: Synthetic coding sequence
atggaccccagcagcgactaccacttcctgagccagatcctgtggaagagagtgaagctgaccctggtgtgcggcgtgttcgagggcgtgctgcagcacgtggaccccaacaagatcgtggtgctgaagaaggtgaagaacgtggagaccggcagaagcgtgcccggcgtgaagctgttcttcggccacgagatcgtgaacgtggagctgctggacgaggtggagcagggcagcgtgagagccaaggccagcagcgtgagcctgcacgccgagagaacctggatggagaagatgaaggtggaggacctgaacgtgtgcgagcccgccagccccgcccccgaggcccccgccaccagcctgctgaacgacctgaagtacagccccagcgaggaggaggaggtgacctacaccgtgatcaaccagttccagcagaagttcggcgccgccatcctgcacatcaagaagcagaacgtgctgagcgtggccgccgagggcgccaacgtgtgcagacacggcaagctgtgctggctgcaggtggccaccaactgcagagtgtacctgttcgacatcttcctgctgggcagcagagccttccacaacggcctgcagatgatcctggaggacaagagaatcctgaaggtgatccacgactgcagatggctgagcgactgcctgagccaccagtacggcatcctgctgaacaacgtgttcgacacccaggtggccgacgtgctgcagttcagcatggagaccggcggctacctgcccaactgcatcaccaccctgcaggagagcctgatcaagcacctgcaggtggcccccaagtacctgagcttcctggagaagagacagaagctgatccaggagaaccccgaggtgtggttcatcagacccgtgagccccagcctgctgaagatcctggccctggaggccacctacctgctgcccctgagactggccctgctggacgagatgatgagcgacctgaccaccctggtggacggctacctgaacacctacagagagggcagcgccgacagactgggcggcaccgagcccacctgcatggagctgcccgaggagctgctgcagctgaaggacttccagaagcagagaagagagaaggccgccagagagtacagagtgaacgcccagggcctgctgatcagaaccgtgctgcagcccaagaagctggtgaccgagaccgccggcaaggaggagaaggtgaagggcttcctgttcggcaagaacttcagaatcgacaaggcccccagcttcaccagccaggacttccacggcgacgtgaacctgctgaaggaggagagcctgaacaagcaggccaccaacccccagcacctgccccccaccgaggagggcgagaccagcgaggacagcagcaacaagctgatctgcaccaagagcaagggcagcgaggaccagagaatcacccagaaggagcacttcatgacccccaagcacgagttccaggccagcctgagcctgaaggaggagaccgagcagctgctgatggtggagaacaaggaggacctgaagtgcaccaagcaggccgtgagcatgagcagcttcccccaggagaccagagtgagccccagcgacaccttctaccccatcagaaagaccgtggtgagcaccctgcccccctgccccgccctggagaagatcgacagctggatcagccccttcctgaacctgccctag

SEQ ID NO: 20745 - DNA, 816 bp, Artificial Sequence
  Description of Artificial Sequence: Synthetic coding sequence
atgagcagacagaacctggtggccctgaccgtgaccaccctgctgggcgtggccgtgggcggcttcgtgctgtggaagggcatccagagaagaagaagaagcaagaccagccccgtgacccagcagccccagcagaaggtgctgggcagcagagagctgcccccccccgaggacgaccagctgcacagcagcgcccccagaagcagctggaaggagagaatcctgaaggccaaggtggtgaccgtgagccaggaggccgagtgggaccagatcgagcccctgctgagaagcgagctggaggacttccccgtgctgggcatcgactgcgagtgggtgaacctggagggcaaggccagccccctgagcctgctgcagatggccagccccagcggcctgtgcgtgctggtgagactgcccaagctgatctgcggcggcaagaccctgcccagaaccctgctggacatcctggccgacggcaccatcctgaaggtgggcgtgggctgcagcgaggacgccagcaagctgctgcaggactacggcctggtggtgagaggctgcctggacctgagatacctggccatgagacagagaaacaacctgctgtgcaacggcctgagcctgaagagcctggccgagaccgtgctgaacttccccctggacaagagcctgctgctgagatgcagcaactgggacgccgagaccctgaccgaggaccaggtgatctacgccgccagagacgcccagatcagcgtggccctgttcctgcacctgctgggctaccccttcagcagaaacagccccggcgagaagagatag

SEQ ID NO: 20746 - DNA, 1866 bp, Artificial Sequence
  Description of Artificial Sequence: Synthetic coding sequence
atgagcagacagaacctggtggccctgaccgtgaccaccctgctgggcgtggccgtgggcggcttcgtgctgtggaagggcatccagagaagaagaagaagcaagaccagccccgtgacccagcagccccagcagaaggtgctgggcagcagagagctgcccccccccgaggacgaccagctgcacagcagcgcccccagaagcagctggaaggagagaatcctgaaggccaaggtggtgaccgtgagccaggaggccgagtgggaccagatcgagcccctgctgagaagcgagctggaggacttccccgtgctgggcatcgactgcgagtgggtgaacctggagggcaaggccagccccctgagcctgctgcagatggccagccccagcggcctgtgcgtgctggtgagactgcccaagctgatctgcggcggcaagaccctgcccagaaccctgctggacatcctggccgacggcaccatcctgaaggtgggcgtgggctgcagcgaggacgccagcaagctgctgcaggactacggcctggtggtgagaggctgcctggacctgagatacctggccatgagacagagaaacaacctgctgtgcaacggcctgagcctgaagagcctggccgagaccgtgctgaacttccccctggacaagagcctgctgctgagatgcagcaactgggacgccgagaccctgaccgaggaccaggtgatctacgccgccagagacgcccagatcagcgtggccctgttcctgcacctgctgggctaccccttcagcagaaacagccccggcgagaagaacgacgaccacagcagctggagaaaggtgctggagaagtgccagggcgtggtggacatccccttcagaagcaagggcatgagcagactgggcgaggaggtgaacggcgaggccaccgagagccagcagaagcccagaaacaagaagagcaagatggacggcatggtgcccggcaaccaccagggcagagaccccagaaagcacaagagaaagcccctgggcgtgggctacagcgccagaaagagccccctgtacgacaactgcttcctgcacgcccccgacggccagcccctgtgcacctgcgacagaagaaaggcccagtggtacctggacaagggcatcggcgagctggtgagcgaggagcccttcgtggtgaagctgagattcgagcccgccggcagacccgagagccccggcgactactacctgatggtgaaggagaacctgtgcgtggtgtgcggcaagagagacagctacatcagaaagaacgtgatcccccacgagtacagaaagcacttccccatcgagatgaaggaccacaacagccacgacgtgctgctgctgtgcaccagctgccacgccatcagcaactactacgacaaccacctgaagcagcagctggccaaggagttccaggcccccatcggcagcgaggagggcctgagactgctggaggaccccgagagaagacaggtgagaagcggcgccagagccctgctgaacgccgagagcctgcccacccagagaaaggaggagctgctgcaggccctgagagagttctacaacaccgacgtggtgaccgaggagatgctgcaggaggccgccagcctggagaccagaatcagcaacgagaactacgtgccccacggcctgaaggtggtgcagtgccacagccagggcggcctgagaagcctgatgcagctggagagcagatggagacagcacttcctggacagcatgcagcccaagcacctgccccagcagtggagcgtggaccacaaccaccagaagctgctgagaaagttcggcgaggacctgcccatccagctgagctag

SEQ ID NO: 20747 - DNA, 1491 bp, Artificial Sequence
  Description of Artificial Sequence: Synthetic coding sequence
atggccagccccagcggcctgtgcgtgctggtgagactgcccaagctgatctgcggcggcaagaccctgcccagaaccctgctggacatcctggccgacggcaccatcctgaaggtgggcgtgggctgcagcgaggacgccagcaagctgctgcaggactacggcctggtggtgagaggctgcctggacctgagatacctggccatgagacagagaaacaacctgctgtgcaacggcctgagcctgaagagcctggccgagaccgtgctgaacttccccctggacaagagcctgctgctgagatgcagcaactgggacgccgagaccctgaccgaggaccaggtgatctacgccgccagagacgcccagatcagcgtggccctgttcctgcacctgctgggctaccccttcagcagaaacagccccggcgagaagaacgacgaccacagcagctggagaaaggtgctggagaagtgccagggcgtggtggacatccccttcagaagcaagggcatgagcagactgggcgaggaggtgaacggcgaggccaccgagagccagcagaagcccagaaacaagaagagcaagatggacggcatggtgcccggcaaccaccagggcagagaccccagaaagcacaagagaaagcccctgggcgtgggctacagcgccagaaagagccccctgtacgacaactgcttcctgcacgcccccgacggccagcccctgtgcacctgcgacagaagaaaggcccagtggtacctggacaagggcatcggcgagctggtgagcgaggagcccttcgtggtgaagctgagattcgagcccgccggcagacccgagagccccggcgactactacctgatggtgaaggagaacctgtgcgtggtgtgcggcaagagagacagctacatcagaaagaacgtgatcccccacgagtacagaaagcacttccccatcgagatgaaggaccacaacagccacgacgtgctgctgctgtgcaccagctgccacgccatcagcaactactacgacaaccacctgaagcagcagctggccaaggagttccaggcccccatcggcagcgaggagggcctgagactgctggaggaccccgagagaagacaggtgagaagcggcgccagagccctgctgaacgccgagagcctgcccacccagagaaaggaggagctgctgcaggccctgagagagttctacaacaccgacgtggtgaccgaggagatgctgcaggaggccgccagcctggagaccagaatcagcaacgagaactacgtgccccacggcctgaaggtggtgcagtgccacagccagggcggcctgagaagcctgatgcagctggagagcagatggagacagcacttcctggacagcatgcagcccaagcacctgccccagcagtggagcgtggaccacaaccaccagaagctgctgagaaagttcggcgaggacctgcccatccagctgagctag

SEQ ID NO: 20748 - DNA, 1866 bp, Artificial Sequence; identical to SEQ ID NO: 20746
  Description of Artificial Sequence: Synthetic coding sequence

SEQ ID NO: 20749 - DNA, 1491 bp, Artificial Sequence; identical to SEQ ID NO: 20747
  Description of Artificial Sequence: Synthetic coding sequence

SEQ ID NO: 20750 - DNA, 1491 bp, Artificial Sequence; identical to SEQ ID NO: 20747
  Description of Artificial Sequence: Synthetic coding sequence

SEQ ID NO: 20751 - DNA, 1491 bp, Artificial Sequence; identical to SEQ ID NO: 20747
  Description of Artificial Sequence: Synthetic coding sequence

SEQ ID NO: 20752 - DNA, 345 bp, Artificial Sequence
  Description of Artificial Sequence: Synthetic coding sequence
atggccagccccagcggcctgtgcgtgctggtgagactgcccaagctgatctgcggcggcaagaccctgcccagaaccctgctggacatcctggccgacggcaccatcctgaaggtgggcgtgggctgcagcgaggacgccagcaagctgctgcaggactacggcctggtggtgagaggctgcctggacctgagatacctggccatgagacagagaaacaacctgctgtgcaacggcctgagcctgaagagcctggccgagaccgtgctgaacttccccctggacaagagcctgctgctgagatgcagcaactgggacgccgagaccctgaccgaggaccagtag

SEQ ID NO: 20753 - DNA, 1491 bp, Artificial Sequence; identical to SEQ ID NO: 20747
  Description of Artificial Sequence: Synthetic coding sequence

SEQ ID NO: 20754 - DNA, 2631 bp, Artificial Sequence
  Description of Artificial Sequence: Synthetic coding sequence
atggaccccggcgaccccgccggcgaccccgccgccggcgagagacacagaatgggcagagaccccctgctgctgctgcaggccctgcagaccctgtggagcaccagagagagaaagcagctgagagaggaggcctggagaggcttcgccgccctggacgaccccctggccggcctgctggacatgctggagagctgcagaggccagagaggcgagggccccagcctggccgcctggatcagccaccagctgcagtgctggctgcaggcccagccctgccccagcctggcccagcacagcctgagactgaagcagctgcaggccagagccgtgaaggtgctgaccgagagcccccccagcctggccgcccccctggccagcatcttccagctgcaggacgccgacagaagctgcctgctggcccacgtgcacagactgcaccacgagggcagattcagagaggccgccaccctgggcgccaccctgaagctgcagagcgagctgggcgtggagaagatgagcatccccctgctgctgcaggacaaggtggccctggtggagagatacgtggccggcttccccgacctgcagagaagactgctggtgctgatggacagctggtgccagcccggcttcgacatcaaggacgtggccagaagataccccgaggtgaccagcctgagcctggagaagctgagccccaaggccctgagcagacaggtgctgagactgcaggagagatacggcgtggcccccgccctgtgccccaacgccgccatccagcagagactggccgccctgagacacctgtgccacaagagattcgtggagaagagcctgagccaggagaactggaccgaccacgtgcagggcctggtgggccagagcccctggctgcaggagcagctgagccagctgctggtgagccacagcgaccccgtgaccgccgcccagtgcgccatggagctgctgctgcccgaggagagactgcccgccgccgtggccgtggagctgagaagattcagactgcagggcagagccaccgaggccgacagcagactggaggtgaaggacatgaaggacagatactaccagctgcccatccccagagagaacgtgcacctgctggccagctgggaggacctgaccagacacgagggcgccctgctgcagtgccaccaggtggtgggcgtggacgtggagtggacccccgtgttcgtggccggcggcagacccagacccagcctgctgcaggtggccgtggagggccacgtgttcctgctggacgtgctggccctgagccagccccccaccggccagggcgcccaggccttcagcagactggtggcccagctgctgagcgaccccagcatcaccaagctgggctacggcatggtgggcgacctgcagaagctgggcaccagctgccccgccctggcccacgtggagaagcagatcctgggcggcatggacctgctgctggtgcacagacagatgagagtggccagcgtgcccgcccccgccgtggacagagccagagagctgagaggcctgagcctgctggtgcagcaggtgctgggcaccgccctggacaagacccagcagctgagcaactgggacagaagacccctgtgcgaggagcaggtgatctacgccgccgccgacgcctactgcctgctggaggtgcaccaggccctgtgcagagagcccgccagattccacctgagcgaggacctggccggcagcagaagacccagacacagagagagacccggcgccagaaagccccccggcctgcagaaggccagcgcccccgccgcccccagacaggtgcccgtggccgtggccgtgagcgagggcgccgccccccagatccccgccagagccttcagagtggtgtgcgacaacatgctgcagggcctggccagaagcctgagatgcctgggcgtggacgccagaatgctgggcaacggcgaggaccacagaagagccgccgaggtggccagacaggagggcagaatcatcctgaccagcggccagcccttccacaagctgagagcccaggtgggcgccggcagatgcctgagcgtggactgcagcctgaaggcccagcagcaggccaaggccgtgctgaagcacttcaacgtgagagtgacccacgccgacatcttcagcagatgccaggcctgcaactgcgaccagtacctgaaggtgagcagagacatgatgaagcagctgatgtggctgagcagccaccaggagggccccagaagcagcggcgacgaggccacccagagccaggccgtgcaggagcccggccccgcccccgacgccgcccccgagggctgcacctacgacagaccctgcagatggctgcagatggccgacctgagagccgagacccccgacatgctggccgacggcaccagactgcagctggccggcgtgcccgtgggcgtgctgagaacccccggcctgagatgcttctactgctgcaccggctgcggcaaggtgttctgggacggcagccacctgggcagagtggccacccacttcagagacatgctggagagcgcccccagcccctgcgagcccagccccgcccccagccccgccagcagccccttctag

SEQ ID NO: 20755 - DNA, 1545 bp, Artificial Sequence
  Description of Artificial Sequence: Synthetic coding sequence
atggagctgctgctgcccgaggagagactgcccgccgccgtggccgtggagctgagaagattcagactgcagggcagagccaccgaggccgacagcagactggaggtgaaggacatgaaggacagatactaccagctgcccatccccagagagaacgtgcacctgctggccagctgggaggacctgaccagacacgagggcgccctgctgcagtgccaccaggtggtgggcgtggacgtggagtggacccccgtgttcgtggccggcggcagacccagacccagcctgctgcaggtggccgtggagggccacgtgttcctgctggacgtgctggccctgagccagccccccaccggccagggcgcccaggccttcagcagactggtggcccagctgctgagcgaccccagcatcaccaagctgggctacggcatggtgggcgacctgcagaagctgggcaccagctgccccgccctggcccacgtggagaagcagatcctgggcggcatggacctgctgctggtgcacagacagatgagagtggccagcgtgcccgcccccgccgtggacagagccagagagctgagaggcctgagcctgctggtgcagcaggtgctgggcaccgccctggacaagacccagcagctgagcaactgggacagaagacccctgtgcgaggagcaggtgatctacgccgccgccgacgcctactgcctgctggaggtgcaccaggccctgtgcagagagcccgccagattccacctgagcgaggacctggccggcagcagaagacccagacacagagagagacccggcgccagaaagccccccggcctgcagaaggccagcgcccccgccgcccccagacagggcctggccagaagcctgagatgcctgggcgtggacgccagaatgctgggcaacggcgaggaccacagaagagccgccgaggtggccagacaggagggcagaatcatcctgaccagcggccagcccttccacaagctgagagcccaggtgggcgccggcagatgcctgagcgtggactgcagcctgaaggcccagcagcaggccaaggccgtgctgaagcacttcaacgtgagagtgacccacgccgacatcttcagcagatgccaggcctgcaactgcgaccagtacctgaaggtgagcagagacatgatgaagcagctgatgtggctgagcagccaccaggagggccccagaagcagcggccccgcccccgacgccgcccccgagggctgcacctacgacagaccctgcagatggctgcagatggccgacctgagagccgagacccccgacatgctggccgacggcaccagactgcagctggccggcgtgcccgtgggcgtgctgagaacccccggcctgagatgcttctactgctgcaccggctgcggcaaggtgttctgggacggcagccacctgggcagagtggccacccacttcagagacatgctggagagcgcccccagcccctgcgagcccagccccgcccccagccccgccagcagccccttctag

SEQ ID NO: 20756 - DNA, 2682 bp, Artificial Sequence
  Description of Artificial Sequence: Synthetic coding sequence
atgaccccccccagcagagccgaggccggcgtgagaagaagcagagtgcccagcgagggcagatggagaggcgccgagccccccggcatcagcgccagcacccagcccgccagcgccggcagagccgccagacactgcggcgccatgagcggcgccagaggcgagggccccgaggccggcgccggcggcgccggcggcagagccgcccccgagaaccccggcggcgtgctgagcgtggagctgcccggcctgctggcccagctggccagaagcttcgccctgctgctgcccgtgtacgccctgggctacctgggcctgagcttcagctgggtgctgctggccctggccctgctggcctggtgcagaagaagcagaggcctgaaggccctgagactgtgcagagccctggccctgctggaggacgaggagagagtggtgagactgggcgtgagagcctgcgacctgcccgcctgggtgcacttccccgacaccgagagagccgagtggctgaacaagaccgtgaagcacatgtggcccttcatctgccagttcatcgagaagctgttcagagagaccatcgagcccgccgtgagaggcgccaacacccacctgagcaccttcagcttcaccaaggtggacgtgggccagcagcccctgagaatcaacggcgtgaaggtgtacaccgagaacgtggacaagagacagatcatcctggacctgcagatcagcttcgtgggcaactgcgagatcgacctggagatcaagagatacttctgcagagccggcgtgaagagcatccagatccacggcaccatgagagtgatcctggagcccctgatcggcgacatgcccctggtgggcgccctgagcatcttcttcctgagaaagcccctgctggagatcaactggaccggcctgaccaacctgctggacgtgcccggcctgaacggcctgagcgacaccatcatcctggacatcatcagcaactacctggtgctgcccaacagaatcaccgtgcccctggtgagcgaggtgcagatcgcccagctgagattccccgtgcccaagggcgtgctgagaatccacttcatcgaggcccaggacctgcagggcaaggacacctacctgaagggcctggtgaagggcaagagcgacccctacggcatcatcagagtgggcaaccagatcttccagagcagagtgatcaaggagaacctgagccccaagtggaacgaggtgtacgaggccctggtgtacgagcaccccggccaggagctggagatcgagctgttcgacgaggaccccgacaaggacgacttcctgggcagcctgatgatcgacctgatcgaggtggagaaggagagactgctggacgagtggttcaccctggacgaggtgcccaagggcaagctgcacctgagactggagtggctgaccctgatgcccaacgccagcaacctggacaaggtgctgaccgacatcaaggccgacaaggaccaggccaacgacggcctgagcagcgccctgctgatcctgtacctggacagcgccagaaacctgcccagcggcaagaagatcagcagcaaccccaaccccgtggtgcagatgagcgtgggccacaaggcccaggagagcaagatcagatacaagaccaacgagcccgtgtgggaggagaacttcaccttcttcatccacaaccccaagagacaggacctggaggtggaggtgagagacgagcagcaccagtgcagcctgggcaacctgaaggtgcccctgagccagctgctgaccagcgaggacatgaccgtgagccagagattccagctgagcaacagcggccccaacagcaccatcaagatgaagatcgccctgagagtgctgcacctggagaagagagagagaccccccgaccaccagcacagcgcccaggtgaagagacccagcgtgagcaaggagggcagaaagaccagcatcaagagccacatgagcggcagccccggccccggcggcagcaacaccgcccccagcacccccgtgatcggcggcagcgacaagcccggcatggaggagaaggcccagccccccgaggccggcccccagggcctgcacgacctgggcagaagcagcagcagcctgctggccagccccggccacatcagcgtgaaggagcccacccccagcatcgccagcgacatcagcctgcccatcgccacccaggagctgagacagagactgagacagctggagaacggcaccaccctgggccagagccccctgggccagatccagctgaccatcagacacagcagccagagaaacaagctgatcgtggtggtgcacgcctgcagaaacctgatcgccttcagcgaggacggcagcgacccctacgtgagaatgtacctgctgcccgacaagagaagaagcggcagaagaaagacccacgtgagcaagaagaccctgaaccccgtgttcgaccagagcttcgacttcagcgtgagcctgcccgaggtgcagagaagaaccctggacgtggccgtgaagaacagcggcggcttcctgagcaaggacaagggcctgctgggcaaggtgctggtggccctggccagcgaggagctggccaagggctggacccagtggtacgacctgaccgaggacggcaccagaccccaggccatgacctag

SEQ ID NO: 20757 - DNA, 672 bp, Artificial Sequence
  Description of Artificial Sequence: Synthetic coding sequence
atgcccgtgttccccccctgcgtgctgcaggtgagagacgagcagcaccagtgcagcctgggcaacctgaaggtgcccctgagccagctgctgaccagcgaggacatgaccgtgagccagagattccagctgagcaacagcggccccaacagcaccatcaagatgaagatcgccctgagagtgctgcacctggagaagagagagagaccccccgaccaccagcacagcgcccaggtgaagagacccagcgtgagcaaggagggcagaaagaccagcatcaagagccacatgagcggcagccccggccccggcggcagcaacaccgcccccagcacccccgtgatcggcggcagcgacaagcccggcatggaggagaaggcccagccccccgaggccggcccccagggcctgcacgacctgggcagaagcagcagcagcctgctggccagccccggccacatcagcgtgaaggagcccacccccagcatcgccagcgacatcagcctgcccatcgccacccaggagctgagacagagactgagacagctggagaacggcaccaccctgggccagagccccctgggccagatccagctgaccatcagacacagcagccagaagcaggcctacagaggcagagcctgcctgcagaagccccactgcctgctgtag

SEQ ID NO: 20758 - DNA, 2829 bp, Artificial Sequence
  Description of Artificial Sequence: Synthetic coding sequence
atgaccgccaacagagacgccgccctgagcagccacagacaccccggctgcgcccagagacccagaacccccaccttcgccagcagcagccagagaagaagcgccttcggcttcgacgacggcaacttccccggcctgggcgagagaagccacgcccccggcagcagactgggcgccagaagaagagccaagaccgccagaggcctgagaggccacagacagagaggcgccggcgccggcctgagcagacccggcagcgccagagcccccagcccccccagacccggcgcccccgagaaccccggcggcgtgctgagcgtggagctgcccggcctgctggcccagctggccagaagcttcgccctgctgctgcccgtgtacgccctgggctacctgggcctgagcttcagctgggtgctgctggccctggccctgctggcctggtgcagaagaagcagaggcctgaaggccctgagactgtgcagagccctggccctgctggaggacgaggagagagtggtgagactgggcgtgagagcctgcgacctgcccgcctgggtgcacttccccgacaccgagagagccgagtggctgaacaagaccgtgaagcacatgtggcccttcatctgccagttcatcgagaagctgttcagagagaccatcgagcccgccgtgagaggcgccaacacccacctgagcaccttcagcttcaccaaggtggacgtgggccagcagcccctgagaatcaacggcgtgaaggtgtacaccgagaacgtggacaagagacagatcatcctggacctgcagatcagcttcgtgggcaactgcgagatcgacctggagatcaagagatacttctgcagagccggcgtgaagagcatccagatccacggcaccatgagagtgatcctggagcccctgatcggcgacatgcccctggtgggcgccctgagcatcttcttcctgagaaagcccctgctggagatcaactggaccggcctgaccaacctgctggacgtgcccggcctgaacggcctgagcgacaccatcatcctggacatcatcagcaactacctggtgctgcccaacagaatcaccgtgcccctggtgagcgaggtgcagatcgcccagctgagattccccgtgcccaagggcgtgctgagaatccacttcatcgaggcccaggacctgcagggcaaggacacctacctgaagggcctggtgaagggcaagagcgacccctacggcatcatcagagtgggcaaccagatcttccagagcagagtgatcaaggagaacctgagccccaagtggaacgaggtgtacgaggccctggtgtacgagcaccccggccaggagctggagatcgagctgttcgacgaggaccccgacaaggacgacttcctgggcagcctgatgatcgacctgatcgaggtggagaaggagagactgctggacgagtggttcaccctggacgaggtgcccaagggcaagctgcacctgagactggagtggctgaccctgatgcccaacgccagcaacctggacaaggtgctgaccgacatcaaggccgacaaggaccaggccaacgacggcctgagcagcgccctgctgatcctgtacctggacagcgccagaaacctgcccagcaaccccctggagttcaaccccgacgtgctgaagaagaccgccgtgcagagagccctgaagagcggcaagaagatcagcagcaaccccaaccccgtggtgcagatgagcgtgggccacaaggcccaggagagcaagatcagatacaagaccaacgagcccgtgtgggaggagaacttcaccttcttcatccacaaccccaagagacaggacctggaggtggaggtgagagacgagcagcaccagtgcagcctgggcaacctgaaggtgcccctgagccagctgctgaccagcgaggacatgaccgtgagccagagattccagctgagcaacagcggccccaacagcaccatcaagatgaagatcgccctgagagtgctgcacctggagaagagagagagaccccccgaccaccagcacagcgcccaggtgaagagacccagcgtgagcaaggagggcagaaagaccagcatcaagagccacatgagcggcagccccggccccggcggcagcaacaccgcccccagcacccccgtgatcggcggcagcgacaagcccggcatggaggagaaggcccagccccccgaggccggcccccagggcctgcacgacctgggcagaagcagcagcagcctgctggccagccccggccacatcagcgtgaaggagcccacccccagcatcgccagcgacatcagcctgcccatcgccacccaggagctgagacagagactgagacagctggagaacggcaccaccctgggccagagccccctgggccagatccagctgaccatcagacacagcagccagagaaacaagctgatcgtggtggtgcacgcctgcagaaacctgatcgccttcagcgaggacggcagcgacccctacgtgagaatgtacctgctgcccgacaagagaagaagcggcagaagaaagacccacgtgagcaagaagaccctgaaccccgtgttcgaccagagcttcgacttcagcgtgagcctgcccgaggtgcagagaagaaccctggacgtggccgtgaagaacagcggcggcttcctgagcaaggacaagggcctgctgggcaaggtgctggtggccctggccagcgaggagctggccaagggctggacccagtggtacgacctgaccgaggacggcaccagaccccaggccatgacctag

SEQ ID NO: 20759 - DNA, 1584 bp, Artificial Sequence
  Description of Artificial Sequence: Synthetic coding sequence
atgtggcccttcatctgccagttcatcgagaagctgttcagagagaccatcgagcccgccgtgagaggcgccaacacccacctgagcaccttcagcttcaccaaggtggacgtgggccagcagcccctgagaatcaacggcgtgaaggtgtacaccgagaacgtggacaagagacagatcatcctggacctgcagatcagcttcgtgggcaactgcgagatcgacctggagatcaagagatacttctgcagagccggcgtgaagagcatccagatccacggcaccatgagagtgatcctggagcccctgatcggcgacatgcccctggtgggcgccctgagcatcttcttcctgagaaagcccctgctggagatcaactggaccggcctgaccaacctgctggacgtgcccggcctgaacggcctgagcgacaccatcatcctggacatcatcagcaactacctggtgctgcccaacagaatcaccgtgcccctggtgagcgaggtgcagatcgcccagctgagattccccgtgcccaagggcgtgctgagaatccacttcatcgaggcccaggacctgcagggcaaggacacctacctgaagggcctggtgaagggcaagagcgacccctacggcatcatcagagtgggcaaccagatcttccagagcagagtgatcaaggagaacctgagccccaagtggaacgaggtgtacgaggccctggtgtacgagcaccccggccaggagctggagatcgagctgttcgacgaggaccccgacaaggacgacttcctgggcagcctgatgatcgacctgatcgaggtggagaaggagagactgctggacgagtggttcaccctggacgaggtgcccaagggcaagctgcacctgagactggagtggctgaccctgatgcccaacgccagcaacctggacaaggtgctgaccgacatcaaggccgacaaggaccaggccaacgacggcctgagcagcgccctgctgatcctgtacctggacagcgccagaaacctgcccagcggcaagaagatcagcagcaaccccaaccccgtggtgcagatgagcgtgggccacaaggcccaggagagcaagatcagatacaagaccaacgagcccgtgtgggaggagaacttcaccttcttcatccacaaccccaagagacaggacctggaggtggaggtgagagacgagcagcaccagtgcagcctgggcaacctgaaggtgcccctgagccagctgctgaccagcgaggacatgaccgtgagccagagattccagctgagcaacagcggccccaacagcaccatcaagatgaagatcgccctgagagtgctgcacctggagaagagagagagaccccccgaccaccagcacagcgcccaggtgaagagacccagcgtgagcaaggagggcagaaagaccagcatcaagagccacatgagcggcagccccggccccggcggcagcaacaccgcccccgccaccagccagagcagaagcagaccccccgccagccccagaaccagcagatgccccagcccccccagaagctgcggcaagggctag

SEQ ID NO: 20760 - DNA, 987 bp, Artificial Sequence
  Description of Artificial Sequence: Synthetic coding sequence
atgcccgtgttccccccctgcgtgctgcaggtgagagacgagcagcaccagtgcagcctgggcaacctgaaggtgcccctgagccagctgctgaccagcgaggacatgaccgtgagccagagattccagctgagcaacagcggccccaacagcaccatcaagatgaagatcgccctgagagtgctgcacctggagaagagagagagaccccccgaccaccagcacagcgcccaggtgaagagacccagcgtgagcaaggagggcagaaagaccagcatcaagagccacatgagcggcagccccggccccggcggcagcaacaccgcccccagcacccccgtgatcggcggcagcgacaagcccggcatggaggagaaggcccagccccccgaggccggcccccagggcctgcacgacctgggcagaagcagcagcagcctgctggccagccccggccacatcagcgtgaaggagcccacccccagcatcgccagcgacatcagcctgcccatcgccacccaggagctgagacagagactgagacagctggagaacggcaccaccctgggccagagccccctgggccagatccagctgaccatcagacacagcagccagagaaacaagctgatcgtggtggtgcacgcctgcagaaacctgatcgccttcagcgaggacggcagcgacccctacgtgagaatgtacctgctgcccgacaagagaagaagcggcagaagaaagacccacgtgagcaagaagaccctgaaccccgtgttcgaccagagcttcgacttcagcgtgagcctgcccgaggtgcagagaagaaccctggacgtggccgtgaagaacagcggcggcttcctgagcaaggacaagggcctgctgggcaaggtgctggtggccctggccagcgaggagctggccaagggctggacccagtggtacgacctgaccgaggacggcaccagaccccaggccatgacctag

SEQ ID NO: 20761 - DNA, 2487 bp, Artificial Sequence
  Description of Artificial Sequence: Synthetic coding sequence
atggccggcagaggctggggcgccctgtgggtgtgcgtggccgccgccaccctgctgcacgccggcggcctggccagagccgactgctggctgatcgagggcgacaagggcttcgtgtggctggccatctgcagccagaaccagcccccctacgaggccatcccccagcagatcaacagcaccatcgtggacctgagactgaacgagaacagaatcagaagcgtgcagtacgccagcctgagcagattcggcaacctgacctacctgaacctgaccaagaacgagatcggctacatcgaggacggcgccttcagcggccagttcaacctgcaggtgctgcagctgggctacaacagactgagaaacctgaccgagggcatgctgagaggcctgggcaagctggagtacctgtacctgcaggccaacctgatcgaggtggtgatggccagcagcttctgggagtgccccaacatcgtgaacatcgacctgagcatgaacagaatccagcagctgaacagcggcaccttcgccggcctggccaagctgagcgtgtgcgagctgtacagcaaccccttctactgcagctgcgagctgctgggcttcctgagatggctggccgccttcaccaacgccacccagacctacgacagaatgcagtgcgagagcccccccgtgtacagcggctactacctgctgggccagggcagaagaggccacagaagcatcctgagcaagctgcagagcgtgtgcaccgaggacagctacgccgccgaggtggtgggcccccccagacccgccagcggcagaagccagcccggcagaagccccccccccccccccccccccgagcccagcgacatgccctgcgccgacgacgagtgcttcagcggcgacggcaccacccccctggtggccctgcccaccctggccacccaggccgaggccagacccctgatcaaggtgaagcagctgacccagaacagcgccaccatcaccgtgcagctgcccagccccttccacagaatgtacaccctggagcacttcaacaacagcaaggccagcaccgtgagcagactgaccaaggcccaggaggagatcagactgaccaacctgttcaccctgaccaactacacctactgcgtggtgagcaccagcgccggcctgagacacaaccacacctgcctgaccatctgcctgcccagactgcccagcccccccggccccgtgcccagccccagcaccgccacccactacatcatgaccatcctgggctgcctgttcggcatggtgctggtgctgggcgccgtgtactactgcctgagaagaagaagaagacaggaggagaagcacaagaaggccgccagcgccgccgccgccggcagcctgaagaagaccatcatcgagctgaagtacggccccgagctggaggcccccggcctggcccccctgagccagggccccctgctgggccccgaggccgtgaccagaatcccctacctgcccgccgccggcgaggtggagcagtacaagctggtggagagcgccgacacccccaaggccagcaagggcagctacatggaggtgagaaccggcgacccccccgagagaagagactgcgagctgggcagacccggccccgacagccagagcagcgtggccgagatcagcaccatcgccaaggaggtggacaaggtgaaccagatcatcaacaactgcatcgacgccctgaagagcgagagcaccagcttccagggcgtgaagagcggccccgtgagcgtggccgagccccccctggtgctgctgagcgagcccctggccgccaagcacggcttcctggcccccggctacaaggacgccttcggccacagcctgcagagacaccacagcgtggaggccgccggcccccccagagccagcaccagcagcagcggcagcgtgagaagccccagagccttcagagccgaggccgtgggcgtgcacaaggccgccgccgccgaggccaagtacatcgagaagggcagccccgccgccgacgccatcctgaccgtgacccccgccgccgccgtgctgagagccgaggccgagaagggcagacagtacggcgagcacagacacagctaccccggcagccaccccgccgagccccccgccccccccggccccccccccccccccccccacgagggcctgggcagaaaggccagcatcctggagcccctgaccagacccagacccagagacctggcctacagccagctgagcccccagtaccacagcctgagctacagcagcagccccgagtacacctgcagagccagccagagcatctgggagagattcagactgagcagaagaagacacaaggaggaggaggagttcatggccgccggccacgccctgagaaagaaggtgcagttcgccaaggacgaggacctgcacgacatcctggactactggaagggcgtgagcgcccagcacaagagctag

SEQ ID NO: 20762 - DNA, 2487 bp, Artificial Sequence; identical to SEQ ID NO: 20761
  Description of Artificial Sequence: Synthetic coding sequence

SEQ ID NO: 20763 - DNA, 495 bp, Artificial Sequence
  Description of Artificial Sequence: Synthetic coding sequence
atgctgcagcaggacagcaacgacgacaccgaggacgtgagcctgttcgacgccgaggaggagaccaccaacagacccagaaaggccaagatcagacaccccgtggccagcttcttccacctgttcttcagagtgagcgccatcatcgtgtgcctgctgtgcgagctgctgagcagcagcttcatcacctgcatggtgaccatcatcctgctgctgagctgcgacttctgggccgtgaagaacgtgaccggcagactgatggtgggcctgagatggtggaaccacatcgacgaggacggcaagagccactgggtgttcgagagcagaaaggagagcagccaggagaacaagaccgtgagcgaggccgagagcagaatcttctggctgggcctgatcgcctgcagcgtgctgtgggtgatcttcgccttcagcgccctgttcagcttcaccgtgaagtggctggagagcgagcccgtgatgctgagaaaccagtag

SEQ ID NO: 20764 - DNA, 534 bp, Artificial Sequence
  Description of Artificial Sequence: Synthetic coding sequence
atgagcgtgaacatggacgagctgaagcaccaggtgatgatcaaccagttcgtgctgaccgccggctgcgccgccgaccaggccaagcagctgctgcaggccgcccactggcagttcgagaccgccctgagcgccttcttccaggagaccaacatcccctacagccaccaccaccaccagatgatgtgcacccccgccaacacccccgccaccccccccaacttccccgacgccctgaccatgttcagcagactgaaggccagcgagagcttccacagcggcggcagcggcagccccatggccgccaccgccaccagcccccccccccacttcccccacgccgccaccagcagcagcgccgccagcagctggcccaccgccgccagcccccccggcggcccccagcaccaccagccccagccccccctgtggacccccaccccccccagccccgccagcgactggccccccctggccccccagcaggccaccagcgagcccagagcccaccccgccatggaggccgagagatag

SEQ ID NO: 20765 - DNA, 495 bp, Artificial Sequence
  Description of Artificial Sequence: Synthetic coding sequence
atgagcgtgaacatggacgagctgagacaccaggtgatgatcaaccagttcgtgctggccgccggctgcgccgccgaccaggccaagcagctgctgcaggccgcccactggcagttcgagaccgccctgagcaccttcttccaggagaccaacatccccaacagccaccaccaccaccagatgatgtgcacccccagcaacacccccgccaccccccccaacttccccgacgccctggccatgttcagcaagctgagagccagcgagggcctgcagagcagcaacagccccatgaccgccgccgcctgcagcccccccgccaacttcagccccttctgggccagcagcccccccagccaccaggccccctggatcccccccagcagccccaccaccttccaccacctgcacagaccccagcccacctggccccccggcgcccagcagggcggcgcccagcagaaggccatggccgccatggacggccagagatag

SEQ ID NO: 20766 - DNA, 435 bp, Artificial Sequence
  Description of Artificial Sequence: Synthetic coding sequence
agccccgccagcctgcccctggcccccggctgcgccctgagactgtgccccctgagcttcggcgagggcgtggagttcgaccccctgccccccaaggaggtgagatacaccagcctggtgaagtacgacagcgagagacacttcatcgacgacgtgcagctgcccctgggcctggccgtggccagctgcagccagaccgtgacctgcgtgcccaacggcacctggagaaactacaaggccgaggtgagattcgagcccagacacagacccaccagattcctgagcaccaccatcgtgtaccccaagtaccccaaggccgtgtacaccaccaccctggactacaactgcagaaagaccctgagaagattcctgagcagcgtggagctggaggccgccgagctgcccggcagcgacgacctgagcgacgagtgctag

SEQ ID NO: 20767 - DNA, 408 bp, Artificial Sequence
  Description of Artificial Sequence: Synthetic coding sequence
atgagacccagaatgctgcccgtgttcttcggcgagagcatcaaggtgaaccccgagcccacccacgagatcagatgcaacagcgaggtgaagtacgccagcgagaagcacttccaggacaaggtgttctacgcccccgtgcccaccgtgaccgcctacagcgagaccatcgtggccgcccccaactgcacctggagaaactacagaagccagctgaccctggagcccagacccagagccctgagattcagaagcaccaccatcatcttccccaagcacgccagaagcaccttcagaaccaccctgcactgcagcctgggcagacccagcagatggttcaccgccagcgtgcagctgcagctgtgccaggaccccgcccccagcctgctgggccccgccaccctgtag

SEQ ID NO: 20768 - DNA, 408 bp, Artificial Sequence; identical to SEQ ID NO: 20767
  Description of Artificial Sequence: Synthetic coding sequence

SEQ ID NO: 20769 - DNA, 651 bp, Artificial Sequence
  Description of Artificial Sequence: Synthetic coding sequence
atggtgggccacctgcacctgcagggcatggaggacagcctgaaggagcagggcagagagggcctgctggacagccccgacagcggcctgccccccagccccagccccagcccccccttctacagcctggcccccggcatcctggacgccagagccggcggcgccggcgccagcagcgagccccccggccccagcgaggccagagccccccccagccagctgcccaacccccccgccagcgagatgagacccagaatgctgcccgtgttcttcggcgagagcatcaaggtgaaccccgagcccacccacgagatcagatgcaacagcgaggtgaagtacgccagcgagaagcacttccaggacaaggtgttctacgcccccgtgcccaccgtgaccgcctacagcgagaccatcgtggccgcccccaactgcacctggagaaactacagaagccagctgaccctggagcccagacccagagccctgagattcagaagcaccaccatcatcttccccaagcacgccagaagcaccttcagaaccaccctgcactgcagcctgggcagacccagcagatggttcaccgccagcgtgcagctgcagctgtgccaggaccccgcccccagcctgctgggccccgccaccctgtag

SEQ ID NO: 20770 - DNA, 369 bp, Artificial Sequence
  Description of Artificial Sequence: Synthetic coding sequence
atgagacccagaatgctgcccgtgttcttcggcgagagcatcaaggtgaaccccgagcccacccacgagatcagatgcaacagcgaggtgaagtacgccagcgagaagcacttccaggacaaggtgttctacgcccccgtgcccaccgtgaccgcctacagcgagaccatcgtggccgcccccaactgcacctggagaaactacagaagcagatggttcaccgccagcgtgcagctgcagctgtgccaggaggccggcagagaggccgccagacccagaaccagagtggagggcggcggcagccccctgcccgccctgacctacagactgggcggcggcctgctggtgctggtgagcagaacccagtag

SEQ ID NO: 20771 - DNA, 408 bp, Artificial Sequence; identical to SEQ ID NO: 20767
  Description of Artificial Sequence: Synthetic coding sequence

SEQ ID NO: 20772 - DNA, 435 bp, Artificial Sequence; identical to SEQ ID NO: 20766
  Description of Artificial Sequence: Synthetic coding sequence

SEQ ID NO: 20773 - DNA, 1083 bp, Artificial Sequence
  Description of Artificial Sequence: Synthetic coding sequence
atgatgaagaagaagaagttcaagttcaaggtggacttcgagctggaggagctgagcagcgtgcccttcgtgaacggcgtgctgttctgcaagatgagactgctggacggcggcagcttcaccgccgagagcagcagagaggtggtgcaggccaactgcgtgagatggagaaagaagttcagcttcatgtgcaagatgagcgccagcgccgccaccggcatcctggacccctgcatctacagagtgagcgtgagaaaggagctgaagggcggcaaggcctacgccaagctgggcttcgccgacctgaacctggccgagttcgccggcagcggcaacaccaccagaagatgcctgctggagggctacgacaccaagaacaccagacaggacaacagcatcctgaaggtgctgatcagcatgcagctgatgagcggcgacccctgcttcaagaccccccccagcaccagcatgagcatccccatcgccggcgagagcgagagcctgcaggaggacagaaagggcggcgagaccctgaaggtgcacctgggcatcgccgacctgagcgccaagagcgccagcgtgcccgacgagctgggcgcctgcggccacagcagaaccagcagctacgccagccagcagagcaaggtgagcggctacagcacctgccacagcagaagcagcagcttcagcgagctgtgccacagaagaaacaccagcgtgggcagcaccagcaccggcgtggagagcatcctggagccctgcgacgagatcgagcagaagatcgccgagcccaacctggacaccgccgacaaggaggacaccgccagcgagaagctgagcagatgccccgtgaagcaggacagcgtggagagccagctgaagagagtggacgacaccagagtggacgccgacgacatcgtggagaagatcctgcagagccaggacttcagcctggacagcagcgccgaggaggagggcctgagactgttcgtgggccccggcggcagcaccaccttcggcagccaccacctgcccaacagagtgggcagcggcgcctacgagcaggtggtgatcaagagatag

SEQ ID NO: 20774 - DNA, 1068 bp, Artificial Sequence
  Description of Artificial Sequence: Synthetic coding sequence
atgatgaagaagaagaagttcaagttcaaggtggacttcgagctggaggagctgagcagcgtgcccttcgtgaacggcgtgctgttctgcaagatgagactgctggacggcggcagcttcaccgccgagagcagcagagaggtggtgcaggccaactgcgtgagatggagaaagaagttcagcttcatgtgcaagatgagcgccagcgccgccaccggcatcctggacccctgcatctacagagtgagcgtgagaaaggagctgaagggcggcaaggcctacgccaagctgggcttcgccgacctgaacctggccgagttcgccggcagcggcaacaccaccagaagatgcctgctggagggctacgacaccaagaacaccagacaggacaacagcatcctgaaggtgctgatcagcatgcagctgatgagcggcgacccctgcttcaagaccccccccagcaccagcatgagcatccccatcgccggcgagagcgagagcctgcaggaggacagaaagggcggcgagaccctgaaggtgcacctgggcatcgccgacctgagcgccaagagcgccagcgtgcccgacgagctgggcgcctgcggccacagcagaaccagcagctacgccagccagcagagcaaggtgagcggctacagcacctgccacagcagaagcagcagcttcagcgagctgtgccacagaagaaacaccagcgtgggcagcaccagcaccggcgtggagagcatcctggagccctgcgacgagatcgagcagaagatcgccgagcccaacctggacaccgccgacaaggaggacaccgccagcgagaagctgagcagatgccccgtgaagcaggacagcgtggagagccagctgaagagagtggacgacaccagagtggacgccgacgacatcgtggagaagatcctgcagagccaggacttcagcctggacagcagcgccgaggaggagggcctgagactgttcgtgggccccggcggcagcaccaccttcggcagccaccacctgcccaacagcttcctgaacagcggcagcctgatctag

SEQ ID NO: 20775 - DNA, 357 bp, Artificial Sequence
  Description of Artificial Sequence: Synthetic coding sequence
atgaccgacaccgccgaggccgtgcccaagttcgaggagatgttcgccagcagattcaccgagaacgacaaggagtaccaggagtacctgaagagaccccccgagagcccccccatcgtggaggagtggaacagcagagccggcggcaaccagagaaacagaggcaacagactgcaggacaacagacagttcagaggcagagacaacagatggggctggcccagcgacaacagaagcaaccagtggcacggcagaagctggggcaacaactacccccagcacagacaggagccctactacccccagcagtacggccactacggctacaaccagagacccccctacggctactactag

SEQ ID NO: 20776 - DNA, 141 bp, Artificial Sequence
  Description of Artificial Sequence: Synthetic coding sequence
atgggcggctgccccgtgagaaagagaagaagaaacggcagcaaggagggcaaccaccacagcacccagcccaagagaaacaagagaaaccccatcttccaggacagccaggacaccgaggtggccatcttcatggagtag

SEQ ID NO: 20777 - DNA, 339 bp, Artificial Sequence
  Description of Artificial Sequence: Synthetic coding sequence
atgacctgcagaaagagaagaagaaacggcagcaaggagggcaaccaccacagcacccagcccaagagaaacaagagaaaccccatcttccaggacagccaggacaccgagttcagctggagcgacaacgagagaagcagcagcagaatcaacatccccgagagagccagcggccccgagggcaacctgaaccagatcgtgaccgagcccgacgccaacttcccccagttcctgcacgagggctacgtgccctgccagggcctgtacagccacatcaaccagaccctgaaggaggcccacttcaacagcctgcagcagagaggccaggcccccacctag

SEQ ID NO: 20778 - DNA, 345 bp, Artificial Sequence
  Description of Artificial Sequence: Synthetic coding sequence
atgctggtgctgtggctgaagagaagaagaaacggcagcaaggagggcaaccaccacagcacccagcccaagagaaacaagagaaaccccatcttccaggacagccaggacaccgagttcagctggagcgacaacgagagaagcagcagcagaatcaacatccccgagagagccagcggccccgagggcaacctgaaccagatcgtgaccgagcccgacgccaacttcccccagttcctgcacgagggctacgtgccctgccagggcctgtacagccacatcaaccagaccctgaaggaggcccacttcaacagcctgcagcagagaggccaggcccccacctag

SEQ ID NO: 20779 - DNA, 561 bp, Artificial Sequence
  Description of Artificial Sequence: Synthetic coding sequence
atgggcggcagaggcgccgacgccggcagcagcggcggcaccggccccaccgagggctacagcccccccgccgccagcaccagagccgccgccagagccaaggccagaggcggcggcagaggcggcagaagaaacaccacccccagcgtgcccagcctgagaggcgccgcccccagaagcttccacccccccgccgccatgagcgagagactgagacccagaaagagaagaagaaacggcaacgaggaggacaaccacctgcccccccagaccaagagaagcagcagaaaccccgtgttccaggacagctgggacaccgagagcagcggcagcgacagcggcggcagcagcagcagcagcagcagcagcatcaacagccccgacagagccagcggccccgagggcagcctgagccagaccatggccggcagcagccccaacaccccccagcccgtgcccgagcagagcgccctgtgccagggcctgtacttccacatcaaccagaccctgagagaggcccacttccacagcctgcagcacagaggcagacccctgacctag

SEQ ID NO: 20780 - DNA, 624 bp, Artificial Sequence
  Description of Artificial Sequence: Synthetic coding sequence
atgggcggcagaggcgccgacgccggcagcagcggcggcaccggccccaccgagggctacagcccccccgccgccagcaccagagccgccgccagagccaaggccagaggcggcggcagaggcggcagaagaaacaccacccccagcgtgcccagcctgagaggcgccgcccccagaagcttccacccccccgccgccatgagcgagagactgagacccagaaagagaagaagaaacggcaacgaggaggacaaccacctgcccccccagaccaagagaagcagcagaaaccccgtgttccaggacagctgggacaccgagaccgtgcccgtgatgagaaacagcaaggagaacagactgagaggcaacaaggccttctgcgccagcagcggcagcgacagcggcggcagcagcagcagcagcagcagcagcatcaacagccccgacagagccagcggccccgagggcagcctgagccagaccatggccggcagcagccccaacaccccccagcccgtgcccgagcagagcgccctgtgccagggcctgtacttccacatcaaccagaccctgagagaggcccacttccacagcctgcagcacagaggcagacccctgacctag

SEQ ID NO: 20781 - DNA, 351 bp, Artificial Sequence
  Description of Artificial Sequence: Synthetic coding sequence
atgggcggctgccccgtgagaaagagaagaagaaacggcagcaaggagggcaaccaccacagcacccagcccaagagaaacaagagaaaccccatcttccaggacagccaggacaccgaggtgttcagctggagcgacaacgagagaagcagcagcagaatcaacatccccgagagagccagcggccccgagggcaacctgaaccagatcgtgaccgagcccgacgccaacttcccccagttcctgcacgagggcctgagcaagcccgtgtacgtgatcaactggttcatgagcttcggccccgagatcaagctgaacaccagccagcagggcagaaaccaggccgtgtag

SEQ ID NO: 20782 - DNA, 348 bp, Artificial Sequence
  Description of Artificial Sequence: Synthetic coding sequence
atgggcggctgccccgtgagaaagagaagaagaaacggcagcaaggagggcaaccaccacagcacccagcccaagagaaacaagagaaaccccatcttccaggacagccaggacaccgagttcagctggagcgacaacgagagaagcagcagcagaatcaacatccccgagagagccagcggccccgagggcaacctgaaccagatcgtgaccgagcccgacgccaacttcccccagttcctgcacgagggcctgagcaagcccgtgtacgtgatcaactggttcatgagcttcggccccgagatcaagctgaacaccagccagcagggcagaaaccaggccgtgtag

SEQ ID NO: 20783 - DNA, 351 bp, Artificial Sequence
  Description of Artificial Sequence: Synthetic coding sequence
atgggcggctgccccgtgagaaagagaagaagaaacggcagcaaggagggcaaccaccacagcacccagcccaagagaaacaagagaaaccccatcttccaggacagccaggacaccgaggtgttcagctggagcgacaacgagagaagcagcagcagaatcaacatccccgagagagccagcggccccgagggcaacctgaaccagatcgtgaccgagcccgacgccaacttcccccagttcctgcacgagggctacgtgccctgccagggcctgtacagccacatcaaccagaccctgaaggaggcccacttcaacagcctgcagcagagaggccaggcccccacctag

SEQ ID NO: 20784 - DNA, 1071 bp, Artificial Sequence
  Description of Artificial Sequence: Synthetic coding sequence
atggccgccaccagaagccccaccagagccagagagagagagagaagcggcgcccccgccgccggcagcgaccaggtgcacagctggatgctggccaccagccaggccctggacaccgtgtggagaatggccaagggcttcgtgatgctggccgtgagcttcctggtggccgccatctgctacttcagaagactgcacctgtacagcggccacaagctgaagtggtggatcggctacctgcagagaaagttcaagagaaacctgagcgtggaggccgaggtggacctgctgagctactgcgccagagagtggaagggcgagacccccagaaacaagctgatgagaaaggcctacgaggagctgttctggagacaccacatcaagtgcgtgagacaggtgagaagagacaactacgacgccctgagaagcgtgctgttccagatcttcagccagggcatcagcttccccagctggatgaaggagaaggacatcgtgaagctgcccgagaagctgctgttcagccagggctgcaactggatccagcagtacagcttcggccccgagaagtacaccggcagcaacgtgttcggcaagctgagaaagtacgtggagctgctgaagacccagtggaccgagttcaacggcatcagagactaccacaagagaggcagcatgtgcaacaccctgttcagcgacgccatcctggagtacaagctgtacgaggccctgaagttcatcatgctgtaccaggtgaccgaggtgtacgagcagatgaagaccaagaaggtgatccccagcctgttcagactgctgttcagcagagagaccagcagcgaccccctgagcttcatgatgaaccacctgaacagcgtgggcgacacctgcggcctggagcagatcgacatgttcatcctgggctacagcctggaggtgaagatcaaggtgttcagactgttcaagttcaacagcagagacttcgaggtgtgctaccccgaggagcccctgagagactggcccgagatcagcctgctgaccgagaacgacagacactaccacatccccgtgttctag

SEQ ID NO: 20785 - DNA, 1059 bp, Artificial Sequence
  Description of Artificial Sequence: Synthetic coding sequence
atgagcagaggcaccatgccccagcccgaggcctggcccggcgccagctgcgccgagacccccgccagagaggccgccgccaccgccagagacggcggcaaggccgccgccagcggccagcccagacccgagatgcagtgccccgccgagcacgaggaggacatgtacagagccgccgacgagatcgagaaggagaaggagctgctgatccacgagagaggcgccagcgagcccagactgagcgtggcccccgagatggacatcatggactactgcaagaaggagtggagaggcaacacccagaaggccacctgcatgaagatgggctacgaggaggtgagccagaagttcaccagcatcagaagagtgagaggcgacaactactgcgccctgagagccaccctgttccaggccatgagccaggccgtgggcctgcccccctggctgcaggaccccgagctgatgctgctgcccgagaagctgatcagcaagtacaactggatcaagcagtggaagctgggcctgaagttcgacggcaagaacgaggacctggtggacaagatcaaggagagcctgaccctgctgagaaagaagtgggccggcctggccgagatgagaaccgccgaggccagacagatcgcctgcgacgagctgttcaccaacgaggccgaggagtacagcctgtacgaggccgtgaagttcctgatgctgaacagagccatcgagctgtacaacgacaaggagaagggcaaggaggtgcccttcttcagcgtgctgctgttcgccagagacaccagcaacgaccccggccagctgctgagaaaccacctgaaccaggtgggccacaccggcggcctggagcaggtggagatgttcctgctggcctacgccgtgagacacaccatccaggtgtacagactgagcaagtacaacaccgaggagttcatcaccgtgtaccccaccgacccccccaaggactggcccgtggtgaccctgatcgccgaggacgacagacactacaacatccccgtgagagtgtgcgaggagaccagcctgtag

SEQ ID NO: 20786 - DNA, 510 bp, Artificial Sequence
  Description of Artificial Sequence: Synthetic coding sequence
atgctgcccagcaccatgttcctggtgcacctgcccctgagcaccaacagactgcactgcctgagaaacaccagcctggagagctacctgtgcagcttcgtgcacctgaaccaccccctgcacatcagcgacagagtgatcctgatcagcctgcacgaggccgtgagattcagcttcgccttcagcttccccagaggcaccctgagcatcgcctactgcctgatgagcagcgtgagcaccagcagcgaggccatcatgagcaccgagctgctggccaactactgccacagcagcctgcacgtgtgcatctgcatcagcagcttccccaacgagaccggcaaccacgacagcttccccggcgccgtggtgagcatcagcgaccagcccaccgaccagtgcaagctggccgccaaggagctgcccctgagaaacctgctggagtgcagattcttcgactgcatgggcgaggaggacctgatcaacctgggcgtgatcggcaccgagagatag

SEQ ID NO: 20787 - DNA, 510 bp, Artificial Sequence
  Description of Artificial Sequence: Synthetic coding sequence
atgctgcccagcaccatgttcctggtgcacctgcccctgagcaccaacagactgcactgcctgagaaacaccagcctggagccctgcctgtgcagcttcgtgcacctgaaccaccccctgcacatcagcgaccccgtgatcctgatcagcctgcacgaggccgtgagattcagcttcgccttcagcttccccagaggcaccctgagcatcgcctactgcctgatgagcagcgtgagcaccagcagcgaggccatcatgagcaccgagctgctggccaactactgccacagcagcctgcacgtgtgcatctgcatcagcagcttccccaacgagaccggcaaccacgacagcttccccggcgccgtggtgagcatcagcgaccagcccaccgaccagtgcaagctggccgccaaggagctgcccctgagaaacctgctggagtgcagattcttcgactgcatgggcgaggaggacctgatcaacctgggcgtgatcggcaccgagagatag

SEQ ID NO: 20788 - DNA, 921 bp, Artificial Sequence
  Description of Artificial Sequence: Synthetic coding sequence
atgagcacctggaaggccagactgaccaagagactgaagagccccagcagaagcatgcaccccttcccctgcagcgccctgctggcctgcttcggcaacaccagagagagcgccagcttcaaccagagcggcgtggccgacacccacagcaccgtgagagtgcagcccgtggccaaggccggcagacagcccagacaccccagcgccgagggcgcccccgagaagagacaggacagcagcacccacgccgagagaaacggcagcgccaacagaaacagcagccacagaaccgccgcccagcccgccgagacccccgaggacgtgcccggcagcctggacgacggcgccgactgcgaggccgtggtgttccacgccagcatccccagacccagcatcatcgacacccccaaggaggaggagttcagagaggagcccaagtgcctggagctggagcagaagatgaccagcgacagcccccccgaggacatcgaccacaaggacagctacctgatcaccagaagcatcatggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagctggagcagctggagctggagaagcagaagctgcaggaggagcaggagaacgcccccgagttcgtgaaggtgaagggcaacctgagaagaaccggccaggaggtggcccaggcccaggagagctag

SEQ ID NO: 20789 - DNA, 396 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagctggagcagctggagctggagaagcagaagctgcaggaggagcaggagaacgcccccgagttcgtgaaggtgaagggcaacctgagaagaaccggccaggaggtggcccaggcccaggagagctag

SEQ ID NO: 20790 - DNA, 396 bp, Artificial Sequence; identical to SEQ ID NO: 20789
  Description of Artificial Sequence: Synthetic coding sequence

SEQ ID NO: 20791 - DNA, 396 bp, Artificial Sequence; identical to SEQ ID NO: 20789
  Description of Artificial Sequence: Synthetic coding sequence

SEQ ID NO: 20792 - DNA, 396 bp, Artificial Sequence; identical to SEQ ID NO: 20789
  Description of Artificial Sequence: Synthetic coding sequence

SEQ ID NO: 20793 - DNA, 396 bp, Artificial Sequence; identical to SEQ ID NO: 20789
  Description of Artificial Sequence: Synthetic coding sequence

SEQ ID NO: 20794 - DNA, 396 bp, Artificial Sequence; identical to SEQ ID NO: 20789
  Description of Artificial Sequence: Synthetic coding sequence

SEQ ID NO: 20795 - DNA, 273 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagtag

SEQ ID NO: 20796 - DNA, 387 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagctggagcagctggagctggagaagcagaagctgcaggaggagcaggagaacgcccccgagttcgtgaaggtgaagggcaacctgagaagaaccggccaggaggtggcccaggcctag

SEQ ID NO: 20797 - DNA, 396 bp, Artificial Sequence; identical to SEQ ID NO: 20789
  Description of Artificial Sequence: Synthetic coding sequence

SEQ ID NO: 20798 - DNA, 396 bp, Artificial Sequence; identical to SEQ ID NO: 20789
  Description of Artificial Sequence: Synthetic coding sequence

SEQ ID NO: 20799 - DNA, 204 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagtag

SEQ ID NO: 20800 - DNA, 306 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagctggagcagctggagctggagaagcagaagctgtag

SEQ ID NO: 20801 - DNA, 396 bp, Artificial Sequence; identical to SEQ ID NO: 20789
  Description of Artificial Sequence: Synthetic coding sequence

SEQ ID NO: 20802 - DNA, 396 bp, Artificial Sequence; identical to SEQ ID NO: 20789
  Description of Artificial Sequence: Synthetic coding sequence

SEQ ID NO: 20803 - DNA, 255 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgtag

SEQ ID NO: 20804 - DNA, 282 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagctggagcagtag

SEQ ID NO: 20805 - DNA, 381 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagctggagcagctggagctggagaagcagaagctgcaggaggagcaggagaacgcccccgagttcgtgaaggtgaagggcaacctgagaagaaccggccaggaggtggcctag

SEQ ID NO: 20806 - DNA, 378 bp, Artificial Sequence
  Description of Artificial Sequence: Synthetic coding sequence
atggccgagcccgactacatcgaggacgacaaccccgagctgatcagaccccagaagctgatcaaccccgtgaagaccagcagaaaccaccaggacctgcacagagagctgctgatgaaccagaagagaggcctggccccccagaacaagcccgagctgcagaaggtgatggagaagagaaagagagaccaggtgatcaagcagaaggaggaggaggcccagaagaagaagagcgacctggagatcgagctgctgaagagacagcagaagctggagcagctggagctggagaagcagaagctgcaggaggagcaggagaacgcccccgagttcgtgaaggtgaagggcaacctgagaagaaccggccaggaggtgtag

SEQ ID NO: 20807 - DNA, 396 bp, Artificial Sequence; identical to SEQ ID NO: 20789
  Description of Artificial Sequence: Synthetic coding sequence

SEQ ID NO: 20808 - DNA, 990 bp, Artificial Sequence
  Description of Artificial Sequence: Synthetic coding sequence
atgcccgagcccggccccagaatgaacggcttcagcctgggcgagctgtgctggctgttctgctgccccccctgccccagcagaatcgccgccaagctggccttcctgccccccgagcccacctacaccgtgctggcccccgagcagagaggcgccggcgccagcgcccccgcccccgcccaggccaccgccgccgccgccgccgcccagcccgccccccagcagcccgaggagggcgccggcgccggccccggcgcctgcagcctgcacctgagcgagagagccgactggcagtacagccagagagagctggacgccgtggaggtgttcttcagcagaaccgccagagacaacagactgggctgcatgttcgtgagatgcgcccccagcagcagatacaccctgctgttcagccacggcaacgccgtggacctgggccagatgtgcagcttctacatcggcctgggcagcagaatcaactgcaacatcttcagctacgactacagcggctacggcgtgagcagcggcaagcccagcgagaagaacctgtacgccgacatcgacgccgcctggcaggccctgagaaccagatacggcgtgagccccgagaacatcatcctgtacggccagagcatcggcaccgtgcccaccgtggacctggccagcagatacgagtgcgccgccgtgatcctgcacagccccctgatgagcggcctgagagtggccttccccgacaccagaaagacctactgcttcgacgccttccccagcatcgacaagatcagcaaggtgaccagccccgtgctggtgatccacggcaccgaggacgaggtgatcgacttcagccacggcctggccatgtacgagagatgccccagagccgtggagcccctgtgggtggagggcgccggccacaacgacatcgagctgtacgcccagtacctggagagactgaagcagttcatcagccacgagctgcccaacagctag

SEQ ID NO: 20809 - DNA, 888 bp, Artificial Sequence
  Description of Artificial Sequence: Synthetic coding sequence
atgcccgagcccggccccagaatgaacggcttcagcctgggcgagctgtgctggctgttctgctgccccccctgccccagcagaatcgccgccaagctggccttcctgccccccgagcccacctacaccgtgctggcccccgagcagagaggcgccggcgccagcgcccccgcccccgcccaggccaccgccgccgccgccgccgcccagcccgccccccagcagcccgaggagggcgccggcgccggccccggcgcctgcagcctgcacctgagcgagagagccgactggcagtacagccagagagagctggacgccgtggaggtgttcttcagcagaaccgccagagacaacagactgggctgcatgttcgtgagatgcgcccccagcagcagatacaccctgctgttcagccacggcaacgccgtggacctgggccagatgtgcagcttctacatcggcctgggcagcagaatcaactgcaacatcttcagctacgactacagcggctacggcgtgagcagcggcaagcccagcgagaagaacctgtacgccgacatcgacgccgcctggcaggccctgagaaccagatacggcgtgagccccgagaacatcatcctgtacggccagagcatcggcaccgtgcccaccgtggacctggccagcagcatcgacaagatcagcaaggtgaccagccccgtgctggtgatccacggcaccgaggacgaggtgatcgacttcagccacggcctggccatgtacgagagatgccccagagccgtggagcccctgtgggtggagggcgccggccacaacgacatcgagctgtacgcccagtacctggagagactgaagcagttcatcagccacgagctgcccaacagctag

SEQ ID NO: 20810 - DNA, 816 bp, Artificial Sequence
  Description of Artificial Sequence: Synthetic coding sequence
atgctgctggccccccccagcacccccagcagaggcagaacccccagcgccgtggagagactggaggccgacaaggccaagtacgtgaagacccaccaggtgatcgccagaagacaggagcccgccctgagaggcagccccggccccctgaccccccacccctgcaacgagctgggcccccccgccagccccagaacccccagacccgtgagaagaggcagcggcagaagactgcccagacccgacagcctgatcttctacagacagaagagagactgcaaggccagcgtgaacaaggagaacgccaagggccagggcctggtgagaagactgttcctgggcgcccccagagacgccgcccccagcagccccgccagcaccgagagacccgccgccagcggcggctgggccgccccccaggacgcccccgaggccgccggcaagagagccctgtgccccacctgcagcctgcccctgagcgagaaggagagattcttcaactactgcggcctggagagagccctggtggaggtgctgggcgccgagagattcagcccccagagctggggcgccgacgccagcccccaggccggcaccagccccccccccggcagcggcgacgccagcgactggaccagcagcgacagaggcgtggacagccccggcggcgccggcggcggcggcggcagcgaggccgccggcagcgccagagacagaagaccccccgtgagcgtggtggagagaaacgccagagtgatccagtggctgtacggctgccagagagccagaggcccccccagagagagcgaggtgtag

SEQ ID NO: 20811 - DNA, 1836 bp, Artificial Sequence
  Description of Artificial Sequence: Synthetic coding sequence
atgagctgcaagaagcagagaagcagaaagcacagcgtgaacgagaagtgcaacatgaagatcgagcactacttcagccccgtgagcaaggagcagcagaacaactgcagcaccagcctgatgagaatggagagcagaggcgaccccagagccaccaccaacacccaggcccagagattccacagccccaagaagaaccccgaggaccagaccatgccccagaacagaaccatctacgtgaccctgaaggtgaaccacagaagaaaccaggacatgaagctgaagctgacccacagcgagaacagcagcctgtacatggccctgaacaccctgcaggccgtgagaaaggagatcgagacccaccagggccaggagatgctggtgagaggcaccgagggcatcaaggagtacatcaacctgggcatgcccctgagctgcttccccgagggcggccaggtggtgatcaccttcagccagagcaagagcaagcagaaggaggacaaccacatcttcggcagacaggacaaggccagcaccgagtgcgtgaagttctacatccacgccatcggcatcggcaagtgcaagagaagaatcgtgaagtgcggcaagctgcacaagaagggcagaaagctgtgcgtgtacgccttcaagggcgagaccatcaaggacgccctgtgcaaggacggcagattcctgagcttcctggagaacgacgactggaagctgatcgagaacaacgacaccatcctggagagcacccagcccgtggacgagctggagggcagatacttccaggtggaggtggagaagagaatggtgcccagcgccgccgccagccagaaccccgagagcgagaagagaaacacctgcgtgctgagagagcagatcgtggcccagtaccccagcctgaagagagagagcgagaagatcatcgagaacttcaagaagaagatgaaggtgaagaacggcgagaccctgttcgagctgcacagaaccaccttcggcaaggtgaccaagaacagcagcagcatcaaggtggtgaagctgctggtgagactgagcgacagcgtgggctacctgttctgggacagcgccaccaccggctacgccacctgcttcgtgttcaagggcctgttcatcctgacctgcagacacgtgatcgacagcatcgtgggcgacggcatcgagcccagcaagtgggccaccatcatcggccagtgcgtgagagtgaccttcggctacgaggagctgaaggacaaggagaccaactacttcttcgtggagccctggttcgagatccacaacgaggagctggactacgccgtgctgaagctgaaggagaacggccagcaggtgcccatggagctgtacaacggcatcacccccgtgcccctgagcggcctgatccacatcatcggccacccctacggcgagaagaagcagatcgacgcctgcgccgtgatcccccagggccagagagccaagaagtgccaggagagagtgcagagcaagaaggccgagagccccgagtacgtgcacatgtacacccagagaagcttccagaagatcgtgcacaaccccgacgtgatcacctacgacaccgagttcttcttcggcgccagcggcagccccgtgttcgacagcaagggcagcctggtggccatgcacgccgccggcttcgcctacacctaccagaacgagaccagaagcatcatcgagttcggcagcaccatggagagcatcctgctggacatcaagcagagacacaagccctggtacgaggaggtgttcgtgaaccagcaggacgtggagatgatgagcgacgaggacctgtag

SEQ ID NO: 20812 - DNA, 1836 bp, Artificial Sequence; identical to SEQ ID NO: 20811
  Description of Artificial Sequence: Synthetic coding sequence

SEQ ID NO: 20813 - DNA, 552 bp, Artificial Sequence
  Description of Artificial Sequence: Synthetic coding sequence
atgagctgcaagaagcagagaagcagaaagcacagcgtgaacgagaagtgcaacatgaagatcgagcactacttcagccccgtgagcaaggagcagcagaacaactgcagcaccagcctgatgagaatggagagcagaggcgaccccagagccaccaccaacacccaggcccagagattccacagccccaagaagaaccccgaggaccagaccatgccccagaacagaaccatctacgtgaccctgaaggtgaaccacagaagaaaccaggacatgaagctgaagctgacccacagcgagaacagcagcctgtacatggccctgaacaccctgcaggccgtgagaaaggagatcgagacccaccagggccaggagatgctggtgagaggcaccgagggcatcaaggagtacatcaacctgggcatgcccctgagctgcttccccgagggcggccaggtggtgatcaccttcagccagagcaagagcaagcagaaggaggacaaccacatcttcggcagacaggacaaggccagcaccgagtgcgtgaagtag

SEQ ID NO: 20814 - DNA, 1836 bp, Artificial Sequence; identical to SEQ ID NO: 20811
  Description of Artificial Sequence: Synthetic coding sequence

SEQ ID NO: 20815 - DNA, 1836 bp, Artificial Sequence; identical to SEQ ID NO: 20811
  Description of Artificial Sequence: Synthetic coding sequence

SEQ ID NO: 20816 - DNA, 291 bp, Artificial Sequence
  Description of Artificial Sequence: Synthetic coding sequence
atgagctgcaagaagcagagaagcagaaagcacagcgtgaacgagaagtgcaacatgaagatcgagcactacttcagccccgtgagcaaggagcagcagaacaactgcagcaccagcctgatgagaatggagagcagaggcgaccccagagccaccaccaacacccaggcccagagattccacagccccaagaagaaccccgaggaccagaccatgccccagaacagaaccatctacgtgaccctgaaggtgaaccacagaagaaaccaggacatgaagctgaagctgtag

SEQ ID NO: 20817 - DNA, 1836 bp, Artificial Sequence; identical to SEQ ID NO: 20811
  Description of Artificial Sequence: Synthetic coding sequence

SEQ ID NO: 20818 - DNA, 2205 bp, Artificial Sequence
  Description of Artificial Sequence: Synthetic coding sequence
atgaacagcatgaagaccgaggagaacaagagcttcagcgccatggaggacgaccagagaaccagacccgaggtgagcaaggacaccgtgatgaagcagacccacgccgacacccccgtggaccactgcctgagcggcatcagaaagtgcagcagcaccttcaagctgaagagcgaggtgaacaagcacgagaccgccctggagatgcagaaccccaacctgaacaacaaggagtgctgcttcaccttcaccctgaacggcaacagcagaaagctggacagaagcgtgttcaccgcctacggcaagcccagcgagagcatctacagcgccctgagcgccaacgactacttcagcgagagaatcaagaaccagttcaacaagaacatcatcgtgtacgaggagaagaccatcgacggccacatcaacctgggcatgcccctgaagtgcctgcccagcgacagccacttcaagatcaccttcggccagagaaagagcagcaaggaggacggccacatcctgagacagtgcgagaaccccaacatggagtgcatcctgttccacgtggtggccatcggcagaaccagaaagaagatcgtgaagatcaacgagctgcacgagaagggcagcaagctgtgcatctacgccctgaagggcgagaccatcgagggcgccctgtgcaaggacggcagattcagaagcgacatcggcgagttcgagtggaagctgaaggagggccacaagaagatctacggcaagcagagcatggtggacgaggtgagcggcaaggtgctggagatggacatcagcaagaagaaggccctgcagcagaaggacatccacaagaagatcaagcagaacgagagcgccaccgacgagatcaaccaccagagcctgatccagagcaagaagaaggtgcacaagcccaagaaggacggcgagaccaaggacgtggagcacagcagagagcagatcctgcccccccaggacctgagccactacatcaaggacaagaccagacagaccatccccagaatcagaaactactacttctgcagcctgcccagaaagtacagacagatcaacagccaggtgagaagaagaccccacctgggcagaagatacgccatcaacctggacgtgcagaaggaggccatcaacctgctgaagaactaccagaccctgaacgaggccatcatgcaccagtaccccaacttcaaggaggaggcccagtgggtgagaaagtacttcagagaggagcagaagagaatgaacctgagccccgccaagcagttcaacatctacaagaaggacttcggcaagatgaccgccaacagcgtgagcgtggccacctgcgagcagctgacctactacagcaagagcgtgggcttcatgcagtgggacaacaacggcaacaccggcaacgccacctgcttcgtgttcaacggcggctacatcttcacctgcagacacgtggtgcacctgatggtgggcaagaacacccaccccagcctgtggcccgacatcatcagcaagtgcgccaaggtgaccttcacctacaccgagttctgccccacccccgacaactggttcagcatcgagccctggctgaaggtgagcaacgagaacctggactacgccatcctgaagctgaaggagaacggcaacgccttcccccccggcctgtggagacagatcagcccccagcccagcaccggcctgatctacctgatcggccaccccgagggccagatcaagaagatcgacggctgcaccgtgatccccctgaacgagagactgaagaagtaccccaacgactgccaggacggcctggtggacctgtacgacaccaccagcaacgtgtactgcatgttcacccagagaagcttcctgagcgaggtgtggaacacccacaccctgagctacgacacctgcttcagcgacggcagcagcggcagccccgtgttcaacgccagcggcaagctggtggccctgcacaccttcggcctgttctaccagagaggcttcaacgtgcacgccctgatcgagttcggctacagcatggacagcatcctgtgcgacatcaagaagaccaacgagagcctgtacaagagcctgaacgacgagaagctggagacctacgacgaggagaagggcaagcaggagagcagcctgcaggaccaccagatcgagcccatggagtgctag

SEQ ID NO: 20819 - DNA, 2115 bp, Artificial Sequence
  Description of Artificial Sequence: Synthetic coding sequence
atgaagcagacccacgccgacacccccgtggaccactgcctgagcggcatcagaaagtgcagcagcaccttcaagctgaagagcgaggtgaacaagcacgagaccgccctggagatgcagaaccccaacctgaacaacaaggagtgctgcttcaccttcaccctgaacggcaacagcagaaagctggacagaagcgtgttcaccgcctacggcaagcccagcgagagcatctacagcgccctgagcgccaacgactacttcagcgagagaatcaagaaccagttcaacaagaacatcatcgtgtacgaggagaagaccatcgacggccacatcaacctgggcatgcccctgaagtgcctgcccagcgacagccacttcaagatcaccttcggccagagaaagagcagcaaggaggacggccacatcctgagacagtgcgagaaccccaacatggagtgcatcctgttccacgtggtggccatcggcagaaccagaaagaagatcgtgaagatcaacgagctgcacgagaagggcagcaagctgtgcatctacgccctgaagggcgagaccatcgagggcgccctgtgcaaggacggcagattcagaagcgacatcggcgagttcgagtggaagctgaaggagggccacaagaagatctacggcaagcagagcatggtggacgaggtgagcggcaaggtgctggagatggacatcagcaagaagaaggccctgcagcagaaggacatccacaagaagatcaagcagaacgagagcgccaccgacgagatcaaccaccagagcctgatccagagcaagaagaaggtgcacaagcccaagaaggacggcgagaccaaggacgtggagcacagcagagagcagatcctgcccccccaggacctgagccactacatcaaggacaagaccagacagaccatccccagaatcagaaactactacttctgcagcctgcccagaaagtacagacagatcaacagccaggtgagaagaagaccccacctgggcagaagatacgccatcaacctggacgtgcagaaggaggccatcaacctgctgaagaactaccagaccctgaacgaggccatcatgcaccagtaccccaacttcaaggaggaggcccagtgggtgagaaagtacttcagagaggagcagaagagaatgaacctgagccccgccaagcagttcaacatctacaagaaggacttcggcaagatgaccgccaacagcgtgagcgtggccacctgcgagcagctgacctactacagcaagagcgtgggcttcatgcagtgggacaacaacggcaacaccggcaacgccacctgcttcgtgttcaacggcggctacatcttcacctgcagacacgtggtgcacctgatggtgggcaagaacacccaccccagcctgtggcccgacatcatcagcaagtgcgccaaggtgaccttcacctacaccgagttctgccccacccccgacaactggttcagcatcgagccctggctgaaggtgagcaacgagaacctggactacgccatcctgaagctgaaggagaacggcaacgccttcccccccggcctgtggagacagatcagcccccagcccagcaccggcctgatctacctgatcggccaccccgagggccagatcaagaagatcgacggctgcaccgtgatccccctgaacgagagactgaagaagtaccccaacgactgccaggacggcctggtggacctgtacgacaccaccagcaacgtgtactgcatgttcacccagagaagcttcctgagcgaggtgtggaacacccacaccctgagctacgacacctgcttcagcgacggcagcagcggcagccccgtgttcaacgccagcggcaagctggtggccctgcacaccttcggcctgttctaccagagaggcttcaacgtgcacgccctgatcgagttcggctacagcatggacagcatcctgtgcgacatcaagaagaccaacgagagcctgtacaagagcctgaacgacgagaagctggagacctacgacgaggagaagggcaagcaggagagcagcctgcaggaccaccagatcgagcccatggagtgctag

SEQ ID NO: 20820 - DNA, 2115 bp, Artificial Sequence; identical to SEQ ID NO: 20819
  Description of Artificial Sequence: Synthetic coding sequence

SEQ ID NO: 20821 - DNA, 489 bp, Artificial Sequence
  Description of Artificial Sequence: Synthetic coding sequence
atgaagcagacccacgccgacacccccgtggaccactgcctgagcggcatcagaaagtgcagcagcaccttcaagctgaagagcgaggtgaacaagcacgagaccgccctggagatgcagaaccccaacctgaacaacaaggagtgctgcttcaccttcaccctgaacggcaacagcagaaagctggacagaagcgtgttcaccgcctacggcaagcccagcgagagcatctacagcgccctgagcgccaacgactacttcagcgagagaatcaagaaccagttcaacaagaacatcatcgtgtacgaggagaagaccatcgacggccacatcaacctgggcatgcccctgaagtgcctgcccagcgacagccacttcaagatcaccttcggccagagaaagagcagcaaggaggacggccacatcctgagacagtgcgagaaccccaacatggagtgcatcctgttccacgtggtggccatcggctag

SEQ ID NO: 20822 - DNA, 1212 bp, Artificial Sequence
  Description of Artificial Sequence: Synthetic coding sequence
atggtgttctgcctgagcagcgaggagcccagaagacccctgagaagcgacatggtgcacttccaggccagcgaggtgcagcagctgctgcacaacaagttcgtggtgatcctgggcgacagcatccagagagccgtgtacaaggacctggtgctgctgctgcagaaggacagcctgctgaccgccgcccagctgaaggccaagtacctggaggacgtgctggaggagctgacctacggccccgcccccgacctggtgatcatcaacagctgcctgtgggacctgagcagatacggcagatgcagcatggagagctacagagagaacctggagagagtgttcgtgagaatggaccaggtgctgcccgacagctgcctgctggtgtggaacatggccatgcccctgggcgagagaatcaccggcggcttcctgctgcccgagctgcagcccctggccggcagcctgagaagagacgtggtggagggcaacttctacagcgccaccctggccggcgaccactgcttcgacgtgctggacctgcacttccacttcagacacgccgtgcagcacagacacagagacggcgtgcactgggaccagcacgcccacagacacctgagccacctgctgctgacccacgtggccgacgcctggggcgtggagctgcccaagagaggctacccccccgacccctggatcgaggactgggccgagatgaaccaccccttccagggcagccacagacagacccccgacttcggcgagcacctggccctgctgccccccccccccagcagcctgcccccccccatgcccttcccctaccccctgccccagcccagccccccccccctgttcccccccctgccccaggacacccccttcttccccggccagcccttccccccccacgagttcttcaactacaaccccgtggaggacttcagcatgcccccccacctgggctgcggccccggcgtgaacttcgtgcccggccccctgcccccccccatccccggccccaacccccacggccagcactggggccccgtggtgcacagaggcatgcccagatacgtgcccaacagcccctaccacgtgagaagaatgggcggcccctgcagacagagactgagacacagcgagagactgatccacacctacaagctggacagaagaccccccgcccacagcggcacctggcccggctag

SEQ ID NO: 20823 - DNA, 1365 bp, Artificial Sequence
  Description of Artificial Sequence: Synthetic coding sequence
atggtgttctgcctgagcagcgaggagcccagaagacccctgagaagcgacatggtgcacttccaggccagcgaggtgcagcagctgctgcacaacaagttcgtggtgatcctgggcgacagcatccagagagccgtgtacaaggacctggtgctgctgctgcagaaggacagcctgctgaccgccgcccagctgaaggccaagggcgagctgagcttcgagcaggaccagctggtggccggcggccagctgggcgagctgcacaacggcacccagtacagagaggtgagacagttctgcagcggcagcggccaccacctggtgagattctacttcctgaccagagtgtacagcgagtacctggaggacgtgctggaggagctgacctacggccccgcccccgacctggtgatcatcaacagctgcctgtgggacctgagcagatacggcagatgcagcatggagagctacagagagaacctggagagagtgttcgtgagaatggaccaggtgctgcccgacagctgcctgctggtgtggaacatggccatgcccctgggcgagagaatcaccggcggcttcctgctgcccgagctgcagcccctggccggcagcctgagaagagacgtggtggagggcaacttctacagcgccaccctggccggcgaccactgcttcgacgtgctggacctgcacttccacttcagacacgccgtgcagcacagacacagagacggcgtgcactgggaccagcacgcccacagacacctgagccacctgctgctgacccacgtggccgacgcctggggcgtggagctgcccaagagaggctacccccccgacccctggatcgaggactgggccgagatgaaccaccccttccagggcagccacagacagacccccgacttcggcgagcacctggccctgctgccccccccccccagcagcctgcccccccccatgcccttcccctaccccctgccccagcccagccccccccccctgttcccccccctgccccaggacacccccttcttccccggccagcccttccccccccacgagttcttcaactacaaccccgtggaggacttcagcatgcccccccacctgggctgcggccccggcgtgaacttcgtgcccggccccctgcccccccccatccccggccccaacccccacggccagcactggggccccgtggtgcacagaggcatgcccagatacgtgcccaacagcccctaccacgtgagaagaatgggcggcccctgcagacagagactgagacacagcgagagactgatccacacctacaagctggacagaagaccccccgcccacagcggcacctggcccggctag

SEQ ID NO: 20824 - DNA, 465 bp, Artificial Sequence
  Description of Artificial Sequence: Synthetic coding sequence
atggtgttctgcctgagcagcgaggagcccagaagacccctgagaagcgacatggtgcacttccaggccagcgaggtgcagcagctgctgcacaacaagttcgtggtgatcctgggcgacagcatccagagagccgtgtacaaggacctggtgctgctgctgcagaaggacagcctgctgaccgccgcccagctgaaggccaagggcgagctgagcttcgagcaggaccagctggtggccggcggccagctgggcgagctgcacaacggcacccagtacagagaggtgagacagttctgcagcggcagcggccaccacctggtgagattctacttcctgaccagagtgtacagcgagtacctggaggacgtgctggaggagctgacctacggcgccagccccagccaccccatgaacagcagcaccatcatccagtggagaaccagcagatgccaccccacctag

SEQ ID NO: 20825 - DNA, 843 bp, Artificial Sequence
  Description of Artificial Sequence: Synthetic coding sequence
atggtgttctgcctgagcagcgaggagcccagaagacccctgagaagcgacatggtgcacttccaggccagcgaggtgcagcagctgctgcacaacaagttcgtggtgatcctgggcgacagcatccagagagccgtgtacaaggacctggtgctgctgctgcagaaggacagcctgctgaccgccgcccagctgaaggccaagggcgagctgagcttcgagcaggaccagctggtggccggcggccagctgggcgagctgcacaacggcacccagtacagagaggtgagacagttctgcagcggcagcggccaccacctggtgagattctacttcctgaccagagtgtacagcgagtacctggaggacgtgctggaggagctgacctacggccccgcccccgacctggtgatcatcaacagctgcctgtgggacctgagcagatacggcagatgcagcatggagagctacagagagaacctggagagagtgttcgtgagaatggaccaggtgctgcccgacagctgcctgctggtgtggaacatggccatgcccctgggcgagagaatcaccggcggcttcctgctgcccgagctgcagcccctggccggcagcctgagaagagacgtggtggagggcaacttctacagcgccaccctggccggcgaccactgcttcgacgtgctggacctgcacttccacttcagacacgccgtgcagcacagacacagagacggcgtgcactgggaccagcacgcccacagacacctgagccacctgctgctgacccacgtggccgacgcctggggcgtggagctgcccaagagaggctaccccccctag

SEQ ID NO: 20826 - DNA, 690 bp, Artificial Sequence
  Description of Artificial Sequence: Synthetic coding sequence
atggtgttctgcctgagcagcgaggagcccagaagacccctgagaagcgacatggtgcacttccaggccagcgaggtgcagcagctgctgcacaacaagttcgtggtgatcctgggcgacagcatccagagagccgtgtacaaggacctggtgctgctgctgcagaaggacagcctgctgaccgccgcccagctgaaggccaagtacctggaggacgtgctggaggagctgacctacggccccgcccccgacctggtgatcatcaacagctgcctgtgggacctgagcagatacggcagatgcagcatggagagctacagagagaacctggagagagtgttcgtgagaatggaccaggtgctgcccgacagctgcctgctggtgtggaacatggccatgcccctgggcgagagaatcaccggcggcttcctgctgcccgagctgcagcccctggccggcagcctgagaagagacgtggtggagggcaacttctacagcgccaccctggccggcgaccactgcttcgacgtgctggacctgcacttccacttcagacacgccgtgcagcacagacacagagacggcgtgcactgggaccagcacgcccacagacacctgagccacctgctgctgacccacgtggccgacgcctggggcgtggagctgcccaagagaggctaccccccctag

SEQ ID NO: 20827 - DNA, 840 bp, Artificial Sequence
  Description of Artificial Sequence: Synthetic coding sequence
atgaacagctgcctgtgggacatcagcagatacggccccaacagctggagaagctacctggagaacctggagaacctgttccagtgcctgggccaggtgctgcccgagagctgcctgctggtgtggaacaccgccatgcccgtgggcgaggaggtgaccggcggcttcctgccccccaagctgagaagacagaaggccaccttcctgaagaacgaggtggtgaaggccaacttccacagcgccaccgaggccagaaagcacaacttcgacgtgctggacctgcacttccacttcagacacgccagagagaacctgcactgggacggcgtgcactggaacggcagagtgcacagatgcctgagccagctgctgctggcccacgtggccgacgcctggggcgtggagctgccccacagacaccccgtgggcgagtggatcaagaagaagaagcccggccccagagtggagggccccccccaggccaacagaaaccaccccgccctgcccctgagcccccccctgcccagccccacctacagacccctgctgggcttccccccccagaccatcctgagcagcagaatcaacagcatcgccatccagatgagcccccaccagcccatgcaggtgagcagcagcaagaccatcctgtggctggtgctgagctgcctgtgccccagcagcccccaccccgtgatcagcggcctgccccagtggtacatcggcgtgctggccggcatcgtgcccgtggcccccatcagacccggcgacagcggcctggacctgcagagagagggcccccagcccatcctgagccagggcctgaacagaagaacctag

SEQ ID NO: 20828 - DNA, 1299 bp, Artificial Sequence
  Description of Artificial Sequence: Synthetic coding sequence
atgatcctgctgagagccagcgaggtgagacagctgctgcacaacaagttcgtggtgatcctgggcgacagcgtgcacagagccgtgtacaaggacctggtgctgctgctgcagaaggacagactgctgacccccggccagctgagagccagaggcgagctgaacttcgagcaggacgagctggtggacggcggccagagaggccacatgcacaacggcctgaactacagagaggtgagagagttcagaagcgaccaccacctggtgagattctacttcctgaccagagtgtacagcgactacctgcagaccatcctgaaggagctgcagagcggcgagcacgcccccgacctggtgatcatgaacagctgcctgtgggacatcagcagatacggccccaacagctggagaagctacctggagaacctggagaacctgttccagtgcctgggccaggtgctgcccgagagctgcctgctggtgtggaacaccgccatgcccgtgggcgaggaggtgaccggcggcttcctgccccccaagctgagaagacagaaggccaccttcctgaagaacgaggtggtgaaggccaacttccacagcgccaccgaggccagaaagcacaacttcgacgtgctggacctgcacttccacttcagacacgccagagagaacctgcactgggacggcgtgcactggaacggcagagtgcacagatgcctgagccagctgctgctggcccacgtggccgacgcctggggcgtggagctgccccacagacaccccgtgggcgagtggatcaagaagaagaagcccggccccagagtggagggccccccccaggccaacagaaaccaccccgccctgcccctgagcccccccctgcccagccccacctacagacccctgctgggcttccccccccagagactgcccctgctgcccctgctgagcccccagccccccccccccatcctgcaccaccagggcatgcccagattcccccagggcccccccgacgcctgcttcagcagcgaccacaccttccagagcgaccagttctactgccacagcgacgtgcccagcagcgcccacgccggcttcttcgtggaggacaacttcatggtgggcccccagctgcccatgcccttcttccccacccccagataccagagacccgcccccgtggtgcacagaggcttcggcagatacagacccagaggcccctacaccccctggggccagagacccagacccagcaagagaagagcccccgccaaccccgagcccagaccccagtag

SEQ ID NO: 20829 - DNA, 1299 bp, Artificial Sequence; identical to SEQ ID NO: 20828
  Description of Artificial Sequence: Synthetic coding sequence

SEQ ID NO: 20830 - DNA, 504 bp, Artificial Sequence
  Description of Artificial Sequence: Synthetic coding sequence
atgatcctgctgagagccagcgaggtgagacagctgctgcacaacaagttcgtggtgatcctgggcgacagcgtgcacagagccgtgtacaaggacctggtgctgctgctgcagaaggacagactgctgacccccggccagctgagagccagaggcgagctgaacttcgagcaggacgagctggtggacggcggccagagaggccacatgcacaacggcctgaactacagagaggtgagagagttcagaagcgaccaccacctggtgagattctacttcctgaccagagtgtacagcgactacctgcagaccatcctgaaggagctgcagagcggcgagcacgcccccgacctggtgatcatgaacagctgcctgtgggacatcagcagatacggccccaacagctggagaagctacctggagaacctggagaacctgttccagtgcctgggccaggtgctgcccgagagctgcctgctggtgtggaacaccgccatgccctag

SEQ ID NO: 20831 - DNA, 507 bp, Artificial Sequence
  Description of Artificial Sequence: Synthetic coding sequence
atgatcctgctgagagccagcgaggtgagacagctgctgcacaacaagttcgtggtgatcctgggcgacagcgtgcacagagccgtgtacaaggacctggtgctgctgctgcagaaggacagactgctgacccccggccagctgagagccagaggcgagctgaacttcgagcaggacgagctggtggacggcggccagagaggccacatgcacaacggcctgaactacagagaggtgagagagttcagaagcgaccaccacctggtgagattctacttcctgaccagagtgtacagcgactacctgcagaccatcctgaaggagctgcagagcggcgagcacgcccccgacctggtgatcatgaacagctgcctgtgggacatcagcagatacggccccaacagctggagaagctacctggagaacctggagaacctgttccagtgcctgggccaggtgctgcccgagagctgcctgctggtgtggaacaccgccatgcccgtgtag

SEQ ID NO: 20832 - DNA, 177 bp, Artificial Sequence
  Description of Artificial Sequence: Synthetic coding sequence
atgatcctgctgagagccagcgaggtgagacagctgctgcacaacaagttcgtggtgatcctgggcgacagcgtgcacagagccgtgtacaaggacctggtgctgctgctgcagaaggacagactgctgacccccggccagctgagagccagaggcgagctgaacttcgagcagtag

SEQ ID NO: 20833 - DNA, 1518 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagcaaggtgctgcccatccaggacaacgtgagcaaggacgtgccccagaccagatggggctactggggcagctggggcaagagcatcctgagcagcgccagcgccaccgtggccaccgtgggccagggcatcagcaacgtgatcgagaaggccgagaccagcctgggcatccccggccccagcgagatcagcaccgaggtgaagtacgtggccggcgagaccaacgccaaggagaacgagaacagcagccccgtggccggcgccttcggcgtgttcagcaccatcagcaccgccgtgcagagcaccggcaagagcgtgatcagcggcggcctggacgccctggagttcatcggcaagaagaccatggacgtgatcgccgagggcgaccccggcttcaagagaaccaagggcctgatgaacagaaacgccaccctgagccaggtgctgagagaggccaaggagaaggaggagatcagaaccagcaacgaggtgaccgtggagaccgacaagaagacccactacggcctgctgttcgacgagttccagggcctgagccacctggaggccctggagatgctgagccaggagagcgagatcaaggtgaagagcatcctgaacagcctgagcggcgaggagctggagaccctgaaggtggagctggagcagctgaaggagaccttcagcctggccgagttctgcgaggaggaggaggaggagaagaagggcgacgaggacttcaccaaggacatcaccgagctgttcagccagctgcacgtgagcagcaagcccgagaagctggccagagccagaaacaccgcccacgagtggatcagaaagagcctgaccaagcccctggccgagaacgaggagggcgagaagcagagcgaggccgagaacaccgagcaggtgaacaagaacagcatcgaggacatccacgccttcgccatcagaagcctggccgagctgaccgcctgcagcatcgagctgttccacaagaccgccgccctggtgctgcacggcagaaagcaggaggtgaccgccatcgagagaagccagaccctgagccagatgaccatcgtgctgtgcaaggagctgagcagcctgagcaaggagttcaccacctgcctgaccaccgccggcgtgaaggagatggccgacgtgctgaaccccctgatcaccgccgtgttcctggaggccagcaacagcgccagctacatccaggacgccttccagctgctgctgcccgtgctggagatcagcctgatcgagaacaagatcgagagccacagacacgagctgcagggccagaagcccctgctggagcactag

SEQ ID NO: 20834 - DNA, 750 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagcaaggtgctgcccatccaggacaacgtgagcaaggacgtgccccagaccagatggggctactggggcagctggggcaagagcatcctgagcagcgccagcgccaccgtggccaccgtgggccagggcatcagcaacgtgatcgagaaggccgagaccagcctgggcatccccggccccagcgagatcagcaccgaggtgaagtacgtggccggcgagaccaacgccaaggagaacgagaacagcagccccgtggccggcgccttcggcgtgttcagcaccatcagcaccgccgtgcagagcaccggcaagagcgtgatcagcggcggcctggacgccctggagttcatcggcaagaagaccatggacgtgatcgccgagggcgaccccggcttcaagagaaccaagggcctgatgaacagaaacgccaccctgagccaggtgctgagagaggccaaggagaaggaggagatcagaaccagcaacgaggtgaccgtggagaccgacaagaagacccactacggcctgctgttcgacgagttccagggcctgcacatctag

SEQ ID NO: 20835 - DNA, 195 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagctag

SEQ ID NO: 20836 - DNA, 312 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagcaaggtgctgcccatccaggacaacgtgagcaaggacgtgccccagaccagatggggctactggggcagctggggcaagagcatcctgagcagcgccagcgccaccgtggccaccgtgtag

SEQ ID NO: 20837 - DNA, 378 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagcaaggtgctgcccatccaggacaacgtgagcaaggacgtgccccagaccagatggggctactggggcagctggggcaagagcatcctgagcagcgccagcgccaccgtggccaccgtgggccagggcatcagcaacgtgatcgagaaggccgagaccagcctgggcatccccggccccagcgagtag

SEQ ID NO: 20838 - DNA, 1518 bp, Artificial Sequence; identical to SEQ ID NO: 20833
  Description of Artificial Sequence: Synthetic coding sequence

SEQ ID NO: 20839 - DNA, 633 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagcaaggtgctgcccatccaggacaacgtgagcaaggacgtgccccagaccagatggggctactggggcagctggggcaagagcatcctgagcagcgccagcgccaccgtggccaccgtgggccagggcatcagcaacgtgatcgagaaggccgagaccagcctgggcatccccggccccagcgagatcagcaccgaggtgaagtacgtggccggcgagaccaacgccaaggagaacgagaacagcagccccgtggccggcgccttcggcgtgttcagcaccatcagcaccgccgtgcagagcaccggcaagagcgtgatcagcggcggcctggacgccctggagttcatcggcaagaagaccatggacgtgatcgccgagggcgaccccggcttcaagagaaccaagggcctgatgaacagaaacgccaccctgagccagtag

SEQ ID NO: 20840 - DNA, 240 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagcaaggtgctgcccatccaggacaacgtgagcaaggacgtgccccagtag

SEQ ID NO: 20841 - DNA, 1518 bp, Artificial Sequence; identical to SEQ ID NO: 20833
  Description of Artificial Sequence: Synthetic coding sequence

SEQ ID NO: 20842 - DNA, 501 bp, Artificial Sequence
  Description of Artificial Sequence: Synthetic coding sequence
atgagcgacaaggacgacatcgagacccccctgctgaccgaggccgcccccatcctggaggacggcaactgcgagcccgccaagaacagcgagagcgtggaccagggcgccaagcccgagagcaagagcgagcccgtggtgagcaccagaaagagacccgagaccaagcccagcagcgacctggagaccagcaaggtgctgcccatccaggacaacgtgagcaaggacgtgccccagaccagatggggctactggggcagctggggcaagagcatcctgagcagcgccagcgccaccgtggccaccgtgggccagggcatcagcaacgtgatcgagaaggccgagaccagcctgggcatccccggccccagcgagatcagcaccgaggtgaagtacgtggccggcgagaccaacgccaaggagaacgagaacagcagccccgtggccggcgccttcggcgtgttcagcaccatcagcaccgccgtgcagagcaccggctag

SEQ ID NO: 20843 - DNA, 48 bp, Artificial Sequence
  Description of Artificial Sequence: Synthetic coding sequence
atgagcgacaaggacgacatcgagacccccctgctgaccgaggcctag

SEQ ID NO: 20844 - DNA, 2760 bp, Artificial Sequence
  Description of Artificial Sequence: Synthetic coding sequence
atggccacccccagcgccgccttcgaggccctgatgaacggcgtgaccagctgggacgtgcccgaggacgccgtgccctgcgagctgctgctgatcggcgaggccagcttccccgtgatggtgaacgacatgggccaggtgctgatcgccgccagcagctacggcagaggcagactggtggtggtgagccacgaggactacctggtggaggcccagctgacccccttcctgctgaacgccgtgggctggctgtgcagcagccccggcgcccccatcggcgtgcaccccagcctggcccccctggccaagatcctggagggcagcggcgtggacgccaaggtggagcccgaggtgaaggacagcctgggcgtgtactgcatcgacgcctacaacgagaccatgaccgagaagctggtgaagttcatgaagtgcggcggcggcctgctgatcggcggccaggcctgggactgggccaaccagggcgaggacgagagagtgctgttcaccttccccggcaacctggtgaccagcgtggccggcatctacttcaccgacaacaagggcgacaccagcttcttcaaggtgagcaagaagatgcccaagatccccgtgctggtgagctgcgaggacgacctgagcgacgacagagaggagctgctgcacggcatcagcgagctggacatcagcaacagcgactgcttccccagccagctgctggtgcacggcgccctggccttccccctgggcctggacagctaccacggctgcgtgatcgccgccgccagatacggcagaggcagagtggtggtgaccggccacaaggtgctgttcaccgtgggcaagctgggccccttcctgctgaacgccgtgagatggctggacggcggcagaagaggcaaggtggtggtgcagaccgagctgagaaccctgagcggcctgctggccgtgggcggcatcgacaccagcatcgagcccaacctgaccagcgacgccagcgtgtactgcttcgagcccgtgagcgaggtgggcgtgaaggagctgcaggagttcgtggccgagggcggcggcctgttcgtgggcgcccaggcctggtggtgggccttcaagaaccccggcgtgagccccctggccagattccccggcaacctgctgctgaaccccttcggcatcagcatcaccagccagagcctgaaccccggccccttcagaacccccaaggccggcatcagaacctaccacttcagaagcaccctggccgagttccaggtgatcatgggcagaaagagaggcaacgtggagaagggctggctggccaagctgggccccgacggcgccgccttcctgcagatccccgccgaggagatccccgcctacatgagcgtgcacagactgctgagaaagctgctgagcagatacagactgcccgtggccaccagagagaaccccgtgatcaacgactgctgcagaggcgccatgctgagcctggccaccggcctggcccacagcggcagcgacctgagcctgctggtgcccgagatcgaggacatgtacagcagcccctacctgagacccagcgagagccccatcaccgtggaggtgaactgcaccaaccccggcaccagatactgctggatgagcaccggcctgtacatccccggcagacagatcatcgaggtgagcctgcccgaggccgccgccagcgccgacctgaagatccagatcggctgccacaccgacgacctgaccagagccagcaagctgttcagaggccccctggtgatcaacagatgctgcctggacaagcccaccaagagcatcacctgcctgtggggcggcctgctgtacatcatcgtgccccagaacagcaagctgggcagcgtgcccgtgaccgtgaagggcgccgtgcacgccccctactacaagctgggcgagaccaccctggaggagtggaagagaagaatccaggagaaccccggcccctggggcgagctggccaccgacaacatcatcctgaccgtgcccaccgccaacctgagaaccctggagaaccccgagcccctgctgagactgtgggacgaggtgatgcaggccgtggccagactgggcgccgagcccttccccctgagactgccccagagaatcgtggccgacgtgcagatcagcgtgggctggatgcacgccggctaccccatcatgtgccacctggagagcgtgcaggagctgatcaacgagaagctgatcagaaccaagggcctgtggggccccgtgcacgagctgggcagaaaccagcagagacaggagtgggagttccccccccacaccaccgaggccacctgcaacctgtggtgcgtgtacgtgcacgagaccgtgctgggcatccccagaagcagagccaacatcgccctgtggccccccgtgagagagaagagagtgagaatctacctgagcaagggccccaacgtgaagaactggaacgcctggaccgccctggagacctacctgcagctgcaggaggccttcggctgggagcccttcatcagactgttcaccgagtacagaaaccagaccaacctgcccaccgagaacgtggacaagatgaacctgtgggtgaagatgttcagccaccaggtgcagaagaacctggcccccttcttcgaggcctgggcctggcccatccagaaggaggtggccaccagcctggcctacctgcccgagtggaaggagaacatcatgaagctgtacctgctgacccagatgtag

SEQ ID NO: 20845 - DNA, 504 bp, Artificial Sequence
  Description of Artificial Sequence: Synthetic coding sequence
atggccacccccagcgccgccttcgaggccctgatgaacggcgtgaccagctgggacgtgcccgaggacgccgtgccctgcgagctgctgctgatcggcgaggccagcttccccgtgatggtgaacgacatgggccaggtgctgatcgccgccagcagctacggcagaggcagactggtggtggtgagccacgaggactacctggtggaggcccagctgacccccttcctgctgaacgccgtgggctggctgtgcagcagccccggcgcccccatcggcgtgcaccccagcctggcccccctggccaagatcctggagggcagcggcgtggacgccaaggtggagcccgaggtgaaggacagcctgggcgtgtactgcatcgacgcctacaacgagaccatgaccgagaagctggtgaagttcatgaagtgcggcggcggcctgctgatcggcggccaggcctgggactgggccaaccagggcgaggacgagagagtgctgtag

SEQ ID NO: 20846 - DNA, 441 bp, Artificial Sequence
  Description of Artificial Sequence: Synthetic coding sequence
atggccacccccagcgccgccttcgaggccctgatgaacggcgtgaccagctgggacgtgcccgaggacgccgtgccctgcgagctgctgctgatcggcgaggccagcttccccgtgatggtgaacgacatgggccaggtgctgatcgccgccagcagctacggcagaggcagactggtggtggtgagccacgaggactacctggtggaggcccagctgacccccttcctgctgaacgccgtgggctggctgtgcagcagccccggcgcccccatcggcgtgcaccccagcctggcccccctggccaagatcctggagggcagcggcgtggacgccaaggtggagcccgaggtgaaggacagcctgggcgtgtactgcatcgacgcctacaacgagaccatgaccgagaagctggtgaagttcatgaagtgcggcggctag

SEQ ID NO: 20847 - DNA, 2766 bp, Artificial Sequence
  Description of Artificial Sequence: Synthetic coding sequence
atggccacccccagcgccgccttcgaggccctgatgaacggcgtgaccagctgggacgtgcccgaggacgccgtgccctgcgagctgctgctgatcggcgaggccagcttccccgtgatggtgaacgacatgggccaggtgctgatcgccgccagcagctacggcagaggcagactggtggtggtgagccacgaggactacctggtggaggcccagctgacccccttcctgctgaacgccgtgggctggctgtgcagcagccccggcgcccccatcggcgtgcaccccagcctggcccccctggccaagatcctggagggcagcggcgtggacgccaaggtggagcccgaggtgaaggacagcctgggcgtgtactgcatcgacgcctacaacgagaccatgaccgagaagctggtgaagttcatgaagtgcggcggcggcctgctgatcggcggccaggcctgggactgggccaaccagggcgaggacgagagagtgctgttcaccttccccggcaacctggtgaccagcgtggccggcatctacttcaccgacaacaagggcgacaccagcttcttcaaggtgagcaagaagatgcccaagatccccgtgctggtgagctgcgaggacgacctgagcgacgacagagaggagctgctgcacggcatcagcgagctggacatcagcaacagcgactgcttccccagccagctgctggtgcacggcgccctggccttccccctgggcctggacagctaccacggctgcgtgatcgccgccgccagatacggcagaggcagagtggtggtgaccggccacaaggtgctgttcaccgtgggcaagctgggccccttcctgctgaacgccgtgagatggctggacggcggcagaagaggcaaggtggtggtgcagaccgagctgagaaccctgagcggcctgctggccgtgggcggcatcgacaccagcatcgagcccaacctgaccagcgacgccagcgtgtactgcttcgagcccgtgagcgaggtgggcgtgaaggagctgcaggagttcgtggccgagggcggcggcctgttcgtgggcgcccaggcctggtggtgggccttcaagaaccccggcgtgagccccctggccagattccccggcaacctgctgctgaaccccttcggcatcagcatcaccagccagagcctgaaccccggccccttcagaacccccaaggccggcatcagaacctaccacttcagaagcaccctggccgagttccaggtgatcatgggcagaaagagaggcaacgtggagaagggctggctggccaagctgggccccgacggcgccgccttcctgcagatccccgccgaggagatccccgcctacatgagcgtgcacagactgctgagaaagctgctgagcagatacagactgcccgtggccaccagagagaaccccgtgatcaacgactgctgcagaggcgccatgctgagcctggccaccggcctggcccacagcggcagcgacctgagcctgctggtgcccgagatcgaggacatgtacagcagcccctacctgagacccagcgagagccccatcaccgtggaggtgaactgcaccaaccccggcaccagatactgctggatgagcaccggcctgtacatccccggcagacagatcatcgaggtgagcctgcccgaggccgccgccagcgccgacctgaagatccagatcggctgccacaccgacgacctgaccagagccagcaagctgttcagaggccccctggtgatcaacagatgctgcctggacaagcccaccaagagcatcacctgcctgtggggcggcctgctgtacatcatcgtgccccagaacagcaagctgggcagcgtgcccgtgaccgtgaagggcgccgtgcacgccccctactacaagctgggcgagaccaccctggaggagtggaagagaagaatccaggagaaccccggcccctggggcgagctggccaccgacaacatcatcctgaccgtgcccaccgccaacctgagaaccctggagaaccccgagcccctgctgagactgtgggacgaggtgatgcaggccgtggccagactgggcgccgagcccttccccctgagactgccccagagaatcgtggccgacgtgcagatcagcgtgggctggatgcacgccggctaccccatcatgtgccacctggagagcgtgcaggagctgatcaacgagaagctgatcagaaccaagggcctgtggggccccgtgcacgagctgggcagaaaccagcagagacaggagtgggagttccccccccacaccaccgaggccacctgcaacctgtggtgcgtgtacgtgcacgagaccgtgctgggcatccccagaagcagagccaacatcgccctgtggccccccgtgagagagaagagagtgagaatctacctgagcaagggccccaacgtgaagaactggaacgcctggaccgccctggagacctacctgcagctgcaggaggccttcggctgggagcccttcatcagactgttcaccgagtacagaaaccagaccaacctgcccaccgagaacgtggacaagatgaacctgtgggtgaagatgttcagccaccaggtgcagaagaacctggcccccttcttcgaggcctgggcctggcccatccagaaggaggtggccaccagcctggcctacctgcccgagtggaaggagaacatcatgaagctgtacctgctgacccagatgccccactag

SEQ ID NO: 20848 - DNA, 228 bp, Artificial Sequence
  Description of Artificial Sequence: Synthetic coding sequence
atggccacccccagcgccgccttcgaggccctgatgaacggcgtgaccagctgggacgtgcccgaggacgccgtgccctgcgagctgctgctgatcggcgaggccagcttccccgtgatggtgaacgacatgggccaggtgctgatcgccgccagcagctacggcagaggcagactggtggtggtgagccacgaggactacctggtggaggcccagctgaccccctag

SEQ ID NO: 20849 - DNA, 453 bp, Artificial Sequence
  Description of Artificial Sequence: Synthetic coding sequence
atggccacccccagcgccgccttcgaggccctgatgaacggcgtgaccagctgggacgtgcccgaggacgccgtgccctgcgagctgctgctgatcggcgaggccagcttccccgtgatggtgaacgacatgggccaggtgctgatcgccgccagcagctacggcagaggcagactggtggtggtgagccacgaggactacctggtggaggcccagctgacccccttcctgctgaacgccgtgggctggctgtgcagcagccccggcgcccccatcggcgtgcaccccagcctggcccccctggccaagatcctggagggcagcggcgtggacgccaaggtggagcccgaggtgaaggacagcctgggcgtgtactgcatcgacgcctacaacgagaccatgaccgagaagctggtgaagttcatgaagtgcggcggcggcctgctgatctag

SEQ ID NO: 20850 - DNA, 2538 bp, Artificial Sequence
  Description of Artificial Sequence: Synthetic coding sequence
atggccaccatcgccgccgccgccttcgaggccctgatggacggcgtgacctgctgggacgtgcccagaggccccatccccagcgagctgctgctgatcggcgaggccgccttccccgtgatggtgaacgacaagggccaggtgctgatcgccgccagcagctacggcagaggcagactggtggtggtgagccacgagggctacctgagccacaccggcctggcccccttcctgctgaacgccgtgagctggctgtgcccctgccccggcgcccccgtgggcgtgcaccccagcctggcccccctggtgaacatcctgcaggacgccggcctggaggcccaggtgaagcccgagcccggcgagcccctgggcgtgtactgcatcaacgcctacaacgacaccctgaccgccaccctgatccagttcgtgaagcacggcggcggcctgctgatcggcggccaggcctggtactgggccagccagcacggccccgacaaggtgctgagcagattccccggcaacaaggtgaccagcgtggccggcgtgtacttcaccgacacctacggcgacagagacagattcaaggtgagcaagaaggtgcccaagatccccctgcacgtgagatacggcgaggacgtgagacaggaccagcagcagctgctggagggcatcagcgagctggacatcagaaccggcggcgtgcccagccagctgctggtgcacggcgccctggccttccccctgggcctggacgccagcctgaactgcttcctggccgccgcccactacggcagaggcagagtggtgctggccgcccacgagtgcctgctgtgcgcccccaagatgggccccttcctgctgaacgccgtgagatggctggccagaggccagaccggcaaggtgggcgtgaacaccaacctgaaggacctgtgccccctgctgagcgagcacggcctgcagtgcagcctggagccccacctgaacagcgacctgtgcgtgtactgctgcaaggcctacagcgacaaggaggccaagcagctgcaggagttcgtggccgagggcggcggcctgctgatcggcggccaggcctggtggtgggccagccagaaccccggccactgccccctggccggcttccccggcaacatcatcctgaactgcttcggcctgagcatcctgccccagaccctgaaggccggctgcttccccgtgcccacccccgagatgagaagctaccacttcagaaaggccctgagccagttccaggccatcctgaaccacgagaacggcaacctggagaagagctgcctggccaagctgagagtggacggcgccgccttcctgcagatccccgccgagggcgtgcccgcctacatcagcctgcacagactgctgagaaagatgctgagaggcagcggcctgcccgccgtgagcagagagaaccccgtggccagcgacagctacgaggccgccgtgctgagcctggccaccggcctggcccacagcggcaccgactgcagccagctggcccagggcctgggcacctggacctgcagcagcagcctgtaccccagcaagcaccccatcaccgtggagatcaacggcatcaaccccggcaacaacgactgctgggtgagcaccggcctgtacctgctggagggccagaacgccgaggtgagcctgagcgaggccgccgccagcgccggcctgagagtgcagatcggctgccacaccgacgacctgaccaaggccagaaagctgagcagagcccccgtggtgacccaccagtgctggatggacagaaccgagagaagcgtgagctgcctgtggggcggcctgctgtacgtgatcgtgcccaagggcagccagctgggccccgtgcccgtgaccatcagaggcgccgtgcccgccccctactacaagctgggcaagaccagcctggaggagtggaagagacagatgcaggagaacctggccccctggggcgagctggccaccgacaacatcatcctgaccgtgcccaccaccaacctgcaggccctgaaggaccccgagcccgtgctgagactgtgggacgagatgatgcaggccgtggccagactggccgccgagcccttccccttcagaagacccgagagaatcgtggccgacgtgcagatcagcgccggctggatgcacagcggctaccccatcatgtgccacctggagagcgtgaaggagatcatcaacgagatggacatgagaagcagaggcgtgtggggccccatccacgagctgggccacaaccagcagagacacggctgggagttccccccccacaccaccgaggccacctgcaacctgtggagcgtgtacgtgcacgagaccgtgctgggcatccccagagcccaggcccacgaggccctgagcccccccgagagagagagaagaatcaaggcccacctgggcaagggcgcccccctgtgcgactggaacgtgtggaccgccctggagacctacctgcaggtgctgagcagaaacagcggcagaagaggctag

SEQ ID NO: 20851 - DNA, 2448 bp, Artificial Sequence
  Description of Artificial Sequence: Synthetic coding sequence
atgaagatcttccagaaggagttcaagttcatcctgaagaagtgcacccccatccagaagtacagagaggagaacggcaacagcagcagcagcccccaccaccagctgcagagccacgccagcggccccagatacggcgaggacgtgagacaggaccagcagcagctgctggagggcatcagcgagctggacatcagaaccggcggcgtgcccagccagctgctggtgcacggcgccctggccttccccctgggcctggacgccagcctgaactgcttcctggccgccgcccactacggcagaggcagagtggtgctggccgcccacgagtgcctgctgtgcgcccccaagatgggccccttcctgctgaacgccgtgagatggctggccagaggccagaccggcaaggtgggcgtgaacaccaacctgaaggacctgtgccccctgctgagcgagcacggcctgcagtgcagcctggagccccacctgaacagcgacctgtgcgtgtactgctgcaaggcctacagcgacaaggaggccaagcagctgcaggagttcgtggccgagggcggcggcctgctgatcggcggccaggcctggtggtgggccagccagaaccccggccactgccccctggccggcttccccggcaacatcatcctgaactgcttcggcctgagcatcctgccccagaccctgaaggccggctgcttccccgtgcccacccccgagatgagaagctaccacttcagaaaggccctgagccagttccaggccatcctgaaccacgagaacggcaacctggagaagagctgcctggccaagctgagagtggacggcgccgccttcctgcagatccccgccgagggcgtgcccgcctacatcagcctgcacagactgctgagaaagatgctgagaggcagcggcctgcccgccgtgagcagagagaaccccgtggccagcgacagctacgaggccgccgtgctgagcctggccaccggcctggcccacagcggcaccgactgcagccagctggcccagggcctgggcacctggacctgcagcagcagcctgtaccccagcaagcaccccatcaccgtggagatcaacggcatcaaccccgagagccacagcgtgatccaggtgggcatgcagtggagagacctgagcagctgcaacctgcacctgctgggcctgagcaacagcagcctgagcgccagctgcgtggccggcaccaccggcaccagacaccacgcctggctgatcttcgtgttcctggtggagagagagttccacagaaagggcaacaacgactgctgggtgagcaccggcctgtacctgctggagggccagaacgccgaggtgagcctgagcgaggccgccgccagcgccggcctgagagtgcagatcggctgccacaccgacgacctgaccaaggccagaaagctgagcagagcccccgtggtgacccaccagtgctggatggacagaaccgagagaagcgtgagctgcctgtggggcggcctgctgtacgtgatcgtgcccaagggcagccagctgggccccgtgcccgtgaccatcagaggcgccgtgcccgccccctactacaagctgggcaagaccagcctggaggagtggaagagacagatgcaggagaacctggccccctggggcgagctggccaccgacaacatcatcctgaccgtgcccaccaccaacctgcaggccctgaaggaccccgagcccgtgctgagactgtgggacgagatgatgcaggccgtggccagactggccgccgagcccttccccttcagaagacccgagagaatcgtggccgacgtgcagatcagcgccggctggatgcacagcggctaccccatcatgtgccacctggagagcgtgaaggagatcatcaacgagatggacatgagaagcagaggcgtgtggggccccatccacgagctgggccacaaccagcagagacacggctgggagttccccccccacaccaccgaggccacctgcaacctgtggagcgtgtacgtgcacgagaccgtgctgggcatccccagagcccaggcccacgaggccctgagcccccccgagagagagagaagaatcaaggcccacctgggcaagggcgcccccctgtgcgactggaacgtgtggaccgccctggagacctacctgcagctgcaggaggccttcggctgggagcccttcacccagctgttcgccgagtaccagaccctgagccacctgcccaaggacaacaccggcagaatgaacctgtgggtgaagaagttcagcgagaaggtgaagaagaacctggtgcccttcttcgaggcctggggctggcccatccagaaggaggtggccgacagcctggccagcctgcccgagtggcaggagaaccccatgcaggtgtacctgagagccagaaagtag

SEQ ID NO: 20852 - DNA, 1695 bp, Artificial Sequence
  Description of Artificial Sequence: Synthetic coding sequence
atgggccccttcctgctgaacgccgtgagatggctggccagaggccagaccggcaaggtgggcgtgaacaccaacctgaaggacctgtgccccctgctgagcgagcacggcctgcagtgcagcctggagccccacctgaacagcgacctgtgcgtgtactgctgcaaggcctacagcgacaaggaggccaagcagctgcaggagttcgtggccgagggcggcggcctgctgatcggcggccaggcctggtggtgggccagccagaaccccggccactgccccctggccggcttccccggcaacatcatcctgaactgcttcggcctgagcatcctgccccagaccctgaaggccggctgcttccccgtgcccacccccgagatgagaagctaccacttcagaaaggccctgagccagttccaggccatcctgaaccacgagaacggcaacctggagaagagctgcctggccaagctgagagtggacggcgccgccttcctgcagatccccgccgagggcgtgcccgcctacatcagcctgcacagactgctgagaaagatgctgagaggcagcggcctgcccgccgtgagcagagagaaccccgtggccagcgacagctacgaggccgccgtgctgagcctggccaccggcctggcccacagcggcaccgactgcagccagctggcccagggcctgggcacctggacctgcagcagcagcctgtaccccagcaagcaccccatcaccgtggagatcaacggcatcaaccccggcaacaacgactgctgggtgagcaccggcctgtacctgctggagggccagaacgccgaggtgagcctgagcgaggccgccgccagcgccggcctgagagtgcagatcggctgccacaccgacgacctgaccaaggccagaaagctgagcagagcccccgtggtgacccaccagtgctggatggacagaaccgagagaagcgtgagctgcctgtggggcggcctgctgtacgtgatcgtgcccaagggcagccagctgggccccgtgcccgtgaccatcagaggcgccgtgcccgccccctactacaagctgggcaagaccagcctggaggagtggaagagacagatgcaggagaacctggccccctggggcgagctggccaccgacaacatcatcctgaccgtgcccaccaccaacctgcaggccctgaaggaccccgagcccgtgctgagactgtgggacgagatgatgcaggccgtggccagactggccgccgagcccttccccttcagaagacccgagagaatcgtggccgacgtgcagatcagcgccggctggatgcacagcggctaccccatcatgtgccacctggagagcgtgaaggagatcatcaacgagatggacatgagaagcagaggcgtgtggggccccatccacgagctgggccacaaccagcagagacacggctgggagttccccccccacaccaccgaggccacctgcaacctgtggagcgtgtacgtgcacgagaccgtgctgggcatccccagagcccaggcccacgaggccctgagcccccccgagagagagagaagaatcaaggcccacctgggcaagggcgcccccctgtgcgactggaacgtgtggaccgccctggagacctacctgcaggtgctgagcagaaacagcggcagaagaggctag

SEQ ID NO: 20853 - DNA, 1695 bp, Artificial Sequence; identical to SEQ ID NO: 20852
  Description of Artificial Sequence: Synthetic coding sequence

SEQ ID NO: 20854 - DNA, 2760 bp, Artificial Sequence
  Description of Artificial Sequence: Synthetic coding sequence
atggccaccatcgccgccgccgccttcgaggccctgatggacggcgtgacctgctgggacgtgcccagaggccccatccccagcgagctgctgctgatcggcgaggccgccttccccgtgatggtgaacgacaagggccaggtgctgatcgccgccagcagctacggcagaggcagactggtggtggtgagccacgagggctacctgagccacaccggcctggcccccttcctgctgaacgccgtgagctggctgtgcccctgccccggcgcccccgtgggcgtgcaccccagcctggcccccctggtgaacatcctgcaggacgccggcctggaggcccaggtgaagcccgagcccggcgagcccctgggcgtgtactgcatcaacgcctacaacgacaccctgaccgccaccctgatccagttcgtgaagcacggcggcggcctgctgatcggcggccaggcctggtactgggccagccagcacggccccgacaaggtgctgagcagattccccggcaacaaggtgaccagcgtggccggcgtgtacttcaccgacacctacggcgacagagacagattcaaggtgagcaagaaggtgcccaagatccccctgcacgtgagatacggcgaggacgtgagacaggaccagcagcagctgctggagggcatcagcgagctggacatcagaaccggcggcgtgcccagccagctgctggtgcacggcgccctggccttccccctgggcctggacgccagcctgaactgcttcctggccgccgcccactacggcagaggcagagtggtgctggccgcccacgagtgcctgctgtgcgcccccaagatgggccccttcctgctgaacgccgtgagatggctggccagaggccagaccggcaaggtgggcgtgaacaccaacctgaaggacctgtgccccctgctgagcgagcacggcctgcagtgcagcctggagccccacctgaacagcgacctgtgcgtgtactgctgcaaggcctacagcgacaaggaggccaagcagctgcaggagttcgtggccgagggcggcggcctgctgatcggcggccaggcctggtggtgggccagccagaaccccggccactgccccctggccggcttccccggcaacatcatcctgaactgcttcggcctgagcatcctgccccagaccctgaaggccggctgcttccccgtgcccacccccgagatgagaagctaccacttcagaaaggccctgagccagttccaggccatcctgaaccacgagaacggcaacctggagaagagctgcctggccaagctgagagtggacggcgccgccttcctgcagatccccgccgagggcgtgcccgcctacatcagcctgcacagactgctgagaaagatgctgagaggcagcggcctgcccgccgtgagcagagagaaccccgtggccagcgacagctacgaggccgccgtgctgagcctggccaccggcctggcccacagcggcaccgactgcagccagctggcccagggcctgggcacctggacctgcagcagcagcctgtaccccagcaagcaccccatcaccgtggagatcaacggcatcaaccccggcaacaacgactgctgggtgagcaccggcctgtacctgctggagggccagaacgccgaggtgagcctgagcgaggccgccgccagcgccggcctgagagtgcagatcggctgccacaccgacgacctgaccaaggccagaaagctgagcagagcccccgtggtgacccaccagtgctggatggacagaaccgagagaagcgtgagctgcctgtggggcggcctgctgtacgtgatcgtgcccaagggcagccagctgggccccgtgcccgtgaccatcagaggcgccgtgcccgccccctactacaagctgggcaagaccagcctggaggagtggaagagacagatgcaggagaacctggccccctggggcgagctggccaccgacaacatcatcctgaccgtgcccaccaccaacctgcaggccctgaaggaccccgagcccgtgctgagactgtgggacgagatgatgcaggccgtggccagactggccgccgagcccttccccttcagaagacccgagagaatcgtggccgacgtgcagatcagcgccggctggatgcacagcggctaccccatcatgtgccacctggagagcgtgaaggagatcatcaacgagatggacatgagaagcagaggcgtgtggggccccatccacgagctgggccacaaccagcagagacacggctgggagttccccccccacaccaccgaggccacctgcaacctgtggagcgtgtacgtgcacgagaccgtgctgggcatccccagagcccaggcccacgaggccctgagcccccccgagagagagagaagaatcaaggcccacctgggcaagggcgcccccctgtgcgactggaacgtgtggaccgccctggagacctacctgcagctgcaggaggccttcggctgggagcccttcacccagctgttcgccgagtaccagaccctgagccacctgcccaaggacaacaccggcagaatgaacctgtgggtgaagaagttcagcgagaaggtgaagaagaacctggtgcccttcttcgaggcctggggctggcccatccagaaggaggtggccgacagcctggccagcctgcccgagtggcaggagaaccccatgcaggtgtacctgagagccagaaagtag

SEQ ID NO: 20855 - DNA, 2538 bp, Artificial Sequence; identical to SEQ ID NO: 20850
  Description of Artificial Sequence: Synthetic coding sequence

SEQ ID NO: 20856 - DNA, 1827 bp, Artificial Sequence
  Description of Artificial Sequence: Synthetic coding sequence
atggccctgagaggccccgccggcctgggccccggcagcagaagacccctggacgaggccgtggccggcgccgagggcagagaggcccccgccctggtggccgccggcggcgcccccgaggacgacgaggaggacgacggcagaggcagaggcctgctgagatgggacagcttcagcgcctggctgcactgcgtgtgcgtggtgggcttcgacctggagctgggccaggccgtggaggtgatctacccccagcacagcaagctgaccgacagagagaagaccaacatctgctacctgagcttccccgacagcaacagcggctgcctgggcgacacccagttctgcttcagattcagacagagcagcggcagaagagtgagcctgcactgcctgctggaccagttcgacaaggacctgcccgtgtacctgaagaaggaccccgcctacttctacggctacgtgtacttcagacaggtgagagacaagaccctgaagagaggctacttccagaagagcctggtgctgatcagcaagctgccctacatccacttcttccacaccgtgctgaagcagatcgcccccgagtacttcgagaagaacgagccctacctggaggccgcctgcaacgacgtggacagatggcccgcccccgtgcccggcaagaccctgcacctgcccatcatgggcgtggtgatgaaggtgagaatccccacctgccacgacaagcccggcaccacccagatcgtgcagctgacccagcaggtggacaccaacatcagcgtgatcctgcccaccgtgcacgaggtggacatcttcagatgcttctgccccgtgttcctgcacagccagatgctgtgggagctggtgctgctgggcgagcccctggtggtgatggcccccagccccagcgagagcagcgagaccgtgctggccctggtgaactgcatcagccccctgaagtacttcagcgacttcagaccctacttcaccatccacgacagcgagttcaaggagtacaccaccagaacccaggccccccccagcgtgatcctgggcgtgaccaaccccttcttcgccaagaccctgcagcactggccccacatcatcagaatcggcgacctgaagcccaccggcgagatccccaagcaggtgaaggtgaagaagctgaagaacctgaagaccctggacagcaagcccggcgtgtacaccagctacaagccctacctgaacagagacgaggagatcatcaagcagctgcagaagggcgtgcagcagaagagacccagcgaggcccagagcgtgatcctgagaagatacttcctggagctgacccagagcttcatcatccccctggagagatacgtggccagcctgatgcccctgcagaagagcatcagcccctggaagagccccccccagctgagacagttcctgcccgaggagttcatgaagaccctggagaagaccggcccccagctgaccagcagaatcaagggcgactggatcggcctgtacagacacttcctgaagagccccaacttcgacggctggttcaagaccagaagaaaggagatgacccagaagctggaggccctgcacctggaggccctgtgcgaggaggacctgctgctgtggatccagaagcacaccgaggtggagaccgtggacctggtgctgaagctgaagaacaagctgctgcaggccgacagagagcacctgcccgtgaagcccgacaccatggagaagctgagaacccacatcgacgccatcatcctggccctgcccgaggacctgcagggcatcctgctgaagaccggcatgacctag

SEQ ID NO: 20857 - DNA, 1758 bp, Artificial Sequence
  Description of Artificial Sequence: Synthetic coding sequence
atggacgccctgctgggcaccggccccagaagagccagaggctgcctgggcgccgccggccccaccagcagcggcagagccgccagaacccccgccgccccctgggccagattcagcgcctggctggagtgcgtgtgcgtggtgaccttcgacctggagctgggccaggccctggagctggtgtaccccaacgacttcagactgaccgacaaggagaagagcagcatctgctacctgagcttccccgacagccacagcggctgcctgggcgacacccagttcagcttcagaatgagacagtgcggcggccagagaagcccctggcacgccgacgacagacactacaacagcagagcccccgtggccctgcagagagagcccgcccactacttcggctacgtgtacttcagacaggtgaaggacagcagcgtgaagagaggctacttccagaagagcctggtgctggtgagcagactgcccttcgtgagactgttccaggccctgctgagcctgatcgcccccgagtacttcgacaagctggccccctgcctggaggccgtgtgcagcgagatcgaccagtggcccgcccccgcccccggccagaccctgaacctgcccgtgatgggcgtggtggtgcaggtgagaatccccagcagagtggacaagagcgagagcagcccccccaagcagttcgaccaggagaacctgctgcccgcccccgtggtgctggccagcgtgcacgagctggacctgttcagatgcttcagacccgtgctgacccacatgcagaccctgtgggagctgatgctgctgggcgagcccctgctggtgctggcccccagccccgacgtgagcagcgagatggtgctggccctgaccagctgcctgcagcccctgagattctgctgcgacttcagaccctacttcaccatccacgacagcgagttcaaggagttcaccaccagaacccaggccccccccaacgtggtgctgggcgtgaccaaccccttcttcatcaagaccctgcagcactggccccacatcctgagagtgggcgagcccaagatgagcggcgacctgcccaagcaggtgaagctgaagaagcccagcagactgaagaccctggacaccaagcccggcctgtacaccgcctacaccgcccacctgcacagagacaaggccctgctgaagagactgctgaagggcgtgcagaagaagagacccagcgacgtgcagagcgccctgctgagaagacacctgctggagctgacccagagcttcatcatccccctggagcactacatggccagcctgatgcccctgcagaagagcatcaccccctggaagacccccccccagatccagcccttcagccaggacgacttcctgagaagcctggagcacgccggcccccagctgacctgcatcctgaagggcgactggctgggcctgtacagaagattcttcaagagcccccacttcgacggctggtacagacagagacacaaggagatggccctgaagctggaggccctgcacctggaggccatctgcgaggccaacatcgagacctggatgaaggacaagagcgaggtggaggtggtggacctggtgctgaagctgagagagaagctggtgagagcccagggccaccagctgcccgtgaaggaggccaccctgcagagagcccagctgtacatcgagaccgtgatcggcagcctgcccaaggacctgcaggccgtgctgtgccccccctag

SEQ ID NO: 20858 - DNA, 1362 bp, Artificial Sequence
  Description of Artificial Sequence: Synthetic coding sequence
atggccggcgccgccgccggcggcagaggcggcggcgcctggggccccggcagaggcggcgccggcggcctgagaagaggctgcagcccccccgcccccgccggcagccccagagccggcctgcagcccctgagagccaccatccccttccagctgcagcagccccaccagagaagagacggcggcggcagagccgccagcgtgccctgcagcgtggcccccgagaagagcgtgtgcagaccccagcccctgcaggtgagaagaaccttcagcctggacaccatcctgagcagctacctgctgggccagtggcccagagacgccgacggcgccttcacctgctgcaccaacgacaaggccacccagacccccctgagctggcaggagctggagggcgagagagccagcagctgcgcccacaagagaagcgccagctggggcagcaccgaccacagaaaggagatcagcaagctgaagcagcagctgcagagaaccaagctgagcagaagcggcaaggagaaggagagaggcagccccctgctgggcgaccacgccgtgagaggcgccctgagagccagcccccccagcttccccagcggcagccccgtgctgagactgagcccctgcctgcacagaagcctggagggcctgaaccaggagctggaggaggtgttcgtgaaggagcagggcgaggaggagctgctgagaatcctggacatccccgacggccacagagcccccgcccccccccagagcggcagctgcgaccaccccctgctgctgctggagcccggcaacctggccagcagccccagcatgagcctggccagcccccagccctgcggcctggccagccacgaggagcacagaggcgccgccgaggagctggccagcacccccaacgacaaggccagcagccccggccaccccgccttcctggaggacggcagccccagccccgtgctggccttcgccgccagccccagacccaaccacagctacatcttcaagagagagccccccgagggctgcgagaaggtgagagtgttcgaggaggccaccagccccggccccgacctggccttcctgaccagctgccccgacaagaacaaggtgcacttcaaccccaccggcagcgccttctgccccgtgaacctgatgaagcccctgttccccggcatgggcttcatcttcagaaactgccccagcaaccccggcagccccctgccccccgccagccccagacccccccccagaaaggaccccgaggccagcaaggccagccccctgcccttcgagccctggcagagaaccccccccagcgaggagcccgtgctgttccagagcagcctgatggtgtag

SEQ ID NO: 20859 - DNA, 1038 bp, Artificial Sequence
  Description of Artificial Sequence: Synthetic coding sequence
atgagagacaaggccacccagaccgagagcgcctgggccgaggagtacagcgagaagaagaagggcagccacaagagaagcgccagctggggcagcaccgaccagctgaaggagatcgccaagctgagacagcagctgcagagaagcaagcacagcagcagacaccacagagacaaggagagacagagccccttccacggcaaccacgccgccatcaaccagtgccaggcccccgtgcccaagagcgccctgatccccgtgatccccatcaccaagagcaccggcagcagattcagaaacagcgtggagggcctgaaccaggagatcgagatcatcatcaaggagaccggcgagaaggaggagcagctgatcccccaggacatccccgacggccacagagcccccccccccctggtgcagagaagcagcagcaccagaagcatcgacacccagacccccggcggcgccgacagaggcagcaacaacagcagcagaagccagagcgtgagccccaccagcttcctgaccatcagcaacgagggcagcgaggagagcccctgcagcgccgacgacctgctggtggaccccagagacaaggagaacggcaacaacagccccctgcccaagtacgccaccagccccaagcccaacaacagctacatgttcaagagagagccccccgagggctgcgagagagtgaaggtgttcgaggagtgcagccccaagcagctgcacgagatccccgccttctactgccccgacaagaacaaggtgaacttcatccccaagagcggcagcgccttctgcctggtgagcatcctgaagcccctgctgcccacccccgacctgaccctgaagggcagcggccacagcctgaccgtgaccaccggcatgaccaccaccctgctgcagcccatcgccgtggccagcctgagcaccaacaccgagcaggacagagtgagcagaggcaccagcaccgtgatgcccagcgccagcctgctgcccccccccgagcccatcgaggaggccgagggctag

SEQ ID NO: 20860 - DNA, 1770 bp, Artificial Sequence
  Description of Artificial Sequence: Synthetic coding sequence
atgagccagagagtgagaagaaacggcagccccacccccgccggcagcctgggcggcggcgccgtggccaccgccggcggccccggcagcagactgcagcccatgagagccaccgtgcccttccagctgaagcagcagcagcagcagcagcacggcagccccaccagaagcggcggcggcggcggcggcaacaacaacggcggctgctgcggcggcgccagcggccccgccggcggcggcggcggcggcggccccagaaccgccagcagaagcaccagccccaccagaggcggcggcaacgccgccgccagaaccagccccaccgtggccacccagaccggcgccagcgccaccagcaccagaggcaccagccccaccagaagcgccgcccccggcgccagaggcagcccccccagaccccccccccccccccccctgctgggcaccgtgagcagccccagcagcagccccacccacctgtggaccggcgaggtgagcgccgcccccccccccgccagagtgagacacagaagaagaagccccgagcagagcagaagcagccccgagaagagaagccccagcgcccccgtgtgcaaggccggcgacaagaccagacagcccagcagcagccccagcagcatcatcagaagaaccagcagcctggacaccctggccgccccctacctggccggccactggcccagagacagccacggccaggccgccccctgcatgagagacaaggccacccagaccgagagcgcctgggccgaggagtacagcgagaagaagaagggcagccacaagagaagcgccagctggggcagcaccgaccagctgaaggagatcgccaagctgagacagcagctgcagagaagcaagcacagcagcagacaccacagagacaaggagagacagagccccttccacggcaaccacgccgccatcaaccagtgccaggcccccgtgcccaagagcgccctgatccccgtgatccccatcaccaagagcaccggcagcagattcagaaacagcgtggagggcctgaaccaggagatcgagatcatcatcaaggagaccggcgagaaggaggagcagctgatcccccaggacatccccgacggccacagagcccccccccccctggtgcagagaagcagcagcaccagaagcatcgacacccagacccccggcggcgccgacagaggcagcaacaacagcagcagaagccagagcgtgagccccaccagcttcctgaccatcagcaacgagggcagcgaggagagcccctgcagcgccgacgacctgctggtggaccccagagacaaggagaacggcaacaacagccccctgcccaagtacgccaccagccccaagcccaacaacagctacatgttcaagagagagccccccgagggctgcgagagagtgaaggtgttcgaggagtgcagccccaagcagctgcacgagatccccgccttctactgccccgacaagaacaaggtgaacttcatccccaagagcggcagcgccttctgcctggtgagcatcctgaagcccctgctgcccacccccgacctgaccctgaagggcagcggccacagcctgaccgtgaccaccggcatgaccaccaccctgctgcagcccatcgccgtggccagcctgagcaccaacaccgagcaggacagagtgagcagaggcaccagcaccgtgatgcccagcgccagcctgctgcccccccccgagcccatcgaggaggccgagggctag

SEQ ID NO: 20861 - DNA, 1056 bp, Artificial Sequence
  Description of Artificial Sequence: Synthetic coding sequence
atggccagcaccggcagccaggccagcgacatcgacgagatcttcggcttcttcaacgacggcgagccccccaccaagaagcccagaaagctgctgcccagcctgaagaccaagaagcccagagagctggtgctggtgatcggcaccggcatcagcgccgccgtggccccccaggtgcccgccctgaagagctggaagggcctgatccaggccctgctggacgccgccatcgacttcgacctgctggaggacgaggagagcaagaagttccagaagtgcctgcacgaggacaagaacctggtgcacgtggcccacgacctgatccagaagctgagccccagaaccagcaacgtgagaagcaccttcttcaaggactgcctgtacgaggtgttcgacgacctggagagcaagatggaggacagcggcaagcagctgctgcagagcgtgctgcacctgatggagaacggcgccctggtgctgaccaccaacttcgacaacctgctggagctgtacgccgccgaccagggcaagcagctggagagcctggacctgaccgacgagaagaaggtgctggagtgggcccaggagaagagaaagctgagcgtgctgcacatccacggcgtgtacaccaaccccagcggcatcgtgctgcaccccgccggctaccagaacgtgctgagaaacaccgaggtgatgagagagatccagaagctgtacgagaacaagagcttcctgttcctgggctgcggctggaccgtggacgacaccaccttccaggccctgttcctggaggccgtgaagcacaagagcgacctggagcacttcatgctggtgagaagaggcgacgtggacgagttcaagaagctgagagagaacatgctggacaagggcatcaaggtgatcagctacggcgacgactacgccgacctgcccgagtacttcaagagactgacctgcgagatcagcaccagaggcaccagcgccggcatggtgagagagggccagctgaacggcagcagcgccgcccacagcgagatcagaggctgcagcacctag

SEQ ID NO: 20862 - DNA, 222 bp, Artificial Sequence
  Description of Artificial Sequence: Synthetic coding sequence
atgagactgatcctgaacctgtgcagaggcgccggctgcaacagacaggccgtggccggccagctgctgcccagcacctggagcctgcacgcccacggcctggccaaggaggcccccatcctgcccgtgaagaagatcagcagaagctgcagcgtgaacaacaaggtgagcaagaagaccaccaagccccccaccctgagaagcttcctgagccccatctag

SEQ ID NO: 20863 - DNA, 771 bp, Artificial Sequence
  Description of Artificial Sequence: Synthetic coding sequence
atgggcaagaccaaggacatcggcgacgacgacaccgtggccagcgagttctggagcggcgccctgagccagcccagcagcgtgcccaccagacccagaacccccaacagagacagctggagaagagcctgggccgccagaggcctgcaccccagacccagcatcctgcagcccggccccgccagactgagcagagccagagccggcggcaccagatgcccccagagaagacacggcagagccaccttctgcgccctgggcagaggcatcggcgtgagaagaggccccggccccagacccgccagaatccccggcctgaccctgacctggaagagaatgagcgccagaagaatgcagtgggccatgcagaccggcggcagaaaccagaccttcggcggcggcgtgcccctgttctggacctggctgaccatctgctgcgccgtgtggagaagcctgccctgcagactgacccacagctgcagcagagccttcagcagcgcccccctgaagaagaccaagagcagcatgctgccccccaagcaggccctggccagcgccgccagaaacctgtgcagaggcgccggctgcaacagacaggccgtggccggccagctgctgcccagcacctggagcctgcacgcccacggcctggccaaggaggcccccatcctgcccgtgaagaagatcagcagaagctgcagcgtgaacaacaaggtgagcaagaagaccaccaagccccccaccctgagaagcttcctgagccccatctag

SEQ ID NO: 20864 - DNA, 816 bp, Artificial Sequence
  Description of Artificial Sequence: Synthetic coding sequence
atggcccaggagaagatggagctggacctggagctgccccccggcaccggcggcagccccgccgagggcggcggcagcggcggcggcggcggcctgagaagaagcaacagcgcccccctgatccacggcctgagcgacaccagccccgtgttccaggccgaggcccccagcgccagaagaaacagcaccaccttccccagcagactgcaccagatcaagcaggaggagggcatggacctgatcaacagagagaccgtgcacgagagagaggtgcagaccgccatgcagatcagccacagctgggaggagagcttcagcctgagcgacaacgacgtggagaagagcgccagccccaagagaatcgacttcatccccgtgagccccgcccccagccccaccagaggcatcggcaagcagtgcttcagccccagcctgcagagcttcgtgagcagcaacggcctgccccccagccccatccccagccccaccaccagattcaccaccagaagaagccagagccccatcaactgcatcagacccagcgtgctgggccccctgaagagaaagtgcgagatggagaccgagtaccagcccaagagattcttccagggcatcaccaacatgctgagcagcgacgtggcccagctgagcgaccccggcgtgtgcgtgagcagcgacaccctggacggcaacagcagcagcgccggcagcagctgcaacagccccgccaaggtgagcaccaccaccgacagccccgtgagccccgcccaggccgccagccccttcatccccctggacgagctgagcagcaagtag

SEQ ID NO: 20865 - DNA, 864 bp, Artificial Sequence
  Description of Artificial Sequence: Synthetic coding sequence
atggcccaggagaagatggagctggacctggagctgccccccggcaccggcggcagccccgccgagggcggcggcagcggcggcggcggcggcctgagaagaagcaacagcgcccccctgatccacggcctgagcgacaccagccccgtgttccaggccgaggcccccagcgccagaagaaacagcaccaccttccccagcagacacggcctgctgctgcccgccagccccgtgagaatgcacagcagcagactgcaccagatcaagcaggaggagggcatggacctgatcaacagagagaccgtgcacgagagagaggtgcagaccgccatgcagatcagccacagctgggaggagagcttcagcctgagcgacaacgacgtggagaagagcgccagccccaagagaatcgacttcatccccgtgagccccgcccccagccccaccagaggcatcggcaagcagtgcttcagccccagcctgcagagcttcgtgagcagcaacggcctgccccccagccccatccccagccccaccaccagattcaccaccagaagaagccagagccccatcaactgcatcagacccagcgtgctgggccccctgaagagaaagtgcgagatggagaccgagtaccagcccaagagattcttccagggcatcaccaacatgctgagcagcgacgtggcccagctgagcgaccccggcgtgtgcgtgagcagcgacaccctggacggcaacagcagcagcgccggcagcagctgcaacagccccgccaaggtgagcaccaccaccgacagccccgtgagccccgcccaggccgccagccccttcatccccctggacgagctgagcagcaagtag

SEQ ID NO: 20866 - DNA, 726 bp, Artificial Sequence
  Description of Artificial Sequence: Synthetic coding sequence
atggcccaggagaagatggagctggacctggagcccgacaccagctacggcggcaccctgagaagaagcagcagcgcccccctgatccacggcctgagcgacctgagccaggtgttccagccctacaccctgagaaccagaagaaacagcaccaccatcatgagcagacacagcctgctgctgagcagcagccccaacagaatccccagcagcagactgcaccagatcaagagagaggagggcctggacatggtgaacagagagaccgcccacgagagagagatgcagaccgccatgcagatcagccagagctgggacgagagcctgagcctgagcgacagcgacttcgacaagcccgagaagctgtacagccccaagagaatcgacttcacccccgtgagccccgcccccagccccaccagaggcttcggcaagatgttcgtgagcagcagcggcctgccccccagccccgtgcccagccccagaagattcagcagaagaagccagagccccgtgaagtgcatcagacccagcgtgctgggccccctgaagagaaagggcgagatggagaccgagagccagcccaagagactgttccagggcaccaccaacatgctgagccccgacgccgcccagctgagcgacctgagcagctggtggtgctaccagggcgaggagatccccgccctgaccagatgcgtggagcacctgcagatgaacgagtag

SEQ ID NO: 20867 - DNA, 801 bp, Artificial Sequence
  Description of Artificial Sequence: Synthetic coding sequence
atggcccaggagaagatggagctggacctggagcccgacaccagctacggcggcaccctgagaagaagcagcagcgcccccctgatccacggcctgagcgacctgagccaggtgttccagccctacaccctgagaaccagaagaaacagcaccaccatcatgagcagacacagcctgctgctgagcagcagccccaacagaatccccagcagcagactgcaccagatcaagagagaggagggcctggacatggtgaacagagagaccgcccacgagagagagatgcagaccgccatgcagatcagccagagctgggacgagagcctgagcctgagcgacagcgacttcgacaagcccgagaagctgtacagccccaagagaatcgacttcacccccgtgagccccgcccccagccccaccagaggcttcggcaagatgttcgtgagcagcagcggcctgccccccagccccgtgcccagccccagaagattcagcagaagaagccagagccccgtgaagtgcatcagacccagcgtgctgggccccctgaagagaaagggcgagatggagaccgagagccagcccaagagactgttccagggcaccaccaacatgctgagccccgacgccgcccagctgagcgacctgagcagctgcagcgacatcctggacggcagcagcagcagcagcggcctgagcagcgaccccctggccaagggcagcgccaccgccgagagccccgtggcctgcagcaacagctgcagcagcttcatcctgatggacgacctgagccccaagtag

SEQ ID NO: 20868 - DNA, 198 bp, Artificial Sequence
  Description of Artificial Sequence: Synthetic coding sequence
atggcccaggagaagatggagctggacctggagcccgacaccagctacggcggcaccctgagaagaagcagcagcgcccccctgatccacggcctgagcgacctgagccaggtgttccagccctacaccctgagaaccagaagaaacagcaccaccatcatgagcagacacagcctgctgcacatctggcacttctag

SEQ ID NO: 20869 - DNA, 744 bp, Artificial Sequence
  Description of Artificial Sequence: Synthetic coding sequence
atggcccaggagaagatggagctggacctggagcccgacaccagctacggcggcaccctgagaagaagcagcagcgcccccctgatccacggcctgagcgacctgagccaggtgttccagccctacaccctgagaaccagaagaaacagcaccaccatcatgagcagacacagcctggaggagggcctggacatggtgaacagagagaccgcccacgagagagagatgcagaccgccatgcagatcagccagagctgggacgagagcctgagcctgagcgacagcgacttcgacaagcccgagaagctgtacagccccaagagaatcgacttcacccccgtgagccccgcccccagccccaccagaggcttcggcaagatgttcgtgagcagcagcggcctgccccccagccccgtgcccagccccagaagattcagcagaagaagccagagccccgtgaagtgcatcagacccagcgtgctgggccccctgaagagaaagggcgagatggagaccgagagccagcccaagagactgttccagggcaccaccaacatgctgagccccgacgccgcccagctgagcgacctgagcagctgcagcgacatcctggacggcagcagcagcagcagcggcctgagcagcgaccccctggccaagggcagcgccaccgccgagagccccgtggcctgcagcaacagctgcagcagcttcatcctgatggacgacctgagccccaagtag

SEQ ID NO: 20870 - DNA, 336 bp, Artificial Sequence
  Description of Artificial Sequence: Synthetic coding sequence
atggcccaggagaagatggagctggacctggagcccgacaccagctacggcggcaccctgagaagaagcagcagcgcccccctgatccacggcctgagcgacctgagccaggtgttccagccctacaccctgagaaccagaagaaacagcaccaccatcatgagcagacacagcctgctgctggtgcccaagggctacatggagagagtggacaagatctacaagagacaccaggaggagggcctggacatggtgaacagagagaccgcccacgagagagagatgcagaccgccatgcagatcagccagagctgggacgagagcctgagcctgtag

SEQ ID NO: 20871 - DNA, 747 bp, Artificial Sequence
  Description of Artificial Sequence: Synthetic coding sequence
atggcccaggagaagatggagctggacctggagcccgacaccagctacggcggcaccctgagaagaagcagcagcgcccccctgatccacggcctgagcgacctgagccaggtgttccagccctacaccctgagaaccagaagaaacagcaccaccatcatgagcagacacagcctggaggagggcctggacatggtgaacagagagaccgcccacgagagagagatgcagaccgccatgcagatcagccagagctgggacgagagcctgagcctgagcgacagcgacttcgacaagcccgagaagctgtacagccccaagagaatcgacttcacccccgtgagccccgcccccagccccaccagaggcttcggcaagatgttcgtgagcagcagcggcctgccccccagccccgtgcccagccccagaagattcagcagcagaagaagccagagccccgtgaagtgcatcagacccagcgtgctgggccccctgaagagaaagggcgagatggagaccgagagccagcccaagagactgttccagggcaccaccaacatgctgagccccgacgccgcccagctgagcgacctgagcagctgcagcgacatcctggacggcagcagcagcagcagcggcctgagcagcgaccccctggccaagggcagcgccaccgccgagagccccgtggcctgcagcaacagctgcagcagcttcatcctgatggacgacctgagccccaagtag

SEQ ID NO: 20872 - DNA, 588 bp, Artificial Sequence
  Description of Artificial Sequence: Synthetic coding sequence
atggcccaggagaagatgaagctgggcttcaagagcctgcccagcagcaccaccgccgacggcaacatcctgagaagagtgaacagcgcccccctgatcaacggcctgggcttcaacagccaggtgctgcaggccgacatgctgagaatcagaaccaacagaaccaccttcagaaacagaagaagcctgctgctgccccccccccccttccacggcagcatcagcagactgcaccagatcaagcaggaggaggccatggacctgatcaacagagagaccatgagcgagtggaagctgcagagcgagatccagatcagccacagctgggaggagggcctgaagctggtgaagtggcacttcaacatcaaccagaagagattcagcaaggcccagcccacctgcttcctgctgatcctgcccaactgccagaagatcatgtgcatctacttccagctgctgctgatggagaccaccgccatgctggacctgctggtgatcagacagctgaagagcgccctgagccagaccctgctgtgccacctgctgatcctggtgctgatctgcagcagcagacagaccttcaactag

SEQ ID NO: 20873 - DNA, 459 bp, Artificial Sequence
  Description of Artificial Sequence: Synthetic coding sequence
atggcccaggagaagatgaagctgggcttcaagagcctgcccagcagcaccaccgccgacggcaacatcctgagaagagtgaacagcgcccccctgatcaacggcctgggcttcaacagccaggtgctgcaggccgacatgctgagaatcagaaccaacagaaccaccttcagaaacagaagaagcctgctgctgccccccccccccttccacggcagcatcagcagactgcaccagatcaagcaggaggaggccatggacctgatcaacagagagaccatgagcgagtggaagctgcagagcgagatccagatcagccacagctgggaggagggcctgaagctgaacgacaacggcctgcagaagagcagcagcctgaagtgcatcgacctgacccccgtgagcagcatggccagcagcatcaagaagaccggcaagagcaccagcagctacttctag

SEQ ID NO: 20874 - DNA, 348 bp, Artificial Sequence
  Description of Artificial Sequence: Synthetic coding sequence
atggcctacttccccggcaccggcagaaccgaccaggagacccagctggacctgagcctgtgcggcagagagcccgagagcctggagaacctgttcctggaccccgacatggcccaggagaagatgaagctgggcttcaagagcctgcccagcagcaccaccgccgacggcaacatcctgagaagagtgaacagcgcccccctgatcaacggcctgggcttcaacagccaggtgctgcaggccgacatgctgagaatcagaaccaacagaaccaccttcagaaacagaagaagcctggagatcaccagccccaccagcgtggagcagaagcccaaggacctgttctag

SEQ ID NO: 20875 - DNA, 558 bp, Artificial Sequence
  Description of Artificial Sequence: Synthetic coding sequence
atggacctgatcaacagagagaccatgagcgagtggaagctgcagagcgagatccagatcagccacagctgggaggagggcctgaagctgaacgacaacggcctgcagaagagcagcagcctgaagtgcatcgacctgacccccgtgagcagcatggccagcagcatcaagaagaccggcaagcagtgcttcagccccagcctgcagacctgcgtgagctgcaccggcagccccagcagccccatccccagccccatgcagcagtacatcatcagaagccagaaccccaccaacatcatcagacccagcatcctgggccccctgaagagaaagggcgagatggccttccagtaccagcccaagaagatcttccagggcaccaccaacatgctgagcagcgacaccagccagctgagcgagaacaacgtgtacctgctgcccgccaccttcgacggcaacgacagcaacgccggcagcagcggcaacagcagcgccgagatcggcaccgtgaccaacagccccgtgagccccagcgacaccggcagccacctgttctag

SEQ ID NO: 20876 - DNA, 1659 bp, Artificial Sequence
  Description of Artificial Sequence: Synthetic coding sequence
atggagaccagcagaagcagaggcggcggcggcgccgtgagcgagagaggcggcgccggcgccagcgtgggcgtgtgcagaagaaaggccgaggccggcgccggcaccggcaccctggccgccgacatggacctgcactgcgactgcgccgccgagacccccgccgccgagccccccagcggcaagatcaacaaggccgccttcaagctgttcaagaagagaaagagcggcggcaccatgcccagcatcttcggcgtgaagaacaagggcgacggcaagagcagcggccccaccggcctggtgagaagcagaacccacgacggcctggccgaggtgctggtgctggagagcggcagaaaggaggagcccagaggcggcggcgacagcggcggcggcggcggcggcagacccaaccccggcccccccagagccgccggccccggcggcggcagcctggccagcagcagcgtggccaagagccacagcttcttcagcctgctgaagaagaacggcagaagcgagaacggcaagggcgagcccgtggacgccagcaaggccggcggcaagcagaagagaggcctgagaggcctgttcagcggcatgagatggcacagaaaggacaagagagccaaggccgaggccgccgagggcagagcccccggcggcggcctgatcctgcccggcagcctgaccgccagcctggagtgcgtgaaggaggagacccccagagccgccagagagcccgaggagcccagccaggacgcccccagagaccccgccggctgcggcgacatcatcgccgaccaggaggaggaggccggccccagctgcgacaagcacgtgcccggccccggcaagcccgccctgagcaagaagaaccccggcgtggtggcctaccagggcggcggcgaggagatggccagccccgacgaggtggacgacacctacctgcaggagttctgggacatgctgagccagaccgaggagcagggccccgagccccaggagggcgccgccaaggtggccgccgccctggagaccaaggtggtgcccgagacccccaaggacaccagatgcgtggaggccgccaaggacgccagcagcgtgaagagaagaagactgaacagaatccccatcgagccccaccccaaggaggagcccaagcaccccgagaaggagcagcaggagggcgtgcccaacagcgacgagggctactgggacagcaccacccccggccccgaggaggacagcagcagcagcggcaagaaggccggcatccccagagacagctacagcggcgacgccctgtacgacctgtacgccgaccccgacggcagccccgccaccctgcccggcggcaaggacaacgaggagaccagcagcctgagcagactgaagcccgtgagccccggcaccatcacctgccccctgagaacccccggcagcctgctgaaggacagcaagatccccatcagcatcaagcacctgaccaacctgcccagcagccaccccgtggtgcaccagcagcccagcagaagcgagatgcccagaaccaagatccccgtgagcaaggtgctggtgagaagagtgagcaacagaggcctggccggcaccaccatcagagccaccgcctgccacgacagcgccaagaagctgtag

SEQ ID NO: 20877 - DNA, 1659 bp, Artificial Sequence; identical to SEQ ID NO: 20876
  Description of Artificial Sequence: Synthetic coding sequence

SEQ ID NO: 20878 - DNA, 2016 bp, Artificial Sequence
  Description of Artificial Sequence: Synthetic coding sequence
atggagaccagcagaagcagaggcggcggcggcgccgtgagcgagagaggcggcgccggcgccagcgtgggcgtgtgcagaagaaaggccgaggccggcgccggcaccggcaccctggccgccgacatggacctgcactgcgactgcgccgccgagacccccgccgccgagccccccagcggcaagatcaacaaggccgccttcaagctgttcaagaagagaaagagcggcggcaccatgcccagcatcttcggcgtgaagaacaagggcgacggcaagagcagcggccccaccggcctggtgagaagcagaacccacgacggcctggccgaggtgctggtgctggagagcggcagaaaggaggagcccagaggcggcggcgacagcggcggcggcggcggcggcagacccaaccccggcccccccagagccgccggccccggcggcggcagcctggccagcagcagcgtggccaagagccacagcttcttcagcctgctgaagaagaacggcagaagcgagaacggcaagggcgagcccgtggacgccagcaaggccggcggcaagcagaagagaggcctgagaggcctgttcagcggcatgagatggcacagaaaggacaagagagccaaggccgaggccgccgagggcagagcccccggcggcggcctgatcctgcccggcagcctgaccgccagcctggagtgcgtgaaggaggagacccccagagccgccagagagcccgaggagcccagccaggacgcccccagagaccccgccggcgagcccgccggcggcgaggaggtgcccgcccccgccgacagagcccccgccagaagctgcagagaggccgagggcctggcccaccccggcgacaccggcgccagaggcgaggacgccgccggccacagaagagccgagcccggccccggcgaggtgagaaccgccgaggacgccagcagaaccggcgccgtgcccgtgaagaccgtgcccctggtggacagcgagggcggcagcggcagagcccccgccgcccccgaccccgccagcgtggacccccccagcgaccccagcgccgacagaatctgcctgatgttcagcgacgtgaccagcctgaagagcttcgacagcctgaccggctgcggcgacatcatcgccgaccaggaggaggaggccggccccagctgcgacaagcacgtgcccggccccggcaagcccgccctgagcaagaagaaccccggcgtggtggcctaccagggcggcggcgaggagatggccagccccgacgaggtggacgacacctacctgcaggagttctgggacatgctgagccagaccgaggagcagggccccgagccccaggagggcgccgccaaggtggccgccgccctggagaccaaggtggtgcccgagacccccaaggacaccagatgcgtggaggccgccaaggacgccagcagcgtgaagagaagaagactgaacagaatccccatcgagccccaccccaaggaggagcccaagcaccccgagaaggagcagcaggagggcgtgcccaacagcgacgagggctactgggacagcaccacccccggccccgaggaggacagcagcagcagcggcaagaaggccggcatccccagagacagctacagcggcgacgccctgtacgacctgtacgccgaccccgacggcagccccgccaccctgcccggcggcaaggacaacgaggagaccagcagcctgagcagactgaagcccgtgagccccggcaccatcacctgccccctgagaacccccggcagcctgctgaaggacagcaagatccccatcagcatcaagcacctgaccaacctgcccagcagccaccccgtggtgcaccagcagcccagcagaagcgagatgcccagaaccaagatccccgtgagcaaggtgctggtgagaagagtgagcaacagaggcctggccggcaccaccatcagagccaccgcctgccacgacagcgccaagaagctgtag

SEQ ID NO: 20879 - DNA, 2586 bp, Artificial Sequence
  Description of Artificial Sequence: Synthetic coding sequence
atggagctgaagagaggcaagaccttcatcaagagcagcctgcaggtgagccacgagaagccccccgaccccgccgccgtggccgccgccagagagggcaccggcccctggagcgtgctgcccggcggccagcagagaccccacagcgagaagggcccccaggccagccccagcgcccaggagtacgacagatgccccaacaagggcgcccagctggaccccaagggcggccccgccgccctgtgcggcgccaccttcaagcccgtgagaaagtgcaagacccacgacagcatgagcggcgccggcagagccaccgccgccaccggccagctggtgggcagcgccagcttccccggcagccccggcagcagaagaatgatcgactacagacacttcgtgccccagatgcccttcgtgcccgccgtggccaagagcatccccagaaagagaatcagcctgaagagacccaagaagtgcttcagaaacctgttccacatcagaagaaacaagaccgaggacctggccagcctggccgccgagggcaagagcctgcccagccccggcgaccccagcgaccccggcggcagaagaagcaaggccttcctgccccccggcgagggccccggcctggacggcctgtgccaggacctgctggacagcgagctgctggccgacgccagcttcggcctgtgcagagccctgtgcgaggacgtggccagcctgcagagcttcgacagcctgaccggctgcggcgaggtgttcgccgacgagagcagcgtgcccagcctggagctgaacgagggccccgagagccccacccaggccgcccagggcctggagagcaaggtgcccagaggccccctgcagggcagcgtggagcagctggccagccccgcccagaacgaggccagcgacttcaccagattctgggacagcgtgaacagaagcgtgagacagcagcagagagccctgctgggcccctggctgagcggcccccagggcaccgacagagaccagagcagactggacaccgccggcctggccgagctgcccctgtgcccctgcagagaccccagaagcggcagcaaggccagcagcatcgacaccggcacccccaagagcgagcagcccgagagcgtgagcaccagcgacgagggctactacgacagcttcagccccggcctggaggaggacaagaaggaggccgagagccccggcacccccgccgccaccttccccagagacagctacagcggcgacgccctgtacgagctgttccacgaccccagcgagggccccctgggccccagccccgacgacgacctgtgcgtgagcgagagcctgagcggccccgccctgggcacccccctgagcatctgcagcttcagagtgggcgccgaggagaacctggcccccgcccccggccccgacctgctgagccagggcttcctgcagagcagctggaagggcaaggagtgcctgctgaagctgtgcgacaccgagctggccatcaccatgggcatcgtgagctggctgagaagaggccccacccccagagccccccccacccccggccagcccgccgccccccccggcagccagggcgcccccagagcccccaccgagaagctgggcggcagagagggcctggccagcgacgccggcggcgccaccgtgtgcagcgcccccagcagacaggagctgtgggcccaccccggcaccaccggcctgctggccggcgagagcaaggccctgggcggcgccacccagggcaccggcaccctgagcagagacgccagcagagaggaggagaccagaggccacagcgagggcctgttcagcagcatggagagcgccgccaccagcaccaccgacaccagcggcaagaacaaggcccccgtgcccagcacctggccctgcagccagaaggagcccggcccccccggcgtgctgggctgcttcagaggcccctggagacccggccacggcggcgacaccctggacgccgagcccatgctggccggctgcgtggccagagtggccgccctgaagatcagcagcaacgagcagccccccgccgcctggccccccagacaggacatgggcagcggcctgttcggccagagatgggccagaggccccgacatgctggagcagaagcagagcagcagcagccccagcatgaccaccatccacggcctgccctacagcgccagcacccaggaccagagatgcagagacagagtgcaggacctgagctggctgagagtggagcccaccggcctgggcgtgcaggcctgggccagcgtggaggaccagcccctgcagctgagcaccgaggccgtggagcaggtggcccacggcagccagctggacagcgagcccagaagcgcccccgccgccagatggagcagccagggccaccaccccgagagcctgggcctgaccctgaacagccagcaggagggcggcgtgagcgccagcgcccccgagtgcagatgcagcctgctggccagagagggcctgctgtgcggccagcccgaggtgggcgccagcggccccgccatggccgagccccacctgtag

SEQ ID NO: 20880 - DNA, 2586 bp, Artificial Sequence; identical to SEQ ID NO: 20879
  Description of Artificial Sequence: Synthetic coding sequence

SEQ ID NO: 20881 - DNA, 429 bp, Artificial Sequence
  Description of Artificial Sequence: Synthetic coding sequence
atggagctgaagagaggcaagaccttcatcaagagcagcctgcaggtgagccacgagaagccccccgaccccgccgccgtggccgccgccagagagggcaccggcccctggagcgtgctgcccggcggccagcagagaccccacagcgagaagggcccccaggccagccccagcgcccaggagtacgacagatgccccaacaagggcgcccagctggaccccaagggcggccccgccgccctgtgcggcgccaccttcaagcccgtgagaaagtgcaagacccacgacagcatgagcggcgccggcagagccaccgccgccaccggccagctggtgggcagcgccagcttccccggcagccccggcagcagaagaatgatcgactacagacacttcgtgccccagatgcccttcgtgcccgccgtgtag

SEQ ID NO: 20882 - DNA, 543 bp, Artificial Sequence
  Description of Artificial Sequence: Synthetic coding sequence
atggagctgaagagaggcaagaccttcatcaagagcagcctgcaggtgagccacgagaagccccccgaccccgccgccgtggccgccgccagagagggcaccggcccctggagcgtgctgcccggcggccagcagagaccccacagcgagaagggcccccaggccagccccagcgcccaggagtacgacagatgccccaacaagggcgcccagctggaccccaagggcggccccgccgccctgtgcggcgccaccttcaagcccgtgagaaagtgcaagacccacgacagcatgagcggcgccggcagagccaccgccgccaccggccagctggtgggcagcgccagcttccccggcagccccggcagcagaagaatgatcgactacagacacttcgtgccccagatgcccttcgtgcccgccgtggccaagagcatccccagaaagagaatcagcctgaagagacccaagaagtgcttcagaaacctgttccacatcagaagaaacaagaccgaggacctggccagcctggccgccgagtag

SEQ ID NO: 20883 - DNA, 1749 bp, Artificial Sequence
  Description of Artificial Sequence: Synthetic coding sequence
atggaccccaaggccggcggcggcggcgaggaggacgactgcgtggacagcggcgccgagaccggcggcagcgactacagccacctgagcagcaccagcaacggcttcagcacctggagaatgccctgctgcctgttcctgtactgcacccacggcgacaaggagaagggcagatggagcctgcaggtggagcacacctggcccagcggcgagctgagcgtggaggaggcccaggaccccttcctggtgagcatccacatcatcgccgaccccggcgagagccagcccctgcaggaggccatcgacaacgtgctggcctggatccaccccgacctgcccctgttcagagtgagcgagagaagagccagcagaagaagaagaaagccccccaagggcgcccagcccgccctggccgtggtgctgttcctgcaggaggagtacggcgaggagcagatcctgcagctgcacagaaccctgcagcagcccccctggagacaccaccacaccgagcaggtgcacggcagattcctgccctacctgccctgcagccaggacttcttcaccctggcccccggcacccccctgtgggccatcagacccgtgcactacggcaaggagatcgtgagattcaccgtgtactgcagatacgacaactacgccgacagcctgagattctaccagctgatcctgagaagaagccccagccagaagaaggccgacttctgcatcttccccatcttcagcaacctggacgtggacatccagttcagcctgaagagactgccctgcgaccagtgccccgtgcccaccgacagcagcgtgctggagttcagagtgagagacatcggcgagctggtgcccctgctgcccaacccctgcagccccatcagcgagggcagatggcagaccgaggaccacgacggcaacaagatcctgctgcaggcccagagagtgcacaagaagttccccaagcccggcagagtgcaccacgccagcgagaagaagagacacagcacccccctgcccagcaccgccgtgcccagccacacccccggcagcagccagcagagccccctgaacagcccccaccccggccccatcagaaccggcctgccccccggccaccagcaggagttcgccggcagagccaacagcacccccaaccccccctggagcttccagagaagcaagagcctgttctgcctgcccaccggcggccccagcctggccagcagcgccgagccccagtggttcagcaacaccggcgcccccggccacagagccagcgagtggagacacggccacctgctgagcatcgacgacctggagggcgcccaggagaccgacgtggacaccggcctgagactgagcagcagcgacctgagcgtggtgagcgcctacagcgcccccagcagattctgcagcaccgtggagacccccctgcccagcgagagatgcagcagccactgggccgcccacaaggacagcagagagggccccctgcccaccgtgagcagagtgaccaccgaggccagctgggccagcctgcccttcttcaccaagagaagcagcagcagcagcgccaccgccagagccgccccccccgcccccagcaccagcaccctgaccgacagcagcccccagctgccctgcgacacccccaaggtgaagcagaccgacggcgacatgccccccccccccggcagcgccggccccggcgacaacgacatggaggagttctacatctag

SEQ ID NO: 20884 - DNA, 1641 bp, Artificial Sequence
  Description of Artificial Sequence: Synthetic coding sequence
atggaccccaaggccggcggcggcggcgaggaggacgactgcgtggacagcggcgccgagaccggcggcagcgactacagccacctgagcagcaccagcagcgagctgagcgtggaggaggcccaggaccccttcctggtgagcatccacatcatcgccgaccccggcgagagccagcccctgcaggaggccatcgacaacgtgctggcctggatccaccccgacctgcccctgttcagagtgagcgagagaagagccagcagaagaagaagaaagccccccaagggcgcccagcccgccctggccgtggtgctgttcctgcaggaggagtacggcgaggagcagatcctgcagctgcacagaaccctgcagcagcccccctggagacaccaccacaccgagcaggtgcacggcagattcctgccctacctgccctgcagccaggacttcttcaccctggcccccggcacccccctgtgggccatcagacccgtgcactacggcaaggagatcgtgagattcaccgtgtactgcagatacgacaactacgccgacagcctgagattctaccagctgatcctgagaagaagccccagccagaagaaggccgacttctgcatcttccccatcttcagcaacctggacgtggacatccagttcagcctgaagagactgccctgcgaccagtgccccgtgcccaccgacagcagcgtgctggagttcagagtgagagacatcggcgagctggtgcccctgctgcccaacccctgcagccccatcagcgagggcagatggcagaccgaggaccacgacggcaacaagatcctgctgcaggcccagagagtgcacaagaagttccccaagcccggcagagtgcaccacgccagcgagaagaagagacacagcacccccctgcccagcaccgccgtgcccagccacacccccggcagcagccagcagagccccctgaacagcccccaccccggccccatcagaaccggcctgccccccggccaccagcaggagttcgccggcagagccaacagcacccccaaccccccctggagcttccagagaagcaagagcctgttctgcctgcccaccggcggccccagcctggccagcagcgccgagccccagtggttcagcaacaccggcgcccccggccacagagccagcgagtggagacacggccacctgctgagcatcgacgacctggagggcgcccaggagaccgacgtggacaccggcctgagactgagcagcagcgacctgagcgtggtgagcgcctacagcgcccccagcagattctgcagcaccgtggagacccccctgcccagcgagagatgcagcagccactgggccgcccacaaggacagcagagagggccccctgcccaccgtgagcagagtgaccaccgaggccagctgggccagcctgcccttcttcaccaagagaagcagcagcagcagcgccaccgccagagccgccccccccgcccccagcaccagcaccctgaccgacagcagcccccagctgccctgcgacacccccaaggtgaagcagaccgacggcgacatgccccccccccccggcagcgccggccccggcgacaacgacatggaggagttctacatctag

SEQ ID NO: 20885 - DNA, 819 bp, Artificial Sequence
  Description of Artificial Sequence: Synthetic coding sequence
atggacgagacccagggccccctggccatgaccgtgcacctgctggccaacagcggccacggcagcctgctgcagagaaccctggaccagctgctggactgcatctgccccgaggtgagactgttccaggtgagcgagagagccagccccgtgaagtactgcgagaagagccacagcaagagaagcagattccccggcatgagcgtgctgctgttcctgcacgagagccccggcgaggacagactgttcagagtgctggacagcctgcagcacagcccctggcagtgctaccccacccaggacaccagaggcagactgtgcccctacttcttcgccaaccaggagttctacagcctggacagccagctgcccatctggggcgtgagacaggtgcactgcggcagcgagatcctgagagtgaccctgtactgcagcttcgacaactacgaggacgccatcagactgtacgagatgatcctgcagagagaggccaccctgcagaagagcaacttctgcttcttcgtgctgtacgccagcaagagcttcgccctgcagctgagcctgaagcagctgccccccggcatgagcgtggaccccaaggagagcagcgtgctgcagttcaaggtgcaggagatcggccagctggtgcccctgctgcccaacccctgcatgcccatcagcagcaccagatggcagacccaggactacgacggcaacaagatcctgctgcagagatgggagagcagcagcgtggcccagaccagagtgagatggtgccaccacagcagcctgagaagcagccccagcggcttcaagtag

SEQ ID NO: 20886 - DNA, 819 bp, Artificial Sequence; identical to SEQ ID NO: 20885
  Description of Artificial Sequence: Synthetic coding sequence

SEQ ID NO: 20887 - DNA, 1368 bp, Artificial Sequence
  Description of Artificial Sequence: Synthetic coding sequence
atggacgagacccagggccccctggccatgaccgtgcacctgctggccaacagcggccacggcagcctgctgcagagaaccctggaccagctgctggactgcatctgccccgaggtgagactgttccaggtgagcgagagagccagccccgtgaagtactgcgagaagagccacagcaagagaagcagattccccggcatgagcgtgctgctgttcctgcacgagagccccggcgaggacagactgttcagagtgctggacagcctgcagcacagcccctggcagtgctaccccacccaggacaccagaggcagactgtgcccctacttcttcgccaaccaggagttctacagcctggacagccagctgcccatctggggcgtgagacaggtgcactgcggcagcgagatcctgagagtgaccctgtactgcagcttcgacaactacgaggacgccatcagactgtacgagatgatcctgcagagagaggccaccctgcagaagagcaacttctgcttcttcgtgctgtacgccagcaagagcttcgccctgcagctgagcctgaagcagctgccccccggcatgagcgtggaccccaaggagagcagcgtgctgcagttcaaggtgcaggagatcggccagctggtgcccctgctgcccaacccctgcatgcccatcagcagcaccagatggcagacccaggactacgacggcaacaagatcctgctgcaggtgcagctgaaccccgagctgggcgtgaagaacggcatcctgggcgccggcatgctgcccctgggcagcagactgaccagcgtgagcgccaagagaaccagcgagcccagaagccagagaaaccagggcaagagaagccagggccacagcctggagctgcccgagcccagcggcagccccaccagcgacagatgcgccggcaccagctggaagagccccggcagaagcttccaggtgagcagccccgccatgggcgcccacctgcacctgagcagccaccacctggagagcggcgccagaatgaaggtgctgaacagagagaacagcttccagaagctggaggccgagaccaacgtggacaccggcctgaccatcatcaacagcgagcccagacagacctacttcggcggcttccccagagacctgcagaccagccagccccccttctgcctgcccgccagcagcctgggcgtggccaccagcaagaacaacagcgtgctgaaggagagagtgagccccctgcccctggccggccagagagacctgggcaccagaaagaccatcagcgagtgcctgctgcacctgcaggtgcagggcgaggagaaggaggaggacgaggaggagttcttcatctag

SEQ ID NO: 20888 - DNA, 1593 bp, Artificial Sequence
  Description of Artificial Sequence: Synthetic coding sequence
atgctgggcaccgacagatgcgtggtggaggagtggctgagcgagttcaaggccctgcccgacacccagatcaccagctacgccgccaccctgcacagaaagaagaccctggtgcccgccctgtacaaggtgatccaggacagcaacaacgagctgctggagcccgtgtgccaccagctgttcgagctgtacagaagcagcgaggtgagactgaagagattcaccctgcagttcctgcccgagctgatgtgggtgtacctgagactgaccgtgagcagagacagacagagcaacggctgcatcgaggccctgctgctgggcatctacaacctggagatcgccgacaaggacggcaacaacaaggtgctgagcttcaccatccccagcctgagcaagcccagcatctaccacgagcccagcaccatcggcagcatggccctgaccgagggcgccctgtgccagcacgacctgatcagagtggtgtacagcgacctgcacccccagagagagaccttcaccgcccagaacagattcgaggtgctgagcttcctgatgctgtgctacaacagcgccatcgtgtacatgcccgccagcagctaccagagcctgtgcagaatgggcagcagagtgtgcgtgagcggcttccccagacagcacgagaagcactggaaggagctgtgcggcagaatcgtgctggaccccgagttcatggtgcagctgctgaccggcgtgtactacgccatgtacaacggccagtgggacctgggccaggaggtgctggacgacatcatctacagagcccagctggagctgttcagccagcccctgctggtggccaacgccatgaagaacagcctgcccttcgacgcccccgacagcacccaggagggccagaaggtgctgaaggtggaggtgacccccaccgtgcccagaatcagcagaaccgccatcaccaccgccagcatcagaagacacagatggagaagagagggcgccgagggcgtgaacggcggcgaggagagcgtgaacctgaacgacgccgacgagggcttcagcagcggcgccagcctgagcagccagcccatcggcaccaagcccagcagcagcagccagagaggcagcctgagaaaggtggccaccggcagaagcgccaaggacaaggagaccgccagcgccatcaagagcagcgagagccccagagacagcgtggtgagaaagcagtacgtgcagcagcccaccgacctgagcgtggacagcgtggagctgacccccatgaagaagcacctgagcctgcccgccggccaggtggtgcccaagatcaacagcctgagcctgatcagaaccgccagcgccagcagcagcaagagcttcgactacgtgaacggcagccaggccagcaccagcatcggcgtgggcaccgagggcggcaccaacctggccgccaacaacgccaacagatacagcaccgtgagcctgcaggaggacagactgggccaggccggcgagggcaaggagctgctgagccccggcgcccccctgaccaagcagagcagaagccccagcttcaacatgcagctgatcagccaggtgtag

SEQ ID NO: 20889 - DNA, 627 bp, Artificial Sequence
  Description of Artificial Sequence: Synthetic coding sequence
atgctgggcaccgacagatgcgtggtggaggagtggctgagcgagttcaaggccctgcccgacacccagatcaccagctacgccgccaccctgcacagaaagaagaccctggtgcccgccctgtacaaggtgatccaggacagcaacaacgagctgctggagcccgtgtgccaccagctgttcgagctgtacagaagcagcgaggtgagactgaagagattcaccctgcagttcctgcccgagctgatgtgggtgtacctgagactgaccgtgagcagagacagacagagcaacggctgcatcgaggccctgctgctgggcatctacaacctggagatcgccgacaaggacggcaacaacaaggtgctgagcttcaccatccccagcctgagcaagcccagcatctaccacgagcccagcaccatcggcagcatggccctgaccgagggcgccctgtgccagcacgacctgatcagagtggtgtacagcgacctgcacccccagagagagaccttcaccgcccagaacagattcgaggtgctgagcttcctgatgctgtgctacaacagcgccatcgtgtacatgcccgccagcagctaccagagcctgtgcagaatgggcagctag

SEQ ID NO: 20890 - DNA, 264 bp, Artificial Sequence
  Description of Artificial Sequence: Synthetic coding sequence
atgctgggcaccgacagatgcgtggtggaggagtggctgagcgagttcaaggccctgcccgacacccagatcaccagctacgccgccaccctgcacagaaagaagaccctggtgcccgccctgtacaaggtgatccaggacagcaacaacgagctgctggagcccgtgtgccaccagctgttcgagctgtacagaagcagcgaggtgagactgaagagattcaccctgcagttcctgcccgagctgatgtgggtgtacctgtag

SEQ ID NO: 20891 - DNA, 342 bp, Artificial Sequence
  Description of Artificial Sequence: Synthetic coding sequence
atggacggcagagtgcagctgatgaaggccctgctggccggccccctgagacccgccgccagaagatggagaaaccccatccccttccccgagaccttcgacggcgacaccgacagactgcccgagttcatcgtgcagaccagcagctacatgttcgtggacgagaacaccttcagcaacgacgccctgaaggtgaccttcctgatcaccagactgaccggccccgccctgcagtgggtgatcccctacatcagaaaggagagccccctgctgaacgactacagaggcttcctggccgagatgaagagagtgttcggctgggaggaggacgaggacttctag

SEQ ID NO: 20892 - DNA, 342 bp, Artificial Sequence
  Description of Artificial Sequence: Synthetic coding sequence
atggagggcagagtgcagctgatgaaggccctgctggccagacccctgagacccgccgccagaagatggagaaaccccatccccttccccgagaccttcgacggcgacaccgacagactgcccgagttcatcgtgcagaccagcagctacatgttcgtggacgagaacaccttcagcaacgacgccctgaaggtgaccttcctgatcaccagactgaccggccccgccctgcagtgggtgatcccctacatcaagaaggagagccccctgctgagcgactacagaggcttcctggccgagatgaagagagtgttcggctgggaggaggacgaggacttctag

SEQ ID NO: 20893 - DNA, 627 bp, Artificial Sequence
  Description of Artificial Sequence: Synthetic coding sequence
atgggcggcggcagaggcctgctgggcagagagaccctgggccccggcgacagatgcagcggcaagggccccctgtgctactggcccccccccggcagcccccccgcccccagcctgagagccagcctgcccctggagccccccagatgccccctgagaagctgccccctgcccagaagcgcctgcctgtgcagcagaaacagcgcccccggcagctgctgcagaccctgggccagcctgtggagcggcctgcccccccccagcagagccagcagcgccccccccatgcacatctggaccctgagctgcgcccccgtggcccaggccgagctgctgctgcacaccgacagacccctgccccccctgcccacccccctgctgctgaccagactgcccgacgactacatcatgctgcccaccgacctgagatgccactgccacagacaccccagccacagcaccgacagactgctgctgctggtgatctgcacccacctgggcggcatctgggccggccacagcccctggaccatgatccagaccgccggctgccccagcagagacctgctgcccagcgccagacccatcagcagccccatccccgagaccttctgcgcccccgcctag

SEQ ID NO: 20894 - DNA, 1782 bp, Artificial Sequence
  Description of Artificial Sequence: Synthetic coding sequence
atgggccccgacagaaaggaggtgcccctgagcagaggcacccaggccgtggtggtgggcaagggcagaggcgcccccggcgacgacagcagcatgggcggcagacccagcagccccctggacaagcagcagagacagcacctgagaggccaggtggacaccctgctgagaaacttcctgccctgctacagaggccagctggccgccagcgtgctgagacagatcagcagagagctgggcccccaggagcccaccggcagccagctgctgagaagcaagaagctgcccagagtgagagagcacagaggccccctgacccagctgagaggccacccccccagatggcagcccatcttctgcgtgctgagaggcgacggcagactggagtggttcagccacaaggaggagtacgagaacggcggccactgcctgggcagcaccgccctgaccggctacaccctgctgaccagccagagagagtacctgagactgctggacgccctgtgccccgagagcctgggcgaccacacccaggaggagcccgacagcctgctggaggtgcccgtgagcttccccctgttcctgcagcaccccttcagaagacacctgtgcttcagcgccgccaccagagaggcccagcacgcctggagactggccctgcagggcggcatcagactgcagggcatcgtgctgcagagaagccaggcccccgccgccagagccttcctggacgccgtgagactgtacagacagcaccagggccacttcggcgacgacgacgtgaccctgggcagcgacgccgaggtgctgaccgccgtgctgatgagagagcagctgcccgccctgagagcccagaccctgcccggcctgagaggcgccggcagagccagagcctgggcctggaccgagctgctggacgccgtgcacgccgccgtgctggccggcgccagcgccggcctgtgcgccttccagcccgagaaggacgagctgctggccagcctggagaagaccatcagacccgacgtggaccagctgctgagacagagagccagagtggccggcagactgagaaccgacatcagaggccccctggagagctgcctgagaagagaggtggacccccagctgcccagagtggtgcagaccctgctgagaaccgtggaggccagcctggaggccgtgagaaccctgctggcccagggcatggacagactgagccacagactgagacagagccccagcggcaccagactgagaagagaggtgtacagcttcggcgagatgccctgggacctggccctgatgcagacctgctacagagaggccgagagaagcagaggcagactgggccagctggccgcccccttcggcttcctgggcatgcagagcctggtgttcggcgcccaggacctggcccagcagctgatggccgacgccgtggccaccttcctgcagctggccgaccagtgcctgaccaccgccctgaactgcgaccaggccgcccagagactggagagagtgagaggcagagtgctgaagaagttcaagagcgacagcggcctggcccagagaagattcatcagaggctggggcctgtgcatcttcctgcccttcgtgctgagccagctggagcccggctgcaagaagaccgagagccacagcgtggcccaggccgtggtgcagtggtgcgacctgggcagcctgcagccccccccccccagattcaagagaagcagccacctgagcctgcccagcagctgggactacagacaccccctgtag

SEQ ID NO: 20895 - DNA, 1956 bp, Artificial Sequence
  Description of Artificial Sequence: Synthetic coding sequence
atgggccccgacagaaaggaggtgcccctgagcagaggcacccaggccgtggtggtgggcaagggcagaggcgcccccggcgacgacagcagcatgggcggcagacccagcagccccctggacaagcagcagagacagcacctgagaggccaggtggacaccctgctgagaaacttcctgccctgctacagaggccagctggccgccagcgtgctgagacagatcagcagagagctgggcccccaggagcccaccggcagccagctgctgagaagcaagaagctgcccagagtgagagagcacagaggccccctgacccagctgagaggccacccccccagatggcagcccatcttctgcgtgctgagaggcgacggcagactggagtggttcagccacaaggaggagtacgagaacggcggccactgcctgggcagcaccgccctgaccggctacaccctgctgaccagccagagagagtacctgagactgctggacgccctgtgccccgagagcctgggcgaccacacccaggaggagcccgacagcctgctggaggtgcccgtgagcttccccctgttcctgcagcaccccttcagaagacacctgtgcttcagcgccgccaccagagaggcccagcacgcctggagactggccctgcagggcggcatcagactgcagggcatcgtgctgcagagaagccaggcccccgccgccagagccttcctggacgccgtgagactgtacagacagcaccagggccacttcggcgacgacgacgtgaccctgggcagcgacgccgaggtgctgaccgccgtgctgatgagagagcagctgcccgccctgagagcccagaccctgcccggcctgagaggcgccggcagagccagagcctgggcctggaccgagctgctggacgccgtgcacgccgccgtgctggccggcgccagcgccggcctgtgcgccttccagcccgagaaggacgagctgctggccagcctggagaagaccatcagacccgacgtggaccagctgctgagacagagagccagagtggccggcagactgagaaccgacatcagaggccccctggagagctgcctgagaagagaggtggacccccagctgcccagagtggtgcagaccctgctgagaaccgtggaggccagcctggaggccgtgagaaccctgctggcccagggcatggacagactgagccacagactgagacagagccccagcggcaccagactgagaagagaggtgtacagcttcggcgagatgccctgggacctggccctgatgcagacctgctacagagaggccgagagaagcagaggcagactgggccagctggccgcccccttcggcttcctgggcatgcagagcctggtgttcggcgcccaggacctggcccagcagctgatggccgacgccgtggccaccttcctgcagctggccgaccagtgcctgaccaccgccctgaactgcgaccaggccgcccagagactggagagagtgagaggcagagtgctgaagaagttcaagagcgacagcggcctggcccagagaagattcatcagaggctggggcctgtgcatcttcctgcccttcgtgctgagccagctggagcccggctgcaagaaggagctgcccgagttcgagggcgacgtgctggccgtgggcagccaggccctgaccaccgagggcatctacgaggacgtgatcagaggctgcctgctgcagagaatcgaccaggagctgaagaagaccctgggcgccaacgacgtgagctgcaccctggacggctgcctggaggtgccctgggagcaggagggcgccgacgaggagaccgaggccgagagagagggcggcgcctgccccagacagcccgacagcggcgcccagatccagcccctgtgccccccccccagccccggcaccttcagaagctag

SEQ ID NO: 20896 - DNA, 2094 bp, Artificial Sequence
  Description of Artificial Sequence: Synthetic coding sequence
atgggccccgacagaaaggaggtgcccctgagcagaggcacccaggccgtggtggtgggcaagggcagaggcgcccccggcgacgacagcagcatgggcggcagacccagcagccccctggacaagcagcagagacagcacctgagaggccaggtggacaccctgctgagaaacttcctgccctgctacagaggccagctggccgccagcgtgctgagacagatcagcagagagctgggcccccaggagcccaccggcagccagctgctgagaagcaagaagctgcccagagtgagagagcacagaggccccctgacccagctgagaggccacccccccagatggcagcccatcttctgcgtgctgagaggcgacggcagactggagtggttcagccacaaggaggagtacgagaacggcggccactgcctgggcagcaccgccctgaccggctacaccctgctgaccagccagagagagtacctgagactgctggacgccctgtgccccgagagcctgggcgaccacacccaggaggagcccgacagcctgctggaggtgcccgtgagcttccccctgttcctgcagcaccccttcagaagacacctgtgcttcagcgccgccaccagagaggcccagcacgcctggagactggccctgcagggcggcatcagactgcagggcatcgtgctgcagagaagccaggcccccgccgccagagccttcctggacgccgtgagactgtacagacagcaccagggccacttcggcgacgacgacgtgaccctgggcagcgacgccgaggtgctgaccgccgtgctgatgagagagcagctgcccgccctgagagcccagaccctgcccggcctgagaggcgccggcagagccagagcctgggcctggaccgagctgctggacgccgtgcacgccgccgtgctggccggcgccagcgccggcctgtgcgccttccagcccgagaaggacgagctgctggccagcctggagaagaccatcagacccgacgtggaccagctgctgagacagagagccagagtggccggcagactgagaaccgacatcagaggccccctggagagctgcctgagaagagaggtggacccccagctgcccagagtggtgcagaccctgctgagaaccgtggaggccagcctggaggccgtgagaaccctgctggcccagggcatggacagactgagccacagactgagacagagccccagcggcaccagactgagaagagaggtgtacagcttcggcgagatgccctgggacctggccctgatgcagacctgctacagagaggccgagagaagcagaggcagactgggccagctggccgcccccttcggcttcctgggcatgcagagcctggtgttcggcgcccaggacctggcccagcagctgatggccgacgccgtggccaccttcctgcagctggccgaccagtgcctgaccaccgccctgaactgcgaccaggccgcccagagactggagagagtgagaggcagagtgctgaagaagttcaagagcgacagcggcctggcccagagaagattcatcagaggctggggcctgtgcatcttcctgcccttcgtgctgagccagctggagcccggctgcaagaaggagctgcccgagttcgagggcgacgtgctggccgtgggcagccaggccctgaccaccgagggcatctacgaggacgtgatcagaggctgcctgctgcagagaatcgaccaggagctgaagaagaccctgggcgccaacgacgtgagctgcaccctggacggctgcctggaggtgccctgggagcaggagggcgccgcccccaacctgaacctggtgagcagcttcctggccggcagacaggccttcaccgacttcctgtgcctgcccgccaagagcagcgccaactggatcctggccgccagcctgctgagctgcagctgcttcagaagcggcttccacagagacagcagagtgttcctggtgcagctggccgagggcctgagccacagcctggagaccgtgagcagccacagcgtgtggagcttcagacccacccccagacagtag

SEQ ID NO: 20897 - DNA, 1848 bp, Artificial Sequence
  Description of Artificial Sequence: Synthetic coding sequence
atgggccccgacagaaaggaggtgcccctgagcagaggcacccaggccgtggtggtgggcaagggcagaggcgcccccggcgacgacagcagcatgggcggcagacccagcagccccctggacaagcagcagagacagcacctgagaggccaggtggacaccctgctgagaaacttcctgccctgctacagaggccagctggccgccagcgtgctgagacagatcagcagagagctgggcccccaggagcccaccggcagccagctgctgagaagcaagaagctgcccagagtgagagagcacagaggccccctgacccagctgagaggccacccccccagatggcagcccatcttctgcgtgctgagaggcgacggcagactggagtggttcagccacaaggaggagtacgagaacggcggccactgcctgggcagcaccgccctgaccggctacaccctgctgaccagccagagagagtacctgagactgctggacgccctgtgccccgagagcctgggcgaccacacccaggaggagcccgacagcctgctggaggtgcccgtgagcttccccctgttcctgcagcaccccttcagaagacacctgtgcttcagcgccgccaccagagaggcccagcacgcctggagactggccctgcagggcggcatcagactgcagggcatcgtgctgcagagaagccaggcccccgccgccagagccttcctggacgccgtgagactgtacagacagcaccagggccacttcggcgacgacgacgtgaccctgggcagcgacgccgaggtgctgaccgccgtgctgatgagagagcagctgcccgccctgagagcccagaccctgcccggcctgagaggcgccggcagagccagagcctgggcctggaccgagctgctggacgccgtgcacgccgccgtgctggccggcgccagcgccggcctgtgcgccttccagcccgagaaggacgagctgctggccagcctggagaagaccatcagacccgacgtggaccagctgctgagacagagagccagagtggccggcagactgagaaccgacatcagaggccccctggagagctgcctgagaagagaggtggacccccagctgcccagagtggtgcagaccctgctgagaaccgtggaggccagcctggaggccgtgagaaccctgctggcccagggcatggacagactgagccacagactgagacagagccccagcggcaccagactgagaagagaggtgtacagcttcggcgagatgccctgggacctggccctgatgcagacctgctacagagaggccgagagaagcagaggcagactgggccagctggccgcccccttcggcttcctgggcatgcagagcctggtgttcggcgcccaggacctggcccagcagctgatggccgacgccgtggccaccttcctgcagctggccgaccagtgcctgaccaccgccctgaactgcgaccaggccgcccagagactggagagagtgagaggcagagtgctgaaggagctgcccgagttcgagggcgacgtgctggccgtgggcagccaggccctgaccaccgagggcatctacgaggacgtgatcagaggctgcctgctgcagagaatcgaccaggagctgaagaagaccctgggcgccaacgacgtgagctgcaccctggacggctgcctggaggtgccctgggagcaggagggcgccgacgaggagaccgaggccgagagagagggcggcgcctgccccagacagcccgacagcggcgcccagatccagcccctgtgccccccccccagccccggcaccttcagaagctag

SEQ ID NO: 20898 - DNA, 1710 bp, Artificial Sequence
  Description of Artificial Sequence: Synthetic coding sequence
atgggcggcagacccagcagccccctggacaagcagcagagacagcacctgagaggccaggtggacaccctgctgagaaacttcctgccctgctacagaggccagctggccgccagcgtgctgcccagagtgagagagcacagaggccccctgacccagctgagaggccacccccccagatggcagcccatcttctgcgtgctgagaggcgacggcagactggagtggttcagccacaaggaggagtacgagaacggcggccactgcctgggcagcaccgccctgaccggctacaccctgctgaccagccagagagagtacctgagactgctggacgccctgtgccccgagagcctgggcgaccacacccaggaggagcccgacagcctgctggaggtgcccgtgagcttccccctgttcctgcagcaccccttcagaagacacctgtgcttcagcgccgccaccagagaggcccagcacgcctggagactggccctgcagggcggcatcagactgcagggcatcgtgctgcagagaagccaggcccccgccgccagagccttcctggacgccgtgagactgtacagacagcaccagggccacttcggcgacgacgacgtgaccctgggcagcgacgccgaggtgctgaccgccgtgctgatgagagagcagctgcccgccctgagagcccagaccctgcccggcctgagaggcgccggcagagccagagcctgggcctggaccgagctgctggacgccgtgcacgccgccgtgctggccggcgccagcgccggcctgtgcgccttccagcccgagaaggacgagctgctggccagcctggagaagaccatcagacccgacgtggaccagctgctgagacagagagccagagtggccggcagactgagaaccgacatcagaggccccctggagagctgcctgagaagagaggtggacccccagctgcccagagtggtgcagaccctgctgagaaccgtggaggccagcctggaggccgtgagaaccctgctggcccagggcatggacagactgagccacagactgagacagagccccagcggcaccagactgagaagagaggtgtacagcttcggcgagatgccctgggacctggccctgatgcagacctgctacagagaggccgagagaagcagaggcagactgggccagctggccgcccccttcggcttcctgggcatgcagagcctggtgttcggcgcccaggacctggcccagcagctgatggccgacgccgtggccaccttcctgcagctggccgaccagtgcctgaccaccgccctgaactgcgaccaggccgcccagagactggagagagtgagaggcagagtgctgaagaagttcaagagcgacagcggcctggcccagagaagattcatcagaggctggggcctgtgcatcttcctgcccttcgtgctgagccagctggagcccggctgcaagaaggagctgcccgagttcgagggcgacgtgctggccgtgggcagccaggccctgaccaccgagggcatctacgaggacgtgatcagaggctgcctgctgcagagaatcgaccaggacgaggagaccgaggccgagagagagggcggcgcctgccccagacagcccgacagcggcgcccagatccagcccctgtgccccccccccagccccggcaccttcagaagctag

SEQ ID NO: 20899 - DNA, 1272 bp, Artificial Sequence
  Description of Artificial Sequence: Synthetic coding sequence
atgagagagcagctgcccgccctgagagcccagaccctgcccggcctgagaggcgccggcagagccagagcctgggcctggaccgagctgctggacgccgtgcacgccgccgtgctggccggcgccagcgccggcctgtgcgccttccagcccgagaaggacgagctgctggccagcctggagaagaccatcagacccgacgtggaccagctgctgagacagagagccagagtggccggcagactgagaaccgacatcagaggccccctggagagctgcctgagaagagaggtggacccccagctgcccagagtggtgcagaccctgctgagaaccgtggaggccagcctggaggccgtgagaaccctgctggcccagggcatggacagactgagccacagactgagacagagccccagcggcaccagactgagaagagaggtgtacagcttcggcgagatgccctgggacctggccctgatgcagacctgctacagagaggccgagagaagcagaggcagactgggccagctggccgcccccttcggcttcctgggcatgcagagcctggtgttcggcgcccaggacctggcccagcagctgatggccgacgccgtggccaccttcctgcagctggccgaccagtgcctgaccaccgccctgaactgcgaccaggccgcccagagactggagagagtgagaggcagagtgctgaagaagttcaagagcgacagcggcctggcccagagaagattcatcagaggctggggcctgtgcatcttcctgcccttcgtgctgagccagctggagcccggctgcaagaaggagctgcccgagttcgagggcgacgtgctggccgtgggcagccaggccctgaccaccgagggcatctacgaggacgtgatcagaggctgcctgctgcagagaatcgaccaggagctgaagaagaccctgggcgccaacgacgtgagctgcaccctggacggctgcctggaggtgccctgggagcaggagggcgccgcccccaacctgaacctggtgagcagcttcctggccggcagacaggccttcaccgacttcctgtgcctgcccgccaagagcagcgccaactggatcctggccgccagcctgctgagctgcagctgcttcagaagcggcttccacagagacagcagagtgttcctggtgcagctggccgagggcctgagccacagcctggagaccgtgagcagccacagcgtgtggagcttcagacccacccccagacagtag

SEQ ID NO: 20900 - DNA, 2748 bp, Artificial Sequence
  Description of Artificial Sequence: Synthetic coding sequence
atgagaaagagcagcagccccagcctgagcaactgcaacagcgtgctggccaacaagatcttcggcatccccctggacgagctgcagcagggcggccaccccgacaacgaggtgcccttcatcgtgagacacgtggtggactacatcgaggagcacggcggcctggagcagcagggcctgttccaggtgaacggcaacgccgagaccgtggagtggctgagacagagatacgacagcggcgaggaggtggacctggtgaaggaggccgacgtgcccagcgccatcagcctgctgagattcttcctgcaggagctgcccgagcccgtgatccccggcagcctgcacatccacctgatgcagctgagccaggactacaacaacgaggacgagttcggcagaaagctgagattcctgctgcagcagctgccccccgtgaactacagcctgctgaagttcctgtgcagattcctggccaacgtggccagccaccacgaggagatctggagcgccaacagcctggccgccgtgttcggccccgacgtgttccacatctacaccgacgtggaggacatgaaggagcaggagatcgtgagcagaatcatggccggcctgctggagaactactacgagttcttcgagaacgaggaggaggacttcagcagcaacgacctgagcagcatcaccgagcaggtgaacgagctgagcgaggaggaggaggaggacgagaagctggagcacatcgaggagctgcccgaggagggcgccgagaagagcaacgacatgcccgaggtggtgcagctgagaatgaccgagaacatcctggagagcaacagcgtgaccgccaccagcacccacatcagccccatcagcatcctgcccgccagcaccgacatcctggagagaaccatcagagccgccgtggagcagcacctgttcgacctgcagagcagcatcgaccacgacctgaagaacctgcagcagcagagcgtggtgtgcaacaacgaggccgagagcatccactgcgacggcgagggcagcaacaaccagatcgacatcgccgacgacatcatcaacgccagcgagagcaacagagactgcagcaagcccgtggccagcaccaacctggacaacgaggccatgcagcaggactgcgtgttcgagaacgaggagaacacccagagcgtgggcatcctgctggagccctgcagcgacagaggcgacagcgaggacggctgcctggagagagaggagtacctgctgttcgacagcgacaagctgagccacctgatcctggacagcagcagcaagatctgcgacctgaacgccaacaccgagagcgaggtgcccggcggccagagcgtgggcgtgcagggcgaggccgcctgcgtgagcatcccccacctggacctgaagaacgtgagcgacggcgacaagtgggaggagcccttccccgccttcaagagctggcaggaggacagcgagagcggcgaggcccagctgagcccccaggccggcagaatgaaccaccaccccctggaggaggactgcccccccgtgctgagccacagaagcctggacttcggccagagccagagattcctgcacgaccccgagaagctggacagcagcagcaaggccctgagcttcaccagaatcagaagaagcagcttcagcagcaaggacgagaagagagaggacagaaccccctaccagctggtgaagaagctgcagaagaagatcagacagttcgaggagcagttcgagagagagagaaacagcaagcccagctacagcgacatcgccgccaaccccaaggtgctgaagtggatgaccgagctgaccaagctgagaaagcagatcaaggacgccaagcacaagaacagcgacggcgagttcgtgccccagaccagacccagaagcaacaccctgcccaagagcttcggcagcagcctggaccacgaggacgaggagaacgaggacgagcccaaggtgatccagaaggagaagaagcccagcaaggaggccaccctggagctgatcctgaagagactgaaggagaagagaatcgagagatgcctgcccgaggacatcaagaagatgaccaaggaccacctggtggaggagaaggccagcctgcagaagagcctgctgtactacgagagccagcacggcagacccgtgaccaaggaggagagacacatcgtgaagcccctgtacgacagatacagactggtgaagcagatgctgaccagagccagcatcacccccgtgctgggcagccccagcaccaagagaagaggccagatgctgcagcccatcatcgagggcgagaccgcccacttcttcgaggagatcaaggaggaggaggaggacggcgtgaacctgagcagcgagctgggcgacatgctgaagaccgccgtgcaggtgcagagcagcctggagaacagcgagagcgacgtggaggagaaccaggagaagctggccctggacctgagactgagcagcagcagagccgccagcatgcccgagctgctggagcagctgtggaaggccagagccgagaagaagaagctgagaaagaccctgagagagttcgaggaggccttctaccagcagaacggcagaaacgcccagaaggaggacagagtgcccgtgctggaggagtacagagagtacaagaagatcaaggccaagctgagactgctggaggtgctgatcagcaagcaggacagcagcaagagcatctag

SEQ ID NO: 20901 - DNA, 2664 bp, Artificial Sequence
  Description of Artificial Sequence: Synthetic coding sequence
atgagaaagagcagcagccccagcctgagcaactgcaacagcgtgctggccaacaagatcttcggcatccccctggacgagctgcagcagggcggccaccccgacaacgaggtgcccttcatcgtgagacacgtggtggactacatcgaggagcacggcggcctggagcagcagggcctgttccaggtgaacggcaacgccgagaccgtggagtggctgagacagagatacgacagcggcgaggaggtggacctggtgaaggaggccgacgtgcccagcgccatcagcctgctgagattcttcctgcaggagctgcccgagcccgtgatccccggcagcctgcacatccacctgatgcagctgagccaggactacaacaacgaggacgagttcggcagaaagctgagattcctgctgcagcagctgccccccgtgaactacagcctgctgaagttcctgtgcagattcctggccaacgtggccagccaccacgaggagatctggagcgccaacagcctggccgccgtgttcggccccgacgtgttccacatctacaccgacgtggaggacatgaaggagcaggagatcgtgagcagaatcatggccggcctgctggagaactactacgagttcttcgagaacgaggaggaggacttcagcagcaacgacctgagcagcatcaccgagcaggtgaacgagctgagcgaggaggaggaggaggacgagaagctggagcacatcgaggagctgcccgaggagggcgccgagaagagcaacgacatgcccgaggtggtgcagctgagaatgaccgagaacatcctggagagcaacagcgtgaccgccaccagcacccacatcagccccatcagcatcctgcccgccagcaccgacatcctggagagaaccatcagagccgccgtggagcagcacctgttcgacctgcagagcagcatcgaccacgacctgaagaacctgcagcagcagagcgtggtgtgcaacaacgaggccgagagcatccactgcgacggcgagggcagcaacaaccagatcgacatcgccgacgacatcatcaacgccagcgagagcaacagagactgcagcaagcccgtggccagcaccaacctggacaacgaggccatgcagcaggactgcgtgttcgagaacgaggagaacacccagagcgtgggcatcctgctggagccctgcagcgacagaggcgacagcgaggacggctgcctggagagagaggagtacctgctgttcgacagcgacaagctgagccacctgatcctggacagcagcagcaagatctgcgacctgaacgccaacaccgagagcgaggtgcccggcggccagagcgtgggcgtgcagggcgaggccgcctgcgtgagcatcccccacctggacctgaagaacgtgagcgacggcgacaagtgggaggagcccttccccgccttcaagagctggcaggaggacagcgagagcggcgaggcccagctgagcccccaggccggcagaatgaaccaccaccccctggaggaggactgcccccccgtgctgagccacagaagcctggacttcggccagagccagagattcctgcacgaccccgagaagctggacagcagcagcaaggccctgagcttcaccagaatcagaagaagcagcttcagcagcaaggacgagaagagagaggacagaaccccctaccagctggtgaagaagctgcagaagaagatcagacagttcgaggagcagttcgagagagagagaaacagcaagcccagctacagcgacatcgccgccaaccccaaggtgctgaagtggatgaccgagctgaccaagctgagaaagcagatcaaggacgccaagcacaagaacagcgacggcgagttcgtgccccagaccagacccagaagcaacaccctgcccaagagcttcggcagcagcctggaccacgaggacgaggagaacgaggacgagcccaaggtgatccagaaggagaagaagcccagcaaggaggccaccctggagctgatcctgaagagactgaaggagaagagaatcgagagatgcctgcccgaggacatcaaggtgaccaaggaggagagacacatcgtgaagcccctgtacgacagatacagactggtgaagcagatgctgaccagagccagcatcacccccgtgctgggcagccccagcaccaagagaagaggccagatgctgcagcccatcatcgagggcgagaccgcccacttcttcgaggagatcaaggaggaggaggaggacggcgtgaacctgagcagcgagctgggcgacatgctgaagaccgccgtgcaggtgcagagcagcctggagaacagcgagagcgacgtggaggagaaccaggagaagctggccctggacctgagactgagcagcagcagagccgccagcatgcccgagctgctggagcagctgtggaaggccagagccgagaagaagaagctgagaaagaccctgagagagttcgaggaggccttctaccagcagaacggcagaaacgcccagaaggaggacagagtgcccgtgctggaggagtacagagagtacaagaagatcaaggccaagctgagactgctggaggtgctgatcagcaagcaggacagcagcaagagcatctag

SEQ ID NO: 20902 - DNA, 2376 bp, Artificial Sequence
  Description of Artificial Sequence: Synthetic coding sequence
atgcagctgagccaggactacaacaacgaggacgagttcggcagaaagctgagattcctgctgcagcagctgccccccgtgaactacagcctgctgaagttcctgtgcagattcctggccaacgtggccagccaccacgaggagatctggagcgccaacagcctggccgccgtgttcggccccgacgtgttccacatctacaccgacgtggaggacatgaaggagcaggagatcgtgagcagaatcatggccggcctgctggagaactactacgagttcttcgagaacgaggaggaggacttcagcagcaacgacctgagcagcatcaccgagcaggtgaacgagctgagcgaggaggaggaggaggacgagaagctggagcacatcgaggagctgcccgaggagggcgccgagaagagcaacgacatgcccgaggtggtgcagctgagaatgaccgagaacatcctggagagcaacagcgtgaccgccaccagcacccacatcagccccatcagcatcctgcccgccagcaccgacatcctggagagaaccatcagagccgccgtggagcagcacctgttcgacctgcagagcagcatcgaccacgacctgaagaacctgcagcagcagagcgtggtgtgcaacaacgaggccgagagcatccactgcgacggcgagggcagcaacaaccagatcgacatcgccgacgacatcatcaacgccagcgagagcaacagagactgcagcaagcccgtggccagcaccaacctggacaacgaggccatgcagcaggactgcgtgttcgagaacgaggagaacacccagagcgtgggcatcctgctggagccctgcagcgacagaggcgacagcgaggacggctgcctggagagagaggagtacctgctgttcgacagcgacaagctgagccacctgatcctggacagcagcagcaagatctgcgacctgaacgccaacaccgagagcgaggtgcccggcggccagagcgtgggcgtgcagggcgaggccgcctgcgtgagcatcccccacctggacctgaagaacgtgagcgacggcgacaagtgggaggccagctgccccatcaccttccccctgatcgacttcaagaccatgcacctgcagagagacggcgaggagcccttccccgccttcaagagctggcaggaggacagcgagagcggcgaggcccagctgagcccccaggccggcagaatgaaccaccaccccctggaggaggactgcccccccgtgctgagccacagaagcctggacttcggccagagccagagattcctgcacgaccccgagaagctggacagcagcagcaaggccctgagcttcaccagaatcagaagaagcagcttcagcagcaaggacgagaagagagaggacagaaccccctaccagctggtgaagaagctgcagaagaagatcagacagttcgaggagcagttcgagagagagagaaacagcaagcccagctacagcgacatcgccgccaaccccaaggtgctgaagtggatgaccgagctgaccaagctgagaaagcagatcaaggacgccaagcacaagaacagcgacggcgagttcgtgccccagaccagacccagaagcaacaccctgcccaagagcttcggcagcagcctggaccacgaggacgaggagaacgaggacgagcccaaggtgatccagaaggagaagaagcccagcaaggaggccaccctggagctgatcctgaagagactgaaggagaagagaatcgagagatgcctgcccgaggacatcaaggtgaccaaggaggagagacacatcgtgaagcccctgtacgacagatacagactggtgaagcagatgctgaccagagccagcatcacccccgtgctgggcagccccagcaccaagagaagaggccagatgctgcagcccatcatcgagggcgagaccgcccacttcttcgaggagatcaaggaggaggaggaggacggcgtgaacctgagcagcgagctgggcgacatgctgaagaccgccgtgcaggtgcagagcagcctggagaacagcgagagcgacgtggaggagaaccaggagaagctggccctggacctgagactgagcagcagcagagccgccagcatgcccgagctgctggagcagctgtggaaggccagagccgagaagaagaagctgagaaagaccctgagagagttcgaggaggccttctaccagcagaacggcagaaacgcccagaaggaggacagagtgcccgtgctggaggagtacagagagtacaagaagatcaaggccaagctgagactgctggaggtgctgatcagcaagcaggacagcagcaagagcatctag

SEQ ID NO: 20903 - DNA, 288 bp, Artificial Sequence
  Description of Artificial Sequence: Synthetic coding sequence
atgagaaagagcagcagccccagcctgagcaactgcaacagcgtgctggccaacaagatcttcggcatccccctggacgagctgcagcagggcggccaccccgacaacgaggtgcccttcatcgtgagacacgtggtggactacatcgaggagcacggcggcctggagcagcagggcctgttccaggtgaacggcaacgccgagaccgtggagtggctgagacagagatacgacagcggcgaggaggtggacctggtgaaggaggccgacgtgcccagcgccatctag

SEQ ID NO: 20904 - DNA, 159 bp, Artificial Sequence
  Description of Artificial Sequence: Synthetic coding sequence
atgagaaagagcagcagccccagcctgagcaactgcaacagcgtgctggccaacaagatcttcggcatccccctggacgagctgcagcagggcggccaccccgacaacgaggtgcccttcatcgtgagacacgtggtggactacatcgaggagcactag

SEQ ID NO: 20905 - DNA, 195 bp, Artificial Sequence
  Description of Artificial Sequence: Synthetic coding sequence
atgagaaagagcagcagccccagcctgagcaactgcaacagcgtgctggccaacaagatcttcggcatccccctggacgagctgcagcagggcggccaccccgacaacgaggtgcccttcatcgtgagacacgtggtggactacatcgaggagcacggcggcctggagcagcagggcctgttccaggtgaactag

SEQ ID NO: 20906 - DNA, 264 bp, Artificial Sequence
  Description of Artificial Sequence: Synthetic coding sequence
atgagaaagagcagcagccccagcctgagcaactgcaacagcgtgctggccaacaagatcttcggcatccccctggacgagctgcagcagggcggccaccccgacaacgaggtgcccttcatcgtgagacacgtggtggactacatcgaggagcacggcggcctggagcagcagggcctgttccaggtgaacggcaacgccgagaccgtggagtggctgagacagagatacgacagcggcgaggaggtggacctggtgaagtag

SEQ ID NO: 20907 - DNA, 429 bp, Artificial Sequence
  Description of Artificial Sequence: Synthetic coding sequence
atgagaaagagcagcagccccagcctgagcaactgcaacagcgtgctggccaacaagatcttcggcatccccctggacgagctgcagcagggcggccaccccgacaacgaggtgcccttcatcgtgagacacgtggtggactacatcgaggagcacggcggcctggagcagcagggcctgttccaggtgaacggcaacgccgagaccgtggagtggctgagacagagatacgacagcggcgaggaggtggacctggtgaaggaggccgacgtgcccagcgccatcagcctgctgagattcttcctgcaggagctgcccgagcccgtgatccccggcagcctgcacatccacctgatgcagctgagccaggactacaacaacgaggacgagttcggcagaaagctgagattcctgctgcagcagctgtag

SEQ ID NO: 20908 - DNA, 1506 bp, Artificial Sequence
  Description of Artificial Sequence: Synthetic coding sequence
atgggcaacttcaagagcagaaagcccaagagcatcttcaaggccgagagcggcagaagccacggcgagagccaggagaccgagcacgtggtgagcagccagagcgagtgccaggtgagagccggcacccccgcccacgagagcccccagaacaacgccttcaagtgccaggagaccgtgagactgcagcccagaatcgaccagagaaccgccatcagccccaaggacgccttcgagaccagacaggacctgaacgaggaggaggccgcccaggtgcacggcgtgaaggaccccgcccccgccagcacccagagcgtgctggccgacggcaccgacagcgccgaccccagccccgtgcacaaggacggccagaacgaggccgacagcgcccccgaggacctgcacagcgtgggcaccagcagactgctgtaccacatcaccgacggcgacaaccccctgctgagccccagatgcagcatcttcagccagagccagagattcaacctggaccccgagagcgcccccagcccccccagcacccagcagttcatgatgcccagaagcagcagcagatgcagctgcggcgacggcaaggagccccagaccatcacccagctgaccaagcacatccagagcctgaagagaaagatcagaaagttcgaggagaagttcgagcaggagaagaagtacagacccagccacggcgacaagaccagcaaccccgaggtgctgaagtggatgaacgacctggccaagggcagaaagcagctgaaggagctgaagctgaagctgagcgaggagcagggcagcgcccccaagggcccccccagaaacctgctgtgcgagcagcccaccgtgcccagagagaacggcaagcccgaggccgccggccccgagcccagcagcagcggcgaggagacccccgacgccgccctgacctgcctgaaggagagaagagagcagctgcccccccaggaggacagcaaggtgaccaagcaggacaagaacctgatcaagcccctgtacgacagatacagaatcatcaagcagatcctgagcacccccagcctgatccccaccatcgaggaggaggacagcgacgaggacagaccccagggcagccagcagcccagcctggccgaccccgccagccacctgcccgtgggcgaccacctgacctacagcaacgagaccgagcccgtgagagccctgctgcccgacgagaagaaggaggtgaagccccccgccctgagcatgagcaacctgcacgaggccaccatgcccgtgctgctggaccacctgagagagaccagagccgacaagaagagactgagaaaggccctgagagagttcgaggagcagttcttcaagcagaccggcagaagcccccagaaggaggacagaatccccatggccgacgagtactacgagtacaagcacatcaaggccaagctgagactgctggaggtgctgatcagcaagcaggacgtggccaagaccatctag

SEQ ID NO: 20909 - DNA, 1758 bp, Artificial Sequence
  Description of Artificial Sequence: Synthetic coding sequence
atgttcagctgcttctgcttcagcctgcaggacaacagcttcagcagcaccaccgtgaccgagtgcgacgaggaccccgtgagcctgcacgaggaccagaccgactgcagcagcctgagagacgagaacaacaaggagaactaccccgacgccggcgccctggtggaggagcacgccccccccagctgggagccccagcagcagaacgtggaggccaccgtgctggtggacagcgtgctgagacccagcatgggcaacttcaagagcagaaagcccaagagcatcttcaaggccgagagcggcagaagccacggcgagagccaggagaccgagcacgtggtgagcagccagagcgagtgccaggtgagagccggcacccccgcccacgagagcccccagaacaacgccttcaagtgccaggagaccgtgagactgcagcccagaatcgaccagagaaccgccatcagccccaaggacgccttcgagaccagacaggacctgaacgaggaggaggccgcccaggtgcacggcgtgaaggaccccgcccccgccagcacccagagcgtgctggccgacggcaccgacagcgccgaccccagccccgtgcacaaggacggccagaacgaggccgacagcgcccccgaggacctgcacagcgtgggcaccagcagactgctgtaccacatcaccgacggcgacaaccccctgctgagccccagatgcagcatcttcagccagagccagagattcaacctggaccccgagagcgcccccagcccccccagcacccagcagttcatgatgcccagaagcagcagcagatgcagctgcggcgacggcaaggagccccagaccatcacccagctgaccaagcacatccagagcctgaagagaaagatcagaaagttcgaggagaagttcgagcaggagaagaagtacagacccagccacggcgacaagaccagcaaccccgaggtgctgaagtggatgaacgacctggccaagggcagaaagcagctgaaggagctgaagctgaagctgagcgaggagcagggcagcgcccccaagggcccccccagaaacctgctgtgcgagcagcccaccgtgcccagagagaacggcaagcccgaggccgccggccccgagcccagcagcagcggcgaggagacccccgacgccgccctgacctgcctgaaggagagaagagagcagctgcccccccaggaggacagcaaggtgaccaagcaggacaagaacctgatcaagcccctgtacgacagatacagaatcatcaagcagatcctgagcacccccagcctgatccccaccatccaggaggaggaggacagcgacgaggacagaccccagggcagccagcagcccagcctggccgaccccgccagccacctgcccgtgggcgaccacctgacctacagcaacgagaccgagcccgtgagagccctgctgcccgacgagaagaaggaggtgaagccccccgccctgagcatgagcaacctgcacgaggccaccatgcccgtgctgctggaccacctgagagagaccagagccgacaagaagagactgagaaaggccctgagagagttcgaggagcagttcttcaagcagaccggcagaagcccccagaaggaggacagaatccccatggccgacgagtactacgagtacaagcacatcaaggccaagctgagactgctggaggtgctgatcagcaagcaggacgtggccaagaccatctag

SEQ ID NO: 20910 - DNA, 1464 bp, Artificial Sequence
  Description of Artificial Sequence: Synthetic coding sequence
atgttcagctgcttctgcttcagcctgcaggacaacagcttcagcagcaccaccgtgaccgagtgcgacgaggaccccgtgagcctgcacgaggaccagaccgactgcagcagcctgagagacgagaacaacaaggagaactaccccgacgccggcgccctggtggaggagcacgccccccccagctgggagccccagcagcagaacgtggaggccaccgtgctggtggacagcgtgctgagacccagcatgggcaacttcaagagcagaaagcccaagagcatcttcaaggccgagagcggcagaagccacggcgagagccaggagaccgagcacgtggtgagcagccagagcgagtgccaggtgagagccggcacccccgcccacgagagcccccagaacaacgccttcaagtgccaggagaccgtgagactgcagcccagaatcgaccagagaaccgccatcagccccaaggacgccttcgagaccagacaggacctgaacgaggaggaggccgcccaggtgcacggcgtgaaggaccccgcccccgccagcacccagagcgtgctggccgacggcaccgacagcgccgaccccagccccgtgcacaaggacggccagaacgaggccgacagcgcccccgaggacctgcacagcgtgggcaccagcagactgctgtaccacatcaccgacggcgacaaccccctgctgagccccagatgcagcatcttcagccagagccagagattcaacctggaccccgagagcgcccccagcccccccagcacccagcagttcatgatgcccagaagcagcagcagatgcagctgcggcgacggcaaggagccccagaccatcacccagctgaccaagcacatccagagcctgaagagaaagatcagaaagttcgaggagaagttcgagcaggagaagaagtacagagtgaccaagcaggacaagaacctgatcaagcccctgtacgacagatacagaatcatcaagcagatcctgagcacccccagcctgatccccaccatccaggaggaggaggacagcgacgaggacagaccccagggcagccagcagcccagcctggccgaccccgccagccacctgcccgtgggcgaccacctgacctacagcaacgagaccgagcccgtgagagccctgctgcccgacgagaagaaggaggtgaagccccccgccctgagcatgagcaacctgcacgaggccaccatgcccgtgctgctggaccacctgagagagaccagagccgacaagaagagactgagaaaggccctgagagagttcgaggagcagttcttcaagcagaccggcagaagcccccagaaggaggacagaatccccatggccgacgagtactacgagtacaagcacatcaaggccaagctgagactgctggaggtgctgatcagcaagcaggacgtggccaagaccatctag

SEQ ID NO: 20911 - DNA, 1377 bp, Artificial Sequence
  Description of Artificial Sequence: Synthetic coding sequence
atgttcagctgcttctgcttcagcctgcaggacaacagcttcagcagcaccaccgtgaccgagtgcgacgaggaccccgtgagcctgcacgaggaccagaccgactgcagcagcctgagagacgagaacaacaaggagaactaccccgacgccggcgccctggtggaggagcacgccccccccagctgggagccccagcagcagaacgtggaggccaccgtgctggtggacagcgtgctgagacccagcatgggcaacttcaagagcagaaagcccaagagcatcttcaaggccgagagcggcagaagccacggcgagagccaggagaccgagcacgtggtgagcagccagagcgagtgccaggtgagagccggcacccccgcccacgagagcccccagaacaacgccttcaagtgccaggagaccgtgagactgcagcccagaatcgaccagagaaccgccatcagccccaaggacgccttcgagaccagacaggacctgaacgaggaggaggccgcccaggtgcacggcgtgaaggaccccgcccccgccagcacccagagcgtgctggccgacggcaccgacagcgccgaccccagccccgtgcacaaggacggccagaacgaggccgacagcgcccccgaggacctgcacagcgtgggcaccagcagactgctgtaccacatcaccgacggcgacaaccccctgctgagccccagatgcagcatcttcagccagagccagagattcaacctggaccccgagagcgcccccagcccccccagcacccagcagttcatgatgcccagaagcagcagcagatgcagctgcggcgacggcaaggagccccagaccatcacccagctgaccaagcacatccagagcctgaagagaaagatcagaaagttcgaggagaagttcgagcaggagaagaagtacagacccagccacggcgacaagaccagcaaccccgaggtgctgaagtggatgaacgacctggccaagggcagaaagcagctgaaggagctgaagctgaagctgagcgaggagcagggcagcgcccccaagggcccccccagaaacctgctgtgcgagcagcccaccgtgcccagagagaacggcaagcccgaggccgccggccccgagcccagcagcagcggcgaggagacccccgacgccgccctgacctgcctgaaggagagaagagagcagctgcccccccaggaggacagcaaggtgaccaagcaggacaagaacctgatcaagcccctgtacgacagatacagaatcatcaagcagatcctgagcacccccagcctgatccccaccatcgtgagccaggacacctgcatgctgctgctgtgcaccgacgtgtag

SEQ ID NO: 20912 - DNA, 1509 bp, Artificial Sequence
  Description of Artificial Sequence: Synthetic coding sequence
atgggcaacttcaagagcagaaagcccaagagcatcttcaaggccgagagcggcagaagccacggcgagagccaggagaccgagcacgtggtgagcagccagagcgagtgccaggtgagagccggcacccccgcccacgagagcccccagaacaacgccttcaagtgccaggagaccgtgagactgcagcccagaatcgaccagagaaccgccatcagccccaaggacgccttcgagaccagacaggacctgaacgaggaggaggccgcccaggtgcacggcgtgaaggaccccgcccccgccagcacccagagcgtgctggccgacggcaccgacagcgccgaccccagccccgtgcacaaggacggccagaacgaggccgacagcgcccccgaggacctgcacagcgtgggcaccagcagactgctgtaccacatcaccgacggcgacaaccccctgctgagccccagatgcagcatcttcagccagagccagagattcaacctggaccccgagagcgcccccagcccccccagcacccagcagttcatgatgcccagaagcagcagcagatgcagctgcggcgacggcaaggagccccagaccatcacccagctgaccaagcacatccagagcctgaagagaaagatcagaaagttcgaggagaagttcgagcaggagaagaagtacagacccagccacggcgacaagaccagcaaccccgaggtgctgaagtggatgaacgacctggccaagggcagaaagcagctgaaggagctgaagctgaagctgagcgaggagcagggcagcgcccccaagggcccccccagaaacctgctgtgcgagcagcccaccgtgcccagagagaacggcaagcccgaggccgccggccccgagcccagcagcagcggcgaggagacccccgacgccgccctgacctgcctgaaggagagaagagagcagctgcccccccaggaggacagcaaggtgaccaagcaggacaagaacctgatcaagcccctgtacgacagatacagaatcatcaagcagatcctgagcacccccagcctgatccccaccatccaggaggaggaggacagcgacgaggacagaccccagggcagccagcagcccagcctggccgaccccgccagccacctgcccgtgggcgaccacctgacctacagcaacgagaccgagcccgtgagagccctgctgcccgacgagaagaaggaggtgaagccccccgccctgagcatgagcaacctgcacgaggccaccatgcccgtgctgctggaccacctgagagagaccagagccgacaagaagagactgagaaaggccctgagagagttcgaggagcagttcttcaagcagaccggcagaagcccccagaaggaggacagaatccccatggccgacgagtactacgagtacaagcacatcaaggccaagctgagactgctggaggtgctgatcagcaagcaggacgtggccaagaccatctag

SEQ ID NO: 20913 - DNA, 18 bp, Artificial Sequence
  Description of Artificial Sequence: Synthetic coding sequence
atgggcaacttcaagtag

SEQ ID NO: 20914 - DNA, 78 bp, Artificial Sequence
  Description of Artificial Sequence: Synthetic coding sequence
atgggcaacttcaagagcagaaagcccaagagcatcttcaaggccgagagcggcagaagccacggcgagagccagtag

SEQ ID NO: 20915 - DNA, 999 bp, Artificial Sequence
  Description of Artificial Sequence: Synthetic coding sequence
atggacagcaccagcagcctgcacggcagcagcctgcacagacccagcaccgagcagaccagaaccgacttcagctgggacggcatcaacctgagcatggaggacaccaccagcatcctgcccaagctgaagagaaacagcaacgcctacggcatcggcgccctggccaagagcagcttcagcggcatcagcagaagcatgaaggaccacgtgaccaagcccaccgccatgggccagggcagagtggcccacatgatcgagtggcagggctggggcaagacccccgccgtgcagccccagcacagccacgagagcgtgagaagagacaccgacgcctacagcgacctgagcgacggcgagaaggaggccagattcctggccggcgtgatggagcagttcgccatcagcgaggccaccctgatggcctggagcagcatggacggcgaggacatgagcgtgaacagcacccaggagcccctgggctgcaactacagcgacaactaccaggagctgatggacagccaggacgccctggcccaggcccccatggacggctggccccacagctacgtgagccagggcatgtactgcctgggcagcagcgacgcctgggaggccagcgaccagagcctgatcgccagccccgccaccggcagctacctgggccccgccttcgacgacagccagcccagcctgcacgagatgggccccagccagcccgccagcggctacagcgccctggagcccccccccctgctgggcggcgacaccgactgggcccccggcgtgggcgccgtggacctggccagaggccccgccgaggaggagaagagacccctggcccccgaggaggaggaggacgccggctgcagagacctggagagcctgagccccagagaggaccccgagatgagcaccgccctgagcagaaaggtgagcgacgtgaccagcagcggcgtgcagagcttcgacgaggaggagggcgaggccaacaactag

SEQ ID NO: 20916 - DNA, 999 bp, Artificial Sequence; identical to SEQ ID NO: 20915
  Description of Artificial Sequence: Synthetic coding sequence

SEQ ID NO: 20917 - DNA, 999 bp, Artificial Sequence; identical to SEQ ID NO: 20915
  Description of Artificial Sequence: Synthetic coding sequence

SEQ ID NO: 20918 - DNA, 1083 bp, Artificial Sequence
  Description of Artificial Sequence: Synthetic coding sequence
atgggctgcatcggcagcagaaccgtgggcaacgaggtgatcgccgtggactggaagggcctgaaggacgtggaccagatcaacatggacagcaccagcagcctgcacggcagcagcctgcacagacccagcaccgagcagaccagaaccgacttcagctgggacggcatcaacctgagcatggaggacaccaccagcatcctgcccaagctgaagagaaacagcaacgcctacggcatcggcgccctggccaagagcagcttcagcggcatcagcagaagcatgaaggaccacgtgaccaagcccaccgccatgggccagggcagagtggcccacatgatcgagtggcagggctggggcaagacccccgccgtgcagccccagcacagccacgagagcgtgagaagagacaccgacgcctacagcgacctgagcgacggcgagaaggaggccagattcctggccggcgtgatggagcagttcgccatcagcgaggccaccctgatggcctggagcagcatggacggcgaggacatgagcgtgaacagcacccaggagcccctgggctgcaactacagcgacaactaccaggagctgatggacagccaggacgccctggcccaggcccccatggacggctggccccacagctacgtgagccagggcatgtactgcctgggcagcagcgacgcctgggaggccagcgaccagagcctgatcgccagccccgccaccggcagctacctgggccccgccttcgacgacagccagcccagcctgcacgagatgggccccagccagcccgccagcggctacagcgccctggagcccccccccctgctgggcggcgacaccgactgggcccccggcgtgggcgccgtggacctggccagaggccccgccgaggaggagaagagacccctggcccccgaggaggaggaggacgccggctgcagagacctggagagcctgagccccagagaggaccccgagatgagcaccgccctgagcagaaaggtgagcgacgtgaccagcagcggcgtgcagagcttcgacgaggaggagggcgaggccaacaactag

SEQ ID NO: 20919 - DNA, 1011 bp, Artificial Sequence
  Description of Artificial Sequence: Synthetic coding sequence
ttcctgctgggcagacaccagagaaccgtgagcacccacgtgctgaacctgtgccccagcttccccgagcactggggctacatccccccctgggacagctggctgagcatggaggacaccaccagcatcctgcccaagctgaagagaaacagcaacgcctacggcatcggcgccctggccaagagcagcttcagcggcatcagcagaagcatgaaggaccacgtgaccaagcccaccgccatgggccagggcagagtggcccacatgatcgagtggcagggctggggcaagacccccgccgtgcagccccagcacagccacgagagcgtgagaagagacaccgacgcctacagcgacctgagcgacggcgagaaggaggccagattcctggccggcgtgatggagcagttcgccatcagcgaggccaccctgatggcctggagcagcatggacggcgaggacatgagcgtgaacagcacccaggagcccctgggctgcaactacagcgacaactaccaggagctgatggacagccaggacgccctggcccaggcccccatggacggctggccccacagctacgtgagccagggcatgtactgcctgggcagcagcgacgcctgggaggccagcgaccagagcctgatcgccagccccgccaccggcagctacctgggccccgccttcgacgacagccagcccagcctgcacgagatgggccccagccagcccgccagcggctacagcgccctggagcccccccccctgctgggcggcgacaccgactgggcccccggcgtgggcgccgtggacctggccagaggccccgccgaggaggagaagagacccctggcccccgaggaggaggaggacgccggctgcagagacctggagagcctgagccccagagaggaccccgagatgagcaccgccctgagcagaaaggtgagcgacgtgaccagcagcggcgtgcagagcttcgacgaggaggagggcgaggccaacaactag

SEQ ID NO: 20920 - DNA, 843 bp, Artificial Sequence
  Description of Artificial Sequence: Synthetic coding sequence
atgggcagctgcgtgagcagagacctgttcaccagcgcccacaagaactgccccatgccccagggcgccgaccccctgaaccccgacctgcccagcggcagaacccccaccgtggcccccgactgcgtgatcggcaaggacaagcagatggacttctgctgggacccctggcagagatgcttccagaccaccaacggctacctgagcgacagcagaagcagacccggcaactacaacgtggccgccctggccaccagcagcctggtgggcgtggtgcagagcatcaaggaccacatcaccaagcccaccgccatggccagaggcagagtggcccacctgatcgagtggaagggctggagcgcccagcccgccggctgggagctgagccccgccgaggacgagcactactgctgcctgcccgacgagctgagagaggccagattcgccgccggcgtggccgagcagttcgccatcaccgaggccaccctgagcgcctggagcagcctggacgaggaggagctgcaccccgagaacagcccccagggcatcgtgcagctgcaggacctggagagcatctacctgcaggacagcctgcccagcggccccagccaggacgacagcctgcaggccttcagcagccccagccccagccccgacagctgccccagccccgaggagccccccagcaccgccggcatcccccagccccccagccccgagctgcagcacagaagaagactgcccggcgcccagggccccgagggcggcacccacccccccggcagcctgcccagcatggacagcggcagcctgtgggaggaggacgaggtgttctacaactag

SEQ ID NO: 20921 - DNA, 747 bp, Artificial Sequence
  Description of Artificial Sequence: Synthetic coding sequence
atgggcaagagagacaacagagtggcctacatgaaccccatcgccatggccagatggagaggccccacccagagcgtgggccccaccatccaggactacctgaacagacccagacccacctgggaggaggtgaagaagcagctggagaacaagaagaccggcagcaaggccctggccgagttcgaggagaagatgaacgagaactggaagaaggagctggagaagagcagagagaagctgctgagcggcaacgagagcagcagcaagaagagagagagaaagaagaagagaaagaagaagagctgcagaagcagcagcagcagcagcagcagcgacagcagcagcagcagcagcgacagcgaggacgaggagaagaagcagggcaagagaagaaagaagaagaagaacagaagctacaagagcagccagagcagcacccacgagagcgagagcgagagcaaggagagcgtgaagaagaagaagaagagcaaggacgagaccgagaaggagaaggacgtgagaagcctgagcaagaagagaaagaagagctaccccgacgacaagcccctgagcagcgagagcagcagcgagagcgactacgaggaggacgtgcaggccaagaagaagagaagatgcgaggagagagagcaggccaaggagaaggtgaagaagaagaagaagaagcagcacaagaagcacagcaagaagaagaagaagaagagcggcagcagccacaagagcagatag

SEQ ID NO: 20922 - DNA, 747 bp, Artificial Sequence; identical to SEQ ID NO: 20921
  Description of Artificial Sequence: Synthetic coding sequence

SEQ ID NO: 20923 - DNA, 747 bp, Artificial Sequence; identical to SEQ ID NO: 20921
  Description of Artificial Sequence: Synthetic coding sequence

SEQ ID NO: 20924 - DNA, 747 bp, Artificial Sequence; identical to SEQ ID NO: 20921
  Description of Artificial Sequence: Synthetic coding sequence

SEQ ID NO: 20925 - DNA, 714 bp, Artificial Sequence
  Description of Artificial Sequence: Synthetic coding sequence
atgaaccccatcgccatggccagaagcagaggccccatccagagcagcggccccaccatccaggactacctgaacagacccagacccacctgggaggaggtgaaggagcagctggagaagaagaagaagggcagcaaggccctggccgagttcgaggagaagatgaacgagaactggaagaaggagctggagaagcacagagagaagctgctgagcggcagcgagagcagcagcaagaagagacagagaaagaagaaggagaagaagaagagcggcagatacagcagcagcagcagcagcagcagcgacagcagcagcagcagcagcgacagcgaggacgaggacaagaagcagggcaagagaagaaagaagaagaagaacagaagccacaagagcagcgagagcagcatgagcgagaccgagagcgacagcaaggacagcctgaagaagaagaagaagagcaaggacggcaccgagaaggagaaggacatcaagggcctgagcaagaagagaaagatgtacagcgaggacaagcccctgagcagcgagagcctgagcgagagcgagtacatcgaggaggtgagagccaagaagaagaagagcagcgaggagagagagaaggccaccgagaagaccaagaagaagaagaagcacaagaagcacagcaagaagaagaagaagaaggccgccagcagcagccccgacagcccctag

SEQ ID NO: 20926 - DNA, 714 bp, Artificial Sequence; identical to SEQ ID NO: 20925
  Description of Artificial Sequence: Synthetic coding sequence

SEQ ID NO: 20927 - DNA, 744 bp, Artificial Sequence
  Description of Artificial Sequence: Synthetic coding sequence
atgggcaagagagacaacagagtggcctacatgaaccccatcgccatggccagaagcagaggccccatccagagcagcggccccaccatccaggactacctgaacagacccagacccacctgggaggaggtgaaggagcagctggagaagaagaagaagggcagcaaggccctggccgagttcgaggagaagatgaacgagaactggaagaaggagctggagaagcacagagagaagctgctgagcggcagcgagagcagcagcaagaagagacagagaaagaagaaggagaagaagaagagcggcagatacagcagcagcagcagcagcagcagcgacagcagcagcagcagcagcgacagcgaggacgaggacaagaagcagggcaagagaagaaagaagaagaagaacagaagccacaagagcagcgagagcagcatgagcgagaccgagagcgacagcaaggacagcctgaagaagaagaagaagagcaaggacggcaccgagaaggagaaggacatcaagggcctgagcaagaagagaaagatgtacagcgaggacaagcccctgagcagcgagagcctgagcgagagcgagtacatcgaggaggtgagagccaagaagaagaagagcagcgaggagagagagaaggccaccgagaagaccaagaagaagaagaagcacaagaagcacagcaagaagaagaagaagaaggccgccagcagcagccccgacagcccctag

SEQ ID NO: 20928 - DNA, 93 bp, Artificial Sequence
  Description of Artificial Sequence: Synthetic coding sequence
atgaaccccatcgccatggccagaagcagaggccccatccagagcagcggccccaccatccaggactacctgaacagacccagacccacctag

SEQ ID NO: 20929 - DNA, 258 bp, Artificial Sequence
  Description of Artificial Sequence: Synthetic coding sequence
atgctgctgaccatcgagaccaagagccactacgtggcccaggccggcctggagctgctggccagcagcgacccccccaccagcgccagccagagcgtgggcatcatcgacatgagccactgcacctggcccaccctgggcaagttcctgaaccccagcaagccccacttcagccccatcaccaagggcaaggacggcaacatcttccccaccaagttcctgagcgacgccctgaccgagctgagactgtgcacctag

SEQ ID NO: 20930 - DNA, 225 bp, Artificial Sequence
  Description of Artificial Sequence: Synthetic coding sequence
atgctgctgaccatcgagaccaagagccactacgtggcccaggccggcctggagctgctggccagcagcgacccccccaccagcgccagccagagcgtgggcatcatcgacatgagccactgcacctggcccaccctgggcaagttcctgaaccccagcaagccccacttcagccccatcaccaagggcaaggacggcaacatcttccccaccaagttcctgtag

SEQ ID NO: 20931 - DNA, 258 bp, Artificial Sequence; identical to SEQ ID NO: 20929
  Description of Artificial Sequence: Synthetic coding sequence

SEQ ID NO: 20932 - DNA, 258 bp, Artificial Sequence; identical to SEQ ID NO: 20929
  Description of Artificial Sequence: Synthetic coding sequence

SEQ ID NO: 20933 - DNA, 1287 bp, Artificial Sequence
  Description of Artificial Sequence: Synthetic coding sequence
atgaacagacagggcaacagaaagaccaccaaggagggcagcaacgacctgaagttccagaacttcagcctgcccaagaacagaagctggcccagaatcaacagcgccaccggccagtaccagagaatgaacaagcccctgctggactgggagagaaacttcgccgccgtgctggacggcgccaagggccacagcgacgacgactacgacgaccccgagctgagaatggaggagacctggcagagcatcaagatcctgcccgccagacccatcaaggagagcgagtacgccgacacccactacttcaaggtggccatggacacccccctgcccctggacaccagaaccagcatcagcatcggccagcccacctggaacacccagaccagactggagagagtggacaagcccatcagcaaggacgtgagaagccagaacatcaagggcgacgccagcgtgagaaagaacaagatccccctgcccccccccagacccctgatcaccctgcccaagaagtaccagcccctgccccccgagcccgagagcagcagaccccccctgagccagagacacaccttccccgaggtgcagagaatgcccagccagatcagcctgagagacctgagcgaggtgctggaggccgagaaggtgccccacaaccagagaaagcccgagagcacccacctgctggagaaccagaacacccaggagatccccctggccatcagcagcagcagcttcaccaccagcaaccacagcgtgcagaacagagaccacagaggcggcatgcagccctgcagcccccagagatgccagccccccgccagctgcagcccccacgagaacatcctgccctacaagtacaccagctggagaccccccttccccaagagaagcgacagaaaggacgtgcagcacaacgagtggtacatcggcgagtacagcagacaggccgtggaggaggccttcatgaaggagaacaaggacggcagcttcctggtgagagactgcagcaccaagagcaaggaggagccctacgtgctggccgtgttctacgagaacaaggtgtacaacgtgaagatcagattcctggagagaaaccagcagttcgccctgggcaccggcctgagaggcgacgagaagttcgacagcgtggaggacatcatcgagcactacaagaacttccccatcatcctgatcgacggcaaggacaagaccggcgtgcacagaaagcagtgccacctgacccagcccctgcccctgaccagacacctgctgcccctgtag

SEQ ID NO: 20934 - DNA, 2322 bp, Artificial Sequence
  Description of Artificial Sequence: Synthetic coding sequence
atgaaggccgccgtgctggacctgggcagcctgctggccaagctgttcgagaccagcaccgccccccccgccggccccagcagcagacccagcggcggcgccgccgccgccggcagcggcggcagcagagccggcacccccctgggcaccgcccccaccctgctgagagccctggcccccgacagccccagcgccagcagaagaagccccgcccccctgctgagcagcccctacagcagaggcagcgccgccagcagagccgccggcgccgtgggcaccctgctgagctggcccagcagccccagagccggcaaggcccccccccagccccccacccccagcggcggcggctgcagccccgccagactggtggtgcccgccagaccccccagcggccccggcggcgtgtgggccgccctgcccagaaaccccctgcagcccggccccggcgagagagagctgggcgcctgcgtggcccccggcgccggccccagaaccctgttcctgaccctgcccgacatcggcgaggagggcgccagcgacggcgacagcggcgacggcgaggccagaggcctgagcgagggcagaagaagacacggcttcaccgtgagaagcaaggacagcctgcccacccacttcaccagaaacgtgcagaaggccatcgacaagtacacctgcaagagcctgagcagcttcagcagcagcggcagccacacccccaccggcgcccacaccagctggagcggcagcgccacccagagcagcaccaccggcagcagcaccgagagaggcagcgtgtacagctggagagacgacgagttcgacgaggccagcagccagagcgtgcagagactgctgtgggaggtggaggagatgctgttcgagggcaaggtgaacccccagacccagagcctgctggccgagtgcggcgagtggaccagaagaagcctgcacctgagagtgctgggcagacagctgatcctgcccaccgacaagggcgtgcagcacttccagggcagcacccccgccagcgccgtgcacagaccccccctgagcgcctgcggccacagcagcaacatcagagagctgtgcatcagcggcagccagatcgtgcccgccgccctgagcgccagcgccctgcccggccccgacgacaccggcgtggccgacctgaccgccagaagcagcctggaggaggaggtgtaccacgtggacggcaagatcgaggagtacttcgccttcgacagaaaggaggacgacgacgagtgcctggagcagaagcccgcccagcccggcagaaagtggagaaagctgggcctgccccccgtgagccccagagactgcgtgaaggacgccgtggccgccgaggtgttcgaccacgtgtggaccaacatggtggagctgctggaggagctgatcagaaagcactgggagaccaccctgaccgagggcaagaagcagagagagaccctgaaggtggccggcaacagattcccccacgtgctggtgccccacgcccacgccgacggcgccagcggcccccccagcggccacgccgaggcccacggcatcagcctggccagcagactgaaccccccccagatccaccacttcagcagcagcttctacagcgacatgaacggcgtgatgaccatccaggccaagcccctgcagagaagacccgcctacttcgccgacagaacccagaacgagaaggaggacaaggccagcggcggcggcgccggcgccctgagcagcgccccccacagactgggcagagccagcgacacccacggcctgagccccagcgccaagaagacccccgtgccctggagactgcccagcctggccagcgacagccagagactgaagacccccaacatctacagcgacgaggtgctgagaggcaccaagctgcccaccggcgtggaccacatggccagccccctggtgcagaccagcagaagcagattcccccccctggtgaccgagaccagaggccagaacaccgccgtgcccggctgcagactggtgagctacagaggcagacacctgcagaacagagtgctgagcgccatgcccgacggcaccgagagaagcagactgagagagagaaccgccaccctggagagactgagcagacccagcaccacccacaccttcagacagagcgacacccccagaaagagcagcctgacccagatggagttcgccgcccacacctggaccggccagagcatcctgaccggcagccagtacgtgcccaagagcttccagagaaccaccctgaccttcaagagaagattccaggtgaccagctag

SEQ ID NO: 20935 - DNA, 1449 bp, Artificial Sequence
  Description of Artificial Sequence: Synthetic coding sequence
atgctgttcgagggcaaggtgaacccccagacccagagcctgctggccgagtgcggcgagtggaccagaagaagcctgcacctgagagtgctgggcagacagctgatcctgcccaccgacaagggcgtgcagcacttccagggcagcacccccgccagcgccgtgcacagaccccccctgagcgcctgcggccacagcagcaacatcagagagctgtgcatcagcggcagccagatcgtgcccgccgccctgagcgccagcgccctgcccggccccgacgacaccggcgtggccgacctgaccgccagaagcagcctggaggaggaggtgtaccacgtggacggcaagatcgaggagtacttcgccttcgacagaaaggaggacgacgacgagtgcctggagcagaagcccgcccagcccggcagaaagtggagaaagctgggcctgccccccgtgagccccagagactgcgtgaaggacgccgtggccgccgaggtgttcgaccacgtgtggaccaacatggtggagctgctggaggagctgatcagaaagcactgggagaccaccctgaccgagggcaagaagcagagagagaccctgaaggtggccggcaacagattcccccacgtgctggtgccccacgcccacgccgacggcgccagcggcccccccagcggccacgccgaggcccacggcatcagcctggccagcagactgaaccccccccagatccaccacttcagcagcagcttctacagcgacatgaacggcgtgatgaccatccaggccaagcccctgcagagaagacccgcctacttcgccgacagaacccagaacgagaaggaggacaaggccagcggcggcggcgccggcgccctgagcagcgccccccacagactgggcagagccagcgacacccacggcctgagccccagcgccaagaagacccccgtgccctggagactgcccagcctggccagcgacagccagagactgaagacccccaacatctacagcgacgaggtgctgagaggcaccaagctgcccaccggcgtggaccacatggccagccccctggtgcagaccagcagaagcagattcccccccctggtgaccgagaccagaggccagaacaccgccgtgcccggctgcagactggtgagctacagaggcagacacctgcagaacagagtgctgagcgccatgcccgacggcaccgagagaagcagactgagagagagaaccgccaccctggagagactgagcagacccagcaccacccacaccttcagacagagcgacacccccagaaagagcagcctgacccagatggagttcgccgcccacacctggaccggccagagcatcctgaccggcagccagtacgtgcccaagagcttccagagaaccaccctgaccttcaagagaagattccaggtgaccagctag

SEQ ID NO: 20936 - DNA, 1449 bp, Artificial Sequence; identical to SEQ ID NO: 20935
  Description of Artificial Sequence: Synthetic coding sequence

SEQ ID NO: 20937 - DNA, 186 bp, Artificial Sequence
  Description of Artificial Sequence: Synthetic coding sequence
atgctgttcgagggcaaggtgaacccccagacccagagcctgctggccgagtgcggcgagtggaccagaagaagcctgcacctgagagtgctgggcagacagctgatcctgcccaccgacaagggcgtgcagcacttccagggcagcacccccgccagcgccgtgcacagaccccccctgagctag

SEQ ID NO: 20938 - DNA, 1749 bp, Artificial Sequence
  Description of Artificial Sequence: Synthetic coding sequence
atgatcagcagatacaccagaaaggccgtgccccagagcctggagctgaagggcatcaccaagcacgccctgaaccaccaccccccccccgagaagctggaggagatcagccccaccagcgacagccacgagaaggacaccagcagccagagcaagagcgacatcaccagagagagcagcttcaccagcgccgacaccggcaacagcctgagcgccttccccagctacaccggcgccggcatcagcaccgagggcagcagcgacttcagctggggctacggcgagctggaccagaacgccaccgagaaggtgcagaccatgttcaccgccatcgacgagctgctgtacgagcagaagctgagcgtgcacaccaagagcctgcaggaggagtgccagcagtggaccgccagcttcccccacctgagaatcctgggcagacagatcatcacccccagcgagggctacagactgtaccccagaagccccagcgccgtgagcgccagctacgagaccaccctgagccaggagagagacagcaccatcttcggcatcagaggcaagaagctgcacttcagcagcagctacgcccacaaggccagcagcatcgccaagagcagcagcttctgcagcatggagagagacgaggaggacagcatcatcgtgagcgagggcatcatcgaggagtacctggccttcgaccacatcgacatcgaggagggcttccacggcaagaagagcgaggccgccaccgagaagcagaagctgggctacccccccatcgcccccttctactgcatgaaggaggacgtgctggcctacgtgttcgacagcgtgtggtgcaaggtggtgagctgcatggagcagctgaccagaagccactgggagggcttcgccagcgacgacgagagcaacgtggccgtgaccagacccgacagcgagagcagctgcgtgctgagcgagctgcaccccctggtgctgcccagagtgccccagagcaaggtgctgtacatcaccagcaaccccatgagcctgtgccaggccagcagacaccagcccaacgtgaacgacctgctggtgcacggcatgcccctgcagcccagaaacctgagcctgatggacaagctgctggacctggacgacaagctgctgatgagacccggcagcagcaccatcctgagcaccagaaactggcccaacagagccgtggagttcagcaccagcagcctgagctacaccgtgcagagcaccagaagaagaaaccccccccccagaaccctgcaccccatcagcaccagccacagctgcgccgagacccccagaagcgtggaggagatcctgagaggcgccagagtgcccgtggcccccgacagcctgagcagccccagccccacccccctgagcagaaacaacctgctgccccccatcggcaccgccgaggtggagcacgtgagcaccgtgggcccccagagacagatgaagccccacggcgacagcagcagagcccagagcgccgtggtggacgagcccaactaccagcagccccaggagagactgctgctgcccgacttcttccccagacccaacaccacccagagcttcctgctggacacccagtacagaagaagctgcgccgtggagtacccccaccaggccagacccggcagaggcagcgccggcccccagctgcacggcagcaccaagagccagagcggcggcagacccgtgagcagaaccagacagggcccctag

SEQ ID NO: 20939 - DNA, 1410 bp, Artificial Sequence
  Description of Artificial Sequence: Synthetic coding sequence
tgattcaccagcgccgacaccggcaacagcctgagcgccttccccagctacaccggcgccggcatcagcaccgagggcagcagcgacttcagctggggctacggcgagctggaccagaacgccaccgagaaggtgcagaccatgttcaccgccatcgacgagctgctgtacgagcagaagctgagcgtgcacaccaagagcctgcaggaggagtgccagcagtggaccgccagcttcccccacctgagaatcctgggcagacagatcatcacccccagcgagggctacagactgtaccccagaagccccagcgccgtgagcgccagctacgagaccaccctgagccaggagagagacagcaccatcttcggcatcagaggcaagaagctgcacttcagcagcagctacgcccacaaggccagcagcatcgccaagagcagcagcttctgcagcatggagagagacgaggaggacagcatcatcgtgagcgagggcatcatcgaggagtacctggccttcgaccacatcgacatcgaggagggcttccacggcaagaagagcgaggccgccaccgagaagcagaagctgggctacccccccatcgcccccttctactgcatgaaggaggacgtgctggcctacgtgttcgacagcgtgtggtgcaaggtggtgagctgcatggagcagctgaccagaagccactgggagggcttcgccagcgacgacgagagcaacgtggccgtgaccagacccgacagcgagagcagctgcgtgctgagcgagctgcaccccctggtgctgcccagagtgccccagagcaagatgagcctgtgccaggccagcagacaccagcccaacgtgaacgacctgctggtgcacggcatgcccctgcagcccagaaacctgagcctgatggacaagctgctggacctggacgacaagctgctgatgagacccggcagcagcaccatcctgagcaccagaaactggcccaacagagccgtggagttcagcaccagcagcctgagctacaccgtgcagagcaccagaagaagaaaccccccccccagaaccctgcaccccatcagcaccagccacagctgcgccgagacccccagaagcgtggaggagatcctgagaggcgccagagtgcccgtggcccccgacagcctgagcagccccagccccacccccctgagcagaaacaacctgctgccccccatcggcaccgccgaggtggagcacgtgagcaccgtgggcccccagagacagatgaagccccacggcgacagcagcagagcccagagcgccgtggtggacgagcccaactaccagcagccccaggagagactgctgctgcccgacttcttccccagacccaacaccacccagagcttcctggtggagtag

SEQ ID NO: 20940 - DNA, 993 bp, Artificial Sequence
  Description of Artificial Sequence: Synthetic coding sequence
atggagagagacgaggaggacagcatcatcgtgagcgagggcatcatcgaggagtacctggccttcgaccacatcgacatcgaggagggcttccacggcaagaagagcgaggccgccaccgagaagcagaagctgggctacccccccatcgcccccttctactgcatgaaggaggacgtgctggcctacgtgttcgacagcgtgtggtgcaaggtggtgagctgcatggagcagctgaccagaagccactgggagggcttcgccagcgacgacgagagcaacgtggccgtgaccagacccgacagcgagagcagctgcgtgctgagcgagctgcaccccctggtgctgcccagagtgccccagagcaaggtgctgtacatcaccagcaaccccatgagcctgtgccaggccagcagacaccagcccaacgtgaacgacctgctggtgcacggcatgcccctgcagcccagaaacctgagcctgatggacaagctgctggacctggacgacaagctgctgatgagacccggcagcagcaccatcctgagcaccagaaactggcccaacagagccgtggagttcagcaccagcagcctgagctacaccgtgcagagcaccagaagaagaaaccccccccccagaaccctgcaccccatcagcaccagccacagctgcgccgagacccccagaagcgtggaggagatcctgagaggcgccagagtgcccgtggcccccgacagcctgagcagccccagccccacccccctgagcagaaacaacctgctgccccccatcggcaccgccgaggtggagcacgtgagcaccgtgggcccccagagacagatgctggacacccagtacagaagaagctgcgccgtggagtacccccaccaggccagacccggcagaggcagcgccggcccccagctgcacggcagcaccaagagccagagcggcggcagacccgtgagcagaaccagacagggcccctag

SEQ ID NO: 20941 - DNA, 1008 bp, Artificial Sequence
  Description of Artificial Sequence: Synthetic coding sequence
agcagcttctgcagcatggagagagacgaggaggacagcatcatcgtgagcgagggcatcatcgaggagtacctggccttcgaccacatcgacatcgaggagggcttccacggcaagaagagcgaggccgccaccgagaagcagaagctgggctacccccccatcgcccccttctactgcatgaaggaggacgtgctggcctacgtgttcgacagcgtgtggtgcaaggtggtgagctgcatggagcagctgaccagaagccactgggagggcttcgccagcgacgacgagagcaacgtggccgtgaccagacccgacagcgagagcagctgcgtgctgagcgagctgcaccccctggtgctgcccagagtgccccagagcaaggtgctgtacatcaccagcaaccccatgagcctgtgccaggccagcagacaccagcccaacgtgaacgacctgctggtgcacggcatgcccctgcagcccagaaacctgagcctgatggacaagctgctggacctggacgacaagctgctgatgagacccggcagcagcaccatcctgagcaccagaaactggcccaacagagccgtggagttcagcaccagcagcctgagctacaccgtgcagagcaccagaagaagaaaccccccccccagaaccctgcaccccatcagcaccagccacagctgcgccgagacccccagaagcgtggaggagatcctgagaggcgccagagtgcccgtggcccccgacagcctgagcagccccagccccacccccctgagcagaaacaacctgctgccccccatcggcaccgccgaggtggagcacgtgagcaccgtgggcccccagagacagatgctggacacccagtacagaagaagctgcgccgtggagtacccccaccaggccagacccggcagaggcagcgccggcccccagctgcacggcagcaccaagagccagagcggcggcagacccgtgagcagaaccagacagggcccctag

SEQ ID NO: 20942 - DNA, 831 bp, Artificial Sequence
  Description of Artificial Sequence: Synthetic coding sequence
atggccgccagcgccggcggccccggcagctggagcgagaacatcctggagtacttcctgagaaacagccagatcaccgccgaggacggcgccgagatcacctggtaccacgccgccaaccacaaggcccagaccaacgaggccctgaagagcaccgcccacatgatcgaggccgacgtgctgctgcccagcgacggcagcgagcacagccagcccatcatggcccacccccccgagaccaacagcgacaacaccctgcaggagtggctgaccgaggtgatgaagagcaacaagggcatcaagctggacttcaagagcctggccgtggtggagcccagcatgatgctgctggagaacgtgaagagacacctgaagagacccgtgtggatcaacgccgacatcctgcccggccccaacggcaacagcaaggtgatcgacgccaagcccttcctggacaccgtgatcagcttcttccccgacgtgaccttcagcctgggctggaccaccggctggcaccccgagaaggtgaacgagggctacagctggaccatggtgaaggagatggagtacatctgcaacgagctgagccagcccgtgaccttccccgtgagagccgccctggtgagacagagctgcagccagctgctgtggctgctgaagaagagcaacagatacagcctgaccatctggaccggcaagaacgacaactacagcgtggaggacctgctgtacatcagagaccacttcgacaagaagcaggtgttctacgacatcctggagccccagaaccacgagttcaagcaggccatcggcatcaaggtgaacctgtag

SEQ ID NO: 20943 - DNA, 435 bp, Artificial Sequence
  Description of Artificial Sequence: Synthetic coding sequence
atggtggacaaggacaccgagagagacatcgagatgaagagacagctgagaagactgagagagctgcacctgtacagcacctggaagaagtaccaggaggccatgaagaccagcctgggcgtgccccagagaggcgacctggaggacctggaggagcacgtgcccggccagaccgtgagcgaggaggccaccggcgtgcacatgatgcaggtggaccccgccaccctggccaagcagctggaggacagcaccatcaccggcagccaccagcagatgagcgccagccccagcagcgcccccgccgaggaggccaccgagaagaccaaggtggaggaggaggtgaagaccagaaagcccaagaagaagaccagaaagcccagcaagaagagcagatggaacgtgctgaagtgctgggacatcttcaacatcttctag

SEQ ID NO: 20944 - DNA, 1164 bp, Artificial Sequence
  Description of Artificial Sequence: Synthetic coding sequence
atgggctgcgtgtacagctgctgcctggaggtgtgctgcggcgaggacgagatcgtgtaccccagaatgcccggcgagagcaccgtgtgccacagagagagagagaagcccatcacctaccactggtaccactggcaccccggccacatctaccccagaatcgccagcatggaggactacgacgaggacctggtgcaggaggccagcagcgaggacgtgctgggcgtgcacatggtggacaaggacaccgagagagacatcgagatgaagagacagctgagaagactgagagagctgcacctgtacagcacctggaagaagtaccaggaggccatgaagaccagcctgggcgtgccccagtgcgagagagacgagggcagcctgggcaagcccctgtgcccccccgagatcctgagcgagaccctgcccggcagcgtgaagaagagagtgtgcttccccagcgaggaccacctggaggagttcatcgccgagcacctgcccgaggccagcaaccagagcctgctgaccgtggcccacagcgagagaggcatcagcttcagctgcgacctggaggacctggaggagcacggccccggccagaccgtgagcgaggaggccaccgaggtgcacaccatggagggcgaccccgacaccctggccgagttcctgatcagagacgtgctgcaggagctgagcagctacaacggcgaggaggaggaccccgaggaggtgaagaccagcctgggcgtgccccagagaggcgacctggaggacctggaggagcacgtgcccggccagaccgtgagcgaggaggccaccggcgtgcacatgatgcaggtggaccccgccaccctggccaagagcgacctggaggacctggaggagcacgtgcccgagcagaccgtgagcgaggaggccaccggcgtgcacatgatgcaggtggaccccgccaccctggccaagcagctggaggacagcaccatcaccggcagccaccagcagatgagcgccagccccagcagcgcccccgccgaggaggccaccgagaagaccaaggtggaggaggaggtgaagaccagaaagcccaagaagaagaccagaaagcccagcaagaagagcagatggaacgtgctgaagtgctgggacatcttcaacatcttctag

SEQ ID NO: 20945 - DNA, 1164 bp, Artificial Sequence
  Description of Artificial Sequence: Synthetic coding sequence
atgggctgcgcctacagctgctgcctggaggtgtgctgcggcgaggacgagatcgtgtaccccagaatgcccggcgagagcaccgtgtgccacagagagagagagaagcccatcacctaccactggtaccactggcaccccggccacatctaccccagagtggccagcatggaggactacgacgaggacctggtgcaggaggccagcagcgaggacgtgctgggcgtgcacatggtggacaaggacaccgagagagacatcgagatgaagagacagctgagaagactgagagagctgcacctgtacagcacctggaagaagtaccaggaggccatgaagaccagcctgggcgtgccccagtgcgagagagacgagggcagcctgggcaagcccctgtgcccccccgagatcctgagcgagaccctgcccggcagcgtgaagaagagagtgtgcttccccagcgaggaccacctggaggagttcatcgccgagcacctgcccgaggccagcaaccagagcctgctgaccgtggcccacgccgacaccggcatccagaccaacggcgacctggaggacctggaggagcacggccccggccagaccgtgagcgaggaggccaccgaggtgcacatgatggagggcgaccccgacaccctggccgagctgctgatcagagacgtgctgcaggagctgagcagctacaacggcgaggaggaggaccccgaggaggtgaagaccagcctgggcgtgccccagagaggcgacctggaggacctggaggagcacgtgcccggccagaccgtgagcgaggaggccaccggcgtgcacatgatgcaggtggaccccgccacccccgccaagagcgacctggaggacctggaggagcacgtgcccggccagaccgtgagcgaggaggccaccggcgtgcacatgatgcaggtggaccccgccaccctggccaagcagctggaggacagcaccatcaccggcagccaccagcagatgagcgccagccccagcagcgcccccgccgaggaggccaccgagaagaccaaggtggaggaggaggtgaagaccagaaagcccaagaagaagaccagaaagcccagcaagaagagcagatggaacgtgctgaagtgctgggacatcttcaacatcttctag

SEQ ID NO: 20946 - DNA, 933 bp, Artificial Sequence
  Description of Artificial Sequence: Synthetic coding sequence
atggtggacaaggacaccgagagagacatcgagatgaagagacagctgagaagactgagagagctgcacctgtacagcacctggaagaagtaccaggaggccatgaagaccagcctgggcgtgccccagtgcgagagagacgagggcagcctgggcaagcccctgtgcccccccgagatcctgagcgagaccctgcccggcagcgtgaagaagagagtgtgcttccccagcgaggaccacctggaggagttcatcgccgagcacctgcccgaggccagcaaccagagcctgctgaccgtggcccacgccgacaccggcatccagaccaacggcgacctggaggacctggaggagcacggccccggccagaccgtgagcgaggaggccaccgaggtgcacatgatggagggcgaccccgacaccctggccgagctgctgatcagagacgtgctgcaggagctgagcagctacaacggcgaggaggaggaccccgaggaggtgaagaccagcctgggcgtgccccagagaggcgacctggaggacctggaggagcacgtgcccggccagaccgtgagcgaggaggccaccggcgtgcacatgatgcaggtggaccccgccacccccgccaagagcgacctggaggacctggaggagcacgtgcccggccagaccgtgagcgaggaggccaccggcgtgcacatgatgcaggtggaccccgccaccctggccaagcagctggaggacagcaccatcaccggcagccaccagcagatgagcgccagccccagcagcgcccccgccgaggaggccaccgagaagaccaaggtggaggaggaggtgaagaccagaaagcccaagaagaagaccagaaagcccagcaagaagagcagatggaacgtgctgaagtgctgggacatcttcaacatcttctag

SEQ ID NO: 20947 - DNA, 933 bp, Artificial Sequence; identical to SEQ ID NO: 20946
  Description of Artificial Sequence: Synthetic coding sequence

SEQ ID NO: 20948 - DNA, 345 bp, Artificial Sequence
  Description of Artificial Sequence: Synthetic coding sequence
atggtggacaaggacaccgagagagacatcgagatgaagagacagctgagaagactgagagagctgcacctgtacagcacctggaagaagtaccaggaggccatgaagaccagcctgggcgtgccccagagaggcgacctggaggacctggaggagcacctgcccggccagaccgtgagcgaggaggccaccggcgtgcacatgatgcaggtggaccccgccacccccgccaagaagctggaggacagcaccatcaccggcagccaccagcagatgagcgccagccccagcagcgcccccgccgaggaggccaccgagaagaccaaggtggaggaggaggtgtag

SEQ ID NO: 20949 - DNA, 120 bp, Artificial Sequence
  Description of Artificial Sequence: Synthetic coding sequence
atggtggacaaggacaccgagagagacatcgagatgaagagacagctgagaagactgagagagctgcacctgtacagcacctggaagaagtaccaggaggccatgaagaccagcctgtag

SEQ ID NO: 20950 - DNA, 435 bp, Artificial Sequence
  Description of Artificial Sequence: Synthetic coding sequence
atggtggacaaggacaccgagagagacatcgagatgaagagacagctgagaagactgagagagctgcacctgtacagcacctggaagaagtaccaggaggccatgaagaccagcctgggcgtgccccagagaggcgacctggaggacctggaggagcacctgcccggccagaccgtgagcgaggaggccaccggcgtgcacatgatgcaggtggaccccgccacccccgccaagaagctggaggacagcaccatcaccggcagccaccagcagatgagcgccagccccagcagcgcccccgccgaggaggccaccgagaagaccaaggtggaggaggaggtgaagaccagaaagcccaagaagaagaccagaaagcccagcaagaagagcagatggaacgtgctgaagtgctgggacatcttcaacatcttctag

SEQ ID NO: 20951 - DNA, 1425 bp, Artificial Sequence
  Description of Artificial Sequence: Synthetic coding sequence
atgaagaccaagtgcatctgcgagctgtgcagctgcggcagacaccactgcccccacctgcccaccaagatctacgacaagaccgagaagccctgcctgctgagcgagtacaccgagaactaccccttctaccacagctacctgcccagagagagcttcaagcccagaagagagtaccagaagggccccatccccatggagggcctgaccaccagcagaagagacttcggcccccacaaggtggcccccgtgaaggtgcaccagtacgaccagttcgtgcccagcgaggagaacatggacctgctgaccacctacaagaaggactacaacccctaccccgtgtgcagagtggaccccatcaagcccagagacagcaagtacccctgcagcgacaagatggagtgcctgcccacctacaaggccgactacctgccctggaaccagcccagaagagagcccctgagactggagcacaagtaccagcccgccagcgtgagattcgacaacagaaccacccaccaggacgactaccccatcaagggcctggtgaagaccatcagctgcaagcccctggccatgcccaagctgtgcaacatccccctggaggacgtgaccaactacaagatgagctacgtggcccaccccgtggagaagagattcgtgcacgaggccgagaagttcagaccctgcgagatccccttcgagagcctgaccacccagaagcagagctacagaggcctgatgggcgagcccgccaagagcctgaagcccctggccagaccccccggcctggacatgcccttctgcaacaccaccgagttcagagacaagtaccaggcctggcccatgcccagaatgttcagcaaggcccccatcacctacgtgccccccgaggacagaatggacctgctgaccaccgtgcaggcccactacacctgccccaagggcgcccccgcccagagctgcagacccgccctgcagatcaagaagtgcggcagattcgagggcagcagcaccaccaaggacgactacaagcagtggagcagcatgagaaccgagcccgtgaagcccgtgccccagctggacctgcccaccgagcccctggactgcctgaccaccaccagagcccactacgtgccccacctgcccatcaacaccaagagctgcaagccccactggagcggccccagaggcaacgtgcccgtggagagccagaccacctacaccatcagcttcacccccaaggagatgggcagatgcctggccagctaccccgagccccccggctacaccttcgaggaggtggacgccctgggccacagaatctacaagcccgtgagccaggccggcagccagcagagcagccacctgagcgtggacgacagcgagaaccccaaccagagagagctggaggtgctggcctag

SEQ ID NO: 20952 - DNA, 849 bp, Artificial Sequence
  Description of Artificial Sequence: Synthetic coding sequence
atgcccaagctgtgcaacatccccctggaggacgtgaccaactacaagatgagctacgtggcccaccccgtggagaagagattcgtgcacgaggccgagaagttcagaccctgcgagatccccttcgagagcctgaccacccagaagcagagctacagaggcctgatgggcgagcccgccaagagcctgaagcccctggccagaccccccggcctggacatgcccttctgcaacaccaccgagttcagagacaagtaccaggcctggcccatgcccagaatgttcagcaaggcccccatcacctacgtgccccccgaggacagaatggacctgctgaccaccgtgcaggcccactacacctgccccaagggcgcccccgcccagagctgcagacccgccctgcagatcaagaagtgcggcagattcgagggcagcagcaccaccaaggacgactacaagcagtggagcagcatgagaaccgagcccgtgaagcccgtgccccagctggacctgcccaccgagcccctggactgcctgaccaccaccagagcccactacgtgccccacctgcccatcaacaccaagagctgcaagccccactggagcggccccagaggcaacgtgcccgtggagagccagaccacctacaccatcagcttcacccccaaggagatgggcagatgcctggccagctaccccgagccccccggctacaccttcgaggaggtggacgccctgggccacagaatctacaagcccgtgagccaggccggcagccagcagagcagccacctgagcgtggacgacagcgagaaccccaaccagagagagctggaggtgctggcctag

SEQ ID NO: 20953 - DNA, 1197 bp, Artificial Sequence
  Description of Artificial Sequence: Synthetic coding sequence
atgggcgccaagagcatgagaagctggtgcctgtgccagatctgcagctgcggcagcgactactgcccctacgagatcgtgaagcagcccagacacgtgcccgaggagtacaagcccaagcagggcaagatcgacctgggcaccacctacaagagagacctgaacagctacaaggtgcagcccgtggccatcgtgagacccctggagagacaggtgaagaagggcaagctggacaccgtgcccacctacaaggacgactacagagcctgggacctgcacaagagcgagctgtacaagcccgagcagacctaccacccccccaccgtgaagttcggcaacagcaccaccttccaggacgacttcgtgccccaggagatcaagcccagacagagcttcaagcccagcagcgtggtgaagagaagcaccgcccccttcaacggcatcaccagccacagactggactacatcccccaccagctggagctgaagttcgagagacccaaggaggtgtacaagcccaccgaccagagattcgaggacctgaccacccacagatgcgacttccagggcctgatcggcgagaccgccaagctgtgcagacccgtgcacaccagagtgacccagaacgccctgttcgagggcagcaccgagttcagagagagcttccagccctgggagatccccccccccgaggtgaagaaggtgcccgagtacgtgccccccaccggcagcatgctgctgaacagcaccagccacctggactacgtgccctaccaggccaaccacgtggtgcccatcagacccgtgagccagaagagaagcaacaacttccccttccagggcaagagcatcatgaaggaggacttccccgcctgggagagctgcagacagggcctgatcaagaagcagcagcagatccccaaccccagcggcaagttcgacggcctgagcaccttcagaagccactacgtgccccacgagctgatccccaccgagagctgcaagcccctgaacatcgccttcaagagcagcgtgcccttcgacgacgtgaccatgtacagcgtggagtacacccccaagagacaggagatctgccccgccagctaccccagcccccccggctacatcttcgacaacaccaacagccagggccacaagttcttcagaaagatcatccccgccgtgaaggccttctag

SEQ ID NO: 20954 - DNA, 1152 bp, Artificial Sequence
  Description of Artificial Sequence: Synthetic coding sequence
atgccctggagcgactactgcccctacgagatcgtgaagcagcccagacacgtgcccgaggagtacaagcccaagcagggcaagatcgacctgggcaccacctacaagagagacctgaacagctacaaggtgcagcccgtggccatcgtgagacccctggagagacaggtgaagaagggcaagctggacaccgtgcccacctacaaggacgactacagagcctgggacctgcacaagagcgagctgtacaagcccgagcagacctaccacccccccaccgtgaagttcggcaacagcaccaccttccaggacgacttcgtgccccaggagatcaagcccagacagagcttcaagcccagcagcgtggtgaagagaagcaccgcccccttcaacggcatcaccagccacagactggactacatcccccaccagctggagctgaagttcgagagacccaaggaggtgtacaagcccaccgaccagagattcgaggacctgaccacccacagatgcgacttccagggcctgatcggcgagaccgccaagctgtgcagacccgtgcacaccagagtgacccagaacgccctgttcgagggcagcaccgagttcagagagagcttccagccctgggagatccccccccccgaggtgaagaaggtgcccgagtacgtgccccccaccggcagcatgctgctgaacagcaccagccacctggactacgtgccctaccaggccaaccacgtggtgcccatcagacccgtgagccagaagagaagcaacaacttccccttccagggcaagagcatcatgaaggaggacttccccgcctgggagagctgcagacagggcctgatcaagaagcagcagcagatccccaaccccagcggcaagttcgacggcctgagcaccttcagaagccactacgtgccccacgagctgatccccaccgagagctgcaagcccctgaacatcgccttcaagagcagcgtgcccttcgacgacgtgaccatgtacagcgtggagtacacccccaagagacaggagatctgccccgccagctaccccagcccccccggctacatcttcgacaacaccaacagccagggccacaagttcttcagaaagatcatccccgccgtgaaggccttctag

SEQ ID NO: 20955 - DNA, 1152 bp, Artificial Sequence
  Description of Artificial Sequence: Synthetic coding sequence
atgggccccctgttcaccaccatccccggcgcccacagcggccccatgagacccctgcccaagaagcacgtggagcccatggccgtgagacagctgctgctgggcaacagcaccatgatcagacacacctgccccatgagcgtgcccctgagcagacaggtgaaggaggtggccgcccagaagcccagcgaggacatctacaagaactggcagcagcagcagcagcagcagcagcagcagcagcagcagcagctggacctgctgttccaccagagaatccagatcagcctgtggcccagaaagcagaagagaagaaagaccgagcagcacagccaccccttcgtgaagaaggccttcagattcagcgccggcagcggctgcggcagacccagcagcaacaagatgctgagaagcatgggcggcggccagagacccaccggcctgggcagcgagttcttcagactgctgcacgacctgcacctgctggccttcgccatgaagagaatctggatccacagaagaggcgaggccaccgccagacccagagcccccgagcaccccgccccccccgccaccgccgtgagaggcagagacgccgccagccagaacctgaagagaagacccggcagcggcaccgacggcctgagactgcagggcgccgagcccagcagactgctgagaacctacgccggcggcgccgtgatccccaccggcacccccgagagagcccagcccccccccccccaggaccccctgggcagaagaagatggctgagcagaaacacctggggcccctggcccggcaccacccagccccccagcccccagctgctgagaaacgactggggcagctgcggcttcatggtgcccgaggccgccagaggcaaggtgttccaggacagccaggagggcgcccacatcagaagagagaccgtgagcaagagcgtgtgcgccgagccctggagacaccagagagccagagaccccgcccccaccaacttccccctgagatgccagaagcagagaggcgccagcgccagcagcggccagcacgagggcagagtgaacctggtgttcttcatcggcagccccaccgtgatcgccgtgcccgacctgcagtgccccaccaagtacagcggcatgctgtactag

SEQ ID NO: 20956 - DNA, 954 bp, Artificial Sequence
  Description of Artificial Sequence: Synthetic coding sequence
atgttccaggccgccgagagaccccaggagtgggccatggagggccccagagacggcctgaagaaggagagactgctggacgacagacacgacagcggcctggacagcatgaaggacgaggagtacgagcagatggtgaaggagctgcaggagatcagactggagccccaggaggtgcccagaggcagcgagccctggaagcagcagctgaccgaggacggcgacagcttcctgcacctggccatcatccacgaggagaaggccctgaccatggaggtgatcagacaggtgaagggcgacctggccttcctgaacttccagaacaacctgcagcagacccccctgcacctggccgtgatcaccaaccagcccgagatcgccgaggccctgctgggcgccggctgcgaccccgagctgagagacttcagaggcaacacccccctgcacctggcctgcgagcagggctgcctggccagcgtgggcgtgctgacccagagctgcaccaccccccacctgcacagcatcctgaaggccaccaactacaacggccacacctgcctgcacctggccagcatccacggctacctgggcatcgtggagctgctggtgagcctgggcgccgacgtgaacgcccaggagccctgcaacggcagaaccgccctgcacctggccgtggacctgcagaaccccgacctggtgagcctgctgctgaagtgcggcgccgacgtgaacagagtgacctaccagggctacagcccctaccagctgacctggggcagacccagcaccagaatccagcagcagctgggccagctgaccctggagaacctgcagatgctgcccgagagcgaggacgaggagagctacgacaccgagagcgagttcaccgagttcaccgaggacgagctgccctacgacgactgcgtgttcggcggccagagactgaccctgtag

SEQ ID NO: 20957 - DNA, 627 bp, Artificial Sequence
  Description of Artificial Sequence: Synthetic coding sequence
atgggcgaggtggagatcagcgccctggcctacgtgaagatgtgcctgcacgccgccagatacccccacgccgccgtgaacggcctgttcctggcccccgcccccagaagcggcgagtgcctgtgcctgaccgactgcgtgcccctgttccacagccacctggccctgagcgtgatgctggaggtggccctgaaccaggtggacgtgtggggcgcccaggccggcctggtggtggccggctactaccacgccaacgccgccgtgaacgaccagagccccggccccctggccctgaagatcgccggcagaatcgccgagttcttccccgacgccgtgctgatcatgctggacaaccagaagctggtgccccagcccagagtgccccccgtgatcgtgctggagaaccagggcctgagatgggtgcccaaggacaagaacctggtgatgtggagagactgggaggagagcagacagatggtgggcgccctgctggaggacagagcccaccagcacctggtggacttcgactgccacctggacgacatcagacaggactggaccaaccagagactgaacacccagatcacccagtgggtgggccccaccaacggcaacggcaacgcctag

SEQ ID NO: 20958 - DNA, 483 bp, Artificial Sequence
  Description of Artificial Sequence: Synthetic coding sequence
atgagcgaggccagcagactgtgcagcggctactacagcctgaaccagagcttcgtggagcccttccagtgccccagaagaggcgagggcgccgccctgcagtactgctgcggcttcgccgacctgaagtactgctgcagcgagcccggcagctacttcccctacaagcacagctacatgtggagcctgagcatcggcgccctgatcggcctgggcatcgccgccctggtgctgctggccttcgtgatcagcgtgtgcgtgctgtgctacctgttcctgtacaccaagccccagagactggacaccggcctgaagctgcagcacctggaggccagcagcacccaggagggcaagagcaacggcaagaccaaggccctgaacagcaacgccgccagcaacgccaccaacgagacctactacgaggccgacgacatcatccaggagaagaccatggacgccacccagatccacatcgcctactag

SEQ ID NO: 20959 - DNA, 3123 bp, Artificial Sequence
  Description of Artificial Sequence: Synthetic coding sequence
atgatgagcagcgtgagcaccgagagcaagctgcagcaggccgtgagcctgcagggcgtggaccccgagacctgcatgatcgtgttcaagaaccactgggcccaggtggtgaagatcctggagaagcacgaccccctgaagaacacccaggccaagtacggcagcatcccccccgacgaggccagcgccgtgcagaactacgtggagcacatgctgttcctgctgatcgaggagcaggccaaggacgccgccatgggccccatcctggagttcgtggtgagcgagaacatcatggagaagctgttcctgtggagcctgagaagagagttcaccgacgagaccaagatcgagcagctgaagatgtacgagatgctggtgacccagagccaccagcccctgctgcaccacaagcccatcctgaagcccctgatgatgctgctgagcagctgcagcggcaccaccacccccaccgtggaggagaagctggtggtgctgctgaaccagctgtgcagcatcctggccaaggaccccagcatcctggagctgttcttccacaccagcgaggaccagggcgccgccaacttcctgatcttcagcctgctgatccccttcatccacagagagggcagcgtgggccagcaggccagagacgccctgctgttcatcatgagcctgagcgccgagaacaccatggtggcccaccacatcgtggagaacacctacttctgccccgtgctggccaccggcctgagcggcctgtacagcagcctgcccaccaagctggaggagaagggcgaggagtggcactgcctgctgaaggacgactggctgctgctgcccagcctggtgcagttcatgaacagcctggagttctgcaacgccgtgatccaggtggcccaccccctgatcagaaaccagctggtgaactacatctacaacggcttcctggtgcccgtgctggcccccgccctgcacaaggtgaccgtggaggaggtgatgaccaccaccgcctacctggacctgttcctgagaagcatcagcgagcccgccctgctggagatcttcctgagattcatcctgctgcaccagcacgagaacgtgcacatcctggacaccctgaccagcagaatcaacacccccttcagactgtgcgtggtgagcctggccctgttcagaaccctgatcggcctgcactgcgaggacgtgatgctgcagctggtgctgagatacctgatcccctgcaaccacatgatgctgagccagagatgggccgtgaaggagagagactgctacagcgtgagcgccgccaagctgctggccctgacccccgtgtgctgcagcagcggcatcaccctgaccctgggcaaccaggagagagactacatcctgtggagcaagtgcatgcacgacaccagcggccccgtggagagacccttccccgaggccttcagcgagagcgcctgcatcgtggagtacggcaaggccctggacatcagctacctgcagtacctgtgggaggcccacaccaacatcctgagatgcatgagagactgcagagtgtggagcgccctgtacgacggcgacagccccgaccccgagatgttcctgcagagcctgaccgaggagggcagcgtgagcagcgcctgccccgtgttcggcctgccccagcagctgcccagaaagaccggcccccagctggcccccagaaaggacaagagccagaccgagctggagtgggacgacagctacgacaccggcatcagcagcggcgccgacgtgggcagccccggcccctacgacgacctggaggtgagcggcccccccgcccccatcgacccccccaagcacatccaggagatgaagaagaacgccctgctgctgttcaagggcagctacatcgaggagagcgacttccaggacgacgtgatggtgtacagactgtgcgccgagaaggacagcgaggacatgaaggacagccaggaggaggccgccagaccccccgccgaggcccaggccgaggtgcagagcgtgcccatcaacaacggccccctgctgagcacccagcccgagaccgacagcgaggaggagtggaacagagacaacagcgaccccttccacagcgagcccaaggagcccaagcaggagagagagcccgaggccgcccccgagagcaacagcgagctggccagccccgcccccgaggccgagcacagcagcaacctgaccgccgcccaccccgagagcgaggagctgatcgcccagtacgaccagatcatcaaggagctggacagcggcgccgagggcctgatggagcagaactaccccacccccgaccccctgctgctgaccaaggaggaggagggcaaggaggagagcaagggcgagaaggagaaggagggcaagaaggagctggaggacgaggaggacgacttcgacagcttcatcgccgagatgcccgccgtggagaccgtgcccagccccttcgtgggcagagacgaggccgccttcgccagcagacaccccgtgagaacccagagcacccccttcaccggccccttcatcagcgtggtgctgagcaagctggagaacatgctggagaacagcctgcacgtgaacctgctgctgatcggcatcatcacccagctggccagctacccccagcccctgctgagaagcttcctgctgaacaccaacatggtgttccagcccagcgtgagaagcctgtaccaggtgctggccagcgtgaagaacaagatcgagcagttcgccagcgtggagagagacttccccggcctgctgatccaggcccagcagtacctgctgttcagagtggacatgagcgacatgacccccgccgccctgaccaaggaccccatccaggaggccagcagaaccggcagcggcaagaacctgctggacggcccccccagagtgctgcagcccttcctgacccacagaaccaaggtggccgaggccccccccaacctgcccctgcccgtgagaaaccccatgctggccgccgccctgttccccgagttcctgaaggagctggccgccctggcccaggagcacagcatcctgtgctacaagatcctgggcgacttcgaggacagctgctgctag

SEQ ID NO: 20960 - DNA, 123 bp, Artificial Sequence
  Description of Artificial Sequence: Synthetic coding sequence
atgatgagcagcgtgagcaccgagagcaagctgcagcaggccgtgagcctgcagggcgtggaccccgagacctgcatgatcgtgttcaagaaccactgggcccaggtggtgaagatcctgtag

SEQ ID NO: 20961 - DNA, 3123 bp, Artificial Sequence; identical to SEQ ID NO: 20959
  Description of Artificial Sequence: Synthetic coding sequence

SEQ ID NO: 20962 - DNA, 183 bp, Artificial Sequence
  Description of Artificial Sequence: Synthetic coding sequence
atgatgagcagcgtgagcaccgagagcaagctgcagcaggccgtgagcctgcagggcgtggaccccgagacctgcatgatcgtgttcaagaaccactgggcccaggtggtgaagatcctggagaagcacgaccccctgaagaacacccaggccaagtacggcagcatcccccccgacgagtag

SEQ ID NO: 20963 - DNA, 42 bp, Artificial Sequence
  Description of Artificial Sequence: Synthetic coding sequence
atgatgagcagcgtgagcaccgagagcaagctgcagcagtag

SEQ ID NO: 20964 - DNA, 129 bp, Artificial Sequence
  Description of Artificial Sequence: Synthetic coding sequence
atgatgagcagcgtgagcaccgagagcaagctgcagcaggccgtgagcctgcagggcgtggaccccgagacctgcatgatcgtgttcaagaaccactgggcccaggtggtgaagatcctggagaagtag

SEQ ID NO: 20965 - DNA, 306 bp, Artificial Sequence
  Description of Artificial Sequence: Synthetic coding sequence
atgttcagcaagttcaccagcatcctgcagcacgccgtggaggccctggcccccagcctgcccctgcaggaggacttcgtgtaccactggaaggccatcacccactactacatcgagaccagcgacgacaaggcccccgtgaccgacaccaacatccccagccacctggagcagatgctggacatcctggtgcaggaggagaacgagagagagagcggcgagaccggcccctgcatggagtacctgctgcaccacaagatcctggagaccctgtacaccctgggcaaggccgacgtgagcagctag

SEQ ID NO: 20966 - DNA, 2298 bp, Artificial Sequence
  Description of Artificial Sequence: Synthetic coding sequence
atgttcagcaagttcaccagcatcctgcagcacgccgtggaggccctggcccccagcctgcccctgcaggaggacttcgtgtaccactggaaggccatcacccactactacatcgagaccagcgacgacaaggcccccgtgaccgacaccaacatccccagccacctggagcagatgctggacatcctggtgcaggaggagaacgagagagagagcggcgagaccggcccctgcatggagtacctgctgcaccacaagatcctggagaccctgtacaccctgggcaaggccgactgcccccccggcatgaagcagcaggtgctggtgttctacaccaagctgctgggcagaatcagacagcccctgctgccccacatcaacgtgcacagacccgtgcagaagctgatcagactgtgcggcgaggtgctggccacccccaccgagaacgaggagatccagttcctgtgcatcgtgtgcgccaagctgaagcaggacccctacctggtgaacttcttcctggagaacaagatgaagagcctggccagcaagggcgtgcccaacgtgatcagcgaggacaccctgaagggccaggacagcctgagcaccgacaccggccagagcagacagcccgaggagctgagcggcgccaccggcatggagcagaccgagctggaggacgagcccccccaccagatggaccacctgagcaccagcctggacaacctgagcgtgaccagcctgcccgaggccagcgtggtgtgccccaaccaggactacaacctggtgaacagcctgctgaacctgaccagaagccccgacggcagaatcgccgtgaaggcctgcgagggcctgatgctgctggtgagcctgcccgagcccgccgccgccaagtgcctgacccagagcacctgcctgtgcgagctgctgaccgacagactggccagcctgtacaaggccctgccccagagcgtggaccccctggacatcgagaccgtggaggccatcaactggggcctggacagctacagccacaaggaggacgccagcgccttccccggcaagagagccctgatcagcttcctgagctggttcgactactgcgaccagctgatcaaggaggcccagaagaccgccgccgtggccctggccaaggccgtgcacgagagattcttcatcggcgtgatggagccccagctgatgcagaccagcgagatgggcatcctgaccagcaccgccctgctgcacagaatcgtgagacaggtgaccagcgacgtgctgctgcaggagatggtgttcttcatcctgggcgagcagagagagcccgagaccctggccgagatcagcagacaccccctgagacacagactgatcgagcactgcgaccacatcagcgacgagatcagcatcatgaccctgagaatgttcgagcacctgctgcagaagcccaacgagcacatcctgtacaacctggtgctgagaaacctggaggagagaaactacaccgagtacaagcccctgtgccccgaggacaaggacgtggtggagaacggcctgatcgccggcgccgtggacctggaggaggaccccctgttcaccgacatcagccccgagaacaccctgcccaaccaggagtggctgagcagcagcccccccgccacccccgaccaccccaagaacgacggcaagaccgaggtgcacaagatcgtgaacagcttcctgtgcctggtgcccgacgacgccaagagcagctaccacgtggagggcaccggctacgacacctacctgagagacgcccacagacagttcagagactactgcgccatctgcctgagatgggagtggcccggcagccccaaggccctggagaagtgcaacctggaggccgccttcttcgagggccacttcctgaaggtgctgttcgacagaatgggcagaatcctggaccagccctacgacgtgaacctgcaggtgaccagcgtgctgagcagactgagcctgttcccccacccccacatccacgagtacctgctggacccctacgtgaacctggcccccggctgcagaagcctgttcagcgtgatcgtgagagtggtgggcgacctgatgctgagaatccagagaatccaggacttcacccccaagctgctgctggtgagaaagagactgctgggcctggagcccgagggccccatcatcgaccacatcaccctgctggagggcgtgatcgtgctggaggagttctgcaaggagctggccgccatcgccttcgtgaagtaccacgccagcagcaccccctag

SEQ ID NO: 20967 - DNA, 2217 bp, Artificial Sequence
  Description of Artificial Sequence: Synthetic coding sequence
atgttcagcaagttcaccagcatcctgcagcacgccgtggaggccctggcccccagcctgcccctgcaggaggacttcgtgtaccactggaaggccatcacccactactacatcgagaccagcgacgacaaggcccccgtgaccgacaccaacatccccagccacctggagcagatgctggacatcctggtgcaggaggagaacgagagagagagcggcgagaccggcccctgcatggagtacctgctgcaccacaagatcctggagaccctgtacaccctgggcaaggccgactgcccccccggcatgaagcagcaggtgctggtgttctacaccaagctgctgggcagaatcagacagcccctgctgccccacatcaacgtgcacagacccgtgcagaagctgatcagactgtgcggcgaggtgctggccacccccaccgagaacgaggagatccagttcctgtgcatcgtgtgcgccaagctgaagcaggacccctacctggtgaacttcttcctggagaacaagatgaagagcctggccagcaagggcgtgcccaacgtgatcagcgaggacaccctgaagggccaggacagcctgagcaccgacaccggccagagcagacagcccgaggagctgagcggcgccaccggcatggagcagaccgagctggaggacgagcccccccaccagatggaccacctgagcaccagcctggacaacctgagcgtgaccagcctgcccgaggccagcgtggtgtgccccaaccaggactacaacctggtgaacagcctgctgaacctgaccagaagccccgacggcagaatcgccgtgaaggcctgcgagggcctgatgctgctggtgagcctgcccgagcccgccgccgccaagtgcctgacccagagcacctgcctgtgcgagctgctgaccgacagactggccagcctgtacaaggccctgccccagagcgtggaccccctggacatcgagaccgtggaggccatcaactggggcctggacagctacagccacaaggaggacgccagcgccttccccggcaagagagccctgatcagcttcctgagctggttcgactactgcgaccagctgatcaaggaggcccagaagaccgccgccgtggccctggccaaggccgtgcacgagagattcttcatcggcgtgatggagccccagctgatgcagaccagcgagatgggcatcctgaccagcaccgccctgctgcacagaatcgtgagacaggtgaccagcgacgtgctgctgcaggagatggtgttcttcatcctgggcgagcagagagagcccgagaccctggccgagatcagcagacaccccctgagacacagactgatcgagcactgcgaccacatcagcgacgagatcagcatcatgaccctgagaatgttcgagcacctgctgcagaagcccaacgagcacatcctgtacaacctggtgctgagaaacctggaggagagaaactacaccgagtacaagcccctgtgccccgaggacaaggacgtggtggagaacggcctgatcgccggcgccgtggacctggaggaggaccccctgttcaccgacatcagccccgagaacaccctgcccaaccaggagtggctgagcagcagcccccccgccacccccgaccaccccaagaacgacggcaagaccgaggtgcacaagatcgtgaacagcttcctgtgcctggtgcccgacgacgccaagagcagctaccacgtggagggcaccggctacgacacctacctgagagacgcccacagacagttcagagactactgcgccatctgcctgagatgggagtggcccggcagccccaaggccctggagaagtgcaacctggaggccgccttcttcgagggccacttcctgaaggtgctgttcgacagaatgggcagaatcctggaccagccctacgacgtgaacctgcaggtgaccagcgtgctgagcagactgagcctgttcccccacccccacatccacgagtacctgctggacccctacgtgaacctggcccccggctgcagaagcctgttcagcgtgatcgtgagagtggtgggcgacctgatgctgagaatccagagaatccaggacttcacccccaagctgctgctggtgagaaagagactgctgggcctggagcccgagggccccatgcagaccctgcccagctggtggtag

SEQ ID NO: 20968 - DNA, 252 bp, Artificial Sequence
  Description of Artificial Sequence: Synthetic coding sequence
ctgagcctgttcccccacccccacatccacgagtacctgctggacccctacgtgaacctggcccccggctgcagaagcctgttcagcgtgatcgtgagagtggtgggcgacctgatgctgagaatccagagaatccaggacttcacccccaagctgctgctggtgagaaagagactgctgggcctggagcccgagggccccatcagcgacctggagcccgtggaggccctgaccgtgagcagcatctgctag

SEQ ID NO: 20969 - DNA, 2232 bp, Artificial Sequence
  Description of Artificial Sequence: Synthetic coding sequence
atgctgagcagactgggcgccctgctgcaggaggccgtgggcgccagagagcccagcatcgacctgctgcaggccttcgtggagcactggaagggcatcacccactactacatcgagagcaccgacgagagcacccccgccaagaagaccgacatcccctggagactgaagcagatgctggacatcctggtgtacgaggagcagcagcaggccgccgccggcgaggccggcccctgcctggagtacctgctgcagcacaagatcctggagaccctgtgcaccctgggcaaggccgagtacccccccggcatgagacagcaggtgttccagttcttcagcaaggtgctggcccaggtgcagcaccccctgctgcactacctgagcgtgcacagacccgtgcagaagctgctgagactgggcggcaccgccagcggcagcgtgaccgagaaggaggaggtgcagttcaccaccgtgctgtgcagcaagatccagcaggaccccgagctgctggcctacatcctggagggcaagaagatcgtgggcagaaagaaggcctgcggcgagcccaccgccctgcccaaggacaccaccagccacggcgacaaggactgcagccacgacggcgcccccgccagaccccagctggacggcgagagctgcggcgcccaggccctgaacagccacatgcccgccgagaccgaggagctggacggcggcaccaccgagagcaacctgatcaccagcctgctgggcctgtgccagagcaagaagagcagagtggccctgaaggcccaggagaacctgctgctgctggtgagcatggccagccccgccgccgccacctacctggtgcagagcagcgcctgctgccccgccatcgtgagacacctgtgccagctgtacagaagcatgcccgtgttcctggaccccgccgacatcgccaccctggagggcatcagctggagactgcccagcgcccccagcgacgaggccagcttccccggcaaggaggccctggccgccttcctgggctggttcgactactgcgaccacctgatcaccgaggcccacaccgtggtggccgacgccctggccaaggccgtggccgagaacttcttcgtggagaccctgcagccccagctgctgcacgtgagcgagcagagcatcctgaccagcaccgccctgctgaccgccatgctgagacagctgagaagccccgccctgctgagagaggccgtggccttcctgctgggcaccgacagacagcccgaggcccccggcgacaacccccacaccctgtacgcccacctgatcggccactgcgaccacctgagcgacgagatcagcatcaccaccctgagactgttcgaggagctgctgcagaagccccacgagggcatcatccacagcctggtgctgagaaacctggagggcagaccctacgtggcctggggcagccccgagcccgagagctacgaggacaccctggacctggaggaggacccctacttcaccgacagcttcctggacagcggcttccagacccccgccaagcccagactggcccccgccaccagctacgacggcaagaccgccgtgaccgagatcgtgaacagcttcctgtgcctggtgcccgaggaggccaagaccagcgccttcctggaggagaccggctacgacacctacgtgcacgacgcctacggcctgttccaggagtgcagcagcagagtggccagctggggctggcccctgacccccacccccctggacccccacgagcccgagagacccttcttcgagggccacttcctgagagtgctgttcgacagaatgagcagaatcctggaccagccctacagcctgaacctgcaggtgaccagcgtgctgagcagactggccctgttcccccacccccacatccacgagtacctgctggacccctacatcagcctggcccccggctgcagaagcctgttcagcgtgctggtgagagtgatcggcgacctgatgcagagaatccagagagtgccccagttccccggcaagctgctgctggtgagaaagcagctgaccggccaggcccccggcgagcagctggaccaccagaccctgctgcagggcgtggtggtgctggaggagttctgcaaggagctggccgccatcgccttcgtgaagttccccccccacgaccccagacagaacgtgagccccgcccccgagggccaggtgtag

SEQ ID NO: 20970 - DNA, 486 bp, Artificial Sequence
  Description of Artificial Sequence: Synthetic coding sequence
atgctgagcagactgggcgccctgctgcacgagcccgagagacccttcttcgagggccacttcctgagagtgctgttcgacagaatgagcagaatcctggaccagccctacagcctgaacctgcaggtgaccagcgtgctgagcagactggccctgttcccccacccccacatccacgagtacctgctggacccctacatcagcctggcccccggctgcagaagcctgttcagcgtgctggtgagagtgatcggcgacctgatgcagagaatccagagagtgccccagttccccggcaagctgctgctggtgagaaagcagctgaccggccaggcccccggcgagcagctggaccaccagaccctgctgcagggcgtggtggtgctggaggagttctgcaaggagctggccgccatcgccttcgtgaagttccccccccacgaccccagacagaacgtgagccccgcccccgagggccaggtgtag

SEQ ID NO: 20971 - DNA, 2133 bp, Artificial Sequence
  Description of Artificial Sequence: Synthetic coding sequence
atgagaggcgagaacagacccatcggcaagagaaccctgccccccagagccggctggatcggcggctgccccggcagccagcccgacgccaaggccagaaagggctggaccctggccccccacagcagcagatgccacagatgctgccactacagatgccactgcagatgctgcctgtgccccgccgagatgaccgtgggcagacccgagggcgcccccggcggcgccgagggcagcagacagatcttcccccccgagagcttcgccgacaccgaggccggcgaggagctgagcggcgacggcctggtgctgcccagagccagcaagctggacgagttcctgagccccgaggaggagatcgacagcaccagcgacagcaccggcagcatctaccagaacctgcaggagctgaagcagaagggcagatggtgcctgctggagagcctgttccagagcgaccccgagagcgacgagaacctgagcgaggacgaggaggacctggagagcttcttccaggacaaggacagaggcatggtgcaggtgcagtgcccccaggccctgagatgcggcagcaccagaagatgcagcagcctgaacaacctgcccagcaacatccccagaccccagacccagccccccagcggcagcagaccccccagccagcacagaagcgtgagcagctgggccagcagcatcaccgtgcccagacccttcagaatgaccctgagagaggccagaaagaaggccgagtggctgggcagccccgccagcttcgagcaggagagacagagagcccagagacagggcgaggaggaggccgagtgccacagacagttcagagcccagcccgtgcccgcccacgtgtacctgcccctgtaccaggagatcatggagagaagcgaggccagaagacaggccggcatccagaagagaaaggagctgctgctgagcagcctgaagcccttcagcttcctggagaaggaggagcagctgaaggaggccgccagacagagagacctggccgccaccgccgaggccaagatcagcaagcagaaggccaccagaagaatccccaagagcatcctggagcccgccctgggcgacaagctgcaggaggccgagctgttcagaaagatcagaatccagatgagagccctggacatgctgcagatggccagcagccccatcgccagcagcagcaacagagccaacccccagcccagaaccgccaccagaacccagcaggagaagctgggcttcctgcacaccaacttcagattccagcccagagtgaaccccgtggtgcccgactacgagggcctgtacaaggccttccagagaagagccgccaagagaagagagacccaggaggccaccagaaacaagcccttcctgctgagaaccgccaacctgagacacccccagagaccctgcgacgccgccaccaccggcagaagacaggacagcccccagccccccgccacccccctgcccagaagcagaagcctgagcggcctggccagcctgagcgccaacaccctgcccgtgcacatcaccgacgccaccagaaagagagagagcgccgtgagaagcgccctggagaagaagaacaaggccgacgagagcatccagtggctggagatccacaagaagaagagccaggccatgagcaagagcgtgaccctgagagccaaggccatggacccccacaagagcctggaggaggtgttcaaggccaagctgaaggagaacagaaacaacgacagaaagagagccaaggagtacaagaaggagctggaggagatgaagcagagaatccagaccagaccctacctgttcgagcaggtggccaaggacctggccaagaaggaggccgagcagtggtacctggacaccctgaagcaggccggcctggaggaggacttcgtgagaaacaagggccagggcaccagagccgtgcaggagaaggagaccaagatcaaggacttccccagattccaggagaccaccaagctgagcatcagagaccccgagcagggcctggagggcagcctggagcagcccgccagccccagaaaggtgctggaggagctgagccaccagagccccgagaacctggtgagcctggcctag

SEQ ID NO: 20972 - DNA, 1944 bp, Artificial Sequence
  Description of Artificial Sequence: Synthetic coding sequence
atgaccgtgggcagacccgagggcgcccccggcggcgccgagggcagcagacagatcttcccccccgagagcttcgccgacaccgaggccggcgaggagctgagcggcgacggcctggtgctgcccagagccagcaagctggacgagttcctgagccccgaggaggagatcgacagcaccagcgacagcaccggcagcatctaccagaacctgcaggagctgaagcagaagggcagatggtgcctgctggagagcctgttccagagcgaccccgagagcgacgagaacctgagcgaggacgaggaggacctggagagcttcttccaggacaaggacagaggcatggtgcaggtgcagtgcccccaggccctgagatgcggcagcaccagaagatgcagcagcctgaacaacctgcccagcaacatccccagaccccagacccagccccccagcggcagcagaccccccagccagcacagaagcgtgagcagctgggccagcagcatcaccgtgcccagacccttcagaatgaccctgagagaggccagaaagaaggccgagtggctgggcagccccgccagcttcgagcaggagagacagagagcccagagacagggcgaggaggaggccgagtgccacagacagttcagagcccagcccgtgcccgcccacgtgtacctgcccctgtaccaggagatcatggagagaagcgaggccagaagacaggccggcatccagaagagaaaggagctgctgctgagcagcctgaagcccttcagcttcctggagaaggaggagcagctgaaggaggccgccagacagagagacctggccgccaccgccgaggccaagatcagcaagcagaaggccaccagaagaatccccaagagcatcctggagcccgccctgggcgacaagctgcaggaggccgagctgttcagaaagatcagaatccagatgagagccctggacatgctgcagatggccagcagccccatcgccagcagcagcaacagagccaacccccagcccagaaccgccaccagaacccagcaggagaagctgggcttcctgcacaccaacttcagattccagcccagagtgaaccccgtggtgcccgactacgagggcctgtacaaggccttccagagaagagccgccaagagaagagagacccaggaggccaccagaaacaagcccttcctgctgagaaccgccaacctgagacacccccagagaccctgcgacgccgccaccaccggcagaagacaggacagcccccagccccccgccacccccctgcccagaagcagaagcctgagcggcctggccagcctgagcgccaacaccctgcccgtgcacatcaccgacgccaccagaaagagagagagcgccgtgagaagcgccctggagaagaagaacaaggccgacgagagcatccagtggctggagatccacaagaagaagagccaggccatgagcaagagcgtgaccctgagagccaaggccatggacccccacaagagcctggaggaggtgttcaaggccaagctgaaggagaacagaaacaacgacagaaagagagccaaggagtacaagaaggagctggaggagatgaagcagagaatccagaccagaccctacctgttcgagcaggtggccaaggacctggccaagaaggaggccgagcagtggtacctggacaccctgaagcaggccggcctggaggaggacttcgtgagaaacaagggccagggcaccagagccgtgcaggagaaggagaccaagatcaaggacttccccagattccaggagaccaccaagctgagcatcagagaccccgagcagggcctggagggcagcctggagcagcccgccagccccagaaaggtgctggaggagctgagccaccagagccccgagaacctggtgagcctggcctag

SEQ ID NO: 20973 - DNA, 978 bp, Artificial Sequence
  Description of Artificial Sequence: Synthetic coding sequence
atggagggcctggaggagaacggcggcgtggtgcaggtgggcgagctgctgccctgcaagatctgcggcagaaccttcttccccgtggccctgaagaagcacggccccatctgccagaagaccgccaccaagaagagaaagaccttcgacagcagcagacagagagccgagggcaccgacatccccaccgtgaagcccctgaagcccagacccgagccccccaagaagcccagcaactggagaagaaagcacgaggagttcatcgccaccatcagagccgccaagggcctggaccaggccctgaaggagggcggcaagctgccccccccccccccccccagctacgaccccgactacatccagtgcccctactgccagagaagattcaacgagaacgccgccgacagacacatcaacttctgcaaggagcaggccgccagaatcagcaacaagggcaagttcagcaccgacaccaagggcaagcccaccagcagaacccaggtgtacaagccccccgccctgaagaagagcaacagccccggcaccgccagcagcggcagcagcagactgccccagcccagcggcgccggcaagaccgtggtgggcgtgcccagcggcaaggtgagcagcagcagcagcagcctgggcaacaagctgcagaccctgagccccagccacaagggcatcgccgccccccacgccggcgccaacgtgaagcccagaaacagcaccccccccagcctggccagaaaccccgcccccggcgtgctgaccaacaagagaaagacctacaccgagagctacatcgccagacccgacggcgactgcgccagcagcctgaacggcggcaacatcaagggcatcgagggccacagccccggcaacctgcccaagttctgccacgagtgcggcaccaagtaccccgtggagtgggccaagttctgctgcgagtgcggcatcagaagaatgatcctgtag

SEQ ID NO: 20974 - DNA, 828 bp, Artificial Sequence
  Description of Artificial Sequence: Synthetic coding sequence
atggccggcctgcagagactggccagccacctgcccgtgggcgtgatgctgccccacaacaccaccgaggcccccggcccccacagcgccaagcaggacagctacgagcagggcgacagcagccagcagagcctgaagggccacctgagaaacaacttccagaagcagctgctgagcaacaaggagctgatcctggacaaggtgtacacccaccccaagtggaacacccagaccaaggccagaagctacagctacccccactgcaccggcatcagccagcaggaccccgagagcgacagccagggccagggcaacggcctgttctacagcagcggcccccagagctggtaccccaaggccaacaaccaggacttcatccccttcaccaagaagagagtgggcgtggacagagccttccccctgaagcccatggtgcacagaaagagctgcagcaccggcgaggccggcaccgacggcgaccacaacgtgtaccccagaccccccgagcccagagagttcagcagcagaaacttcggcgtgagaaaccagggcaacttcagcgtggtgggcaccgtgctggccgccacccaggccgagaaggccgtggccaacttcgacagaaccgagtgggtgcagatcagaagactggaggccgccggcgagagcctggaggaggagatcagaagaaagcagatcctgctgagaggcaagctgaagaagaccgaggaggagctgagaagaatccagacccagaaggagcaggccaaggagaacgagaacggcgagctgcagaagatcatcctgcccagaagcagagtgaagggctag

SEQ ID NO: 20975 - DNA, 1371 bp, Artificial Sequence
  Description of Artificial Sequence: Synthetic coding sequence
atggccggcctgcagagactggccagccacctgcccgtgggcgtgatgctgccccacaacaccaccgaggcccccggcccccacagcgccaagcaggacagctacgagcagggcgacagcagccagcagagcctgaagggccacctgagaaacaacttccagaagcagctgctgagcaacaaggagctgatcctggacaaggtgtacacccaccccaagtggaacacccagaccaaggccagaagctacagctacccccactgcaccggcatcagccagcaggaccccgagagcgacagccagggccagggcaacggcctgttctacagcagcggcccccagagctggtaccccaaggccaacaaccaggacttcatccccttcaccaagaagagagtgggcgtggacagagccttccccctgaagcccatggtgcacagaaagagctgcagcaccggcgaggccggcaccgacggcgaccacaacgtgtaccccagaccccccgagcccagagagttcagcagcagaaacttcggcgtgagaaaccagggcaacttcagcgtggtgggcaccgtgctggccgccacccaggccgagaaggccgtggccaacttcgacagaaccgagtgggtgcagatcagaagactggaggccgccggcgagagcctggaggaggagatcagaagaaagcagatcctgctgagaggcaagctgaagaagaccgaggaggagctgagaagaatccagacccagaaggagcaggccaaggagaacgagaacggcgagctgcagaagatcatcctgcccagaagcagagtgaagggcaacaagagcaacaccatgtacaagcccatcttcagccccgagttcgagttcgaggaggagttcagcagagacagaagagaggacgagacctggggcagaagccagcagaacagcggccccttccagttcagcgactacagaatccagagactgaagagagagagactggtggccagcaacaacaagatcagagaccccgtgagcgagcccagcgtggagaagttcagcccccccagcgagacccccgtgggcgccctgcagggcagcgccagaaacagcagcctgagcatggcccccgacagcagcggcagcagcggcagcatcgaggagccccagctgggcgagtgcagccactgcggcagaaagttcctgagcttcagactggagagacacagcaacatctgcagcagaatgagaggcagcaagagaaaggtgttcgacagcagcagagccagagccaagggcaccgagctggagcagtacctgaactggaagggccccgccagcgccaaggccgagcccccccagaagagcaactggagatag

SEQ ID NO: 20976 - DNA, 279 bp, Artificial Sequence
  Description of Artificial Sequence: Synthetic coding sequence
atggccggcctgcagagactggccagccacctgcccgtgggcgtgatgctgccccacaacaccaccgaggcccccggcccccacagcgccaagcaggacagctacgagcagggcgacagcagccagcagagcctgaagggccacctgagaaacaacttccagaagcagctgctgagcaacaaggagctgatcctggacaaggtgtacacccaccccaagtggaacacccagaccaaggccagaagctacagctacccccactgcaccggcatcagctag

SEQ ID NO: 20977 - DNA, 516 bp, Artificial Sequence
  Description of Artificial Sequence: Synthetic coding sequence
atggccggcctgcagagactggccagccacctgcccgtgggcgtgatgctgccccacaacaccaccgaggcccccggcccccacagcgccaagcaggacagctacgagcagggcgacagcagccagcagagcctgaagggccacctgagaaacaacttccagaagcagctgctgagcaacaaggagctgatcctggacaaggtgtacacccaccccaagtggaacacccagaccaaggccagaagctacagctacccccactgcaccggcatcagccagcaggaccccgagagcgacagccagggccagggcaacggcctgttctacagcagcggcccccagagctggtaccccaaggccaacaaccaggacttcatccccttcaccaagaagagagtgggcgtggacagagccttccccctgaagcccatggtgcacagaaagagctgcagcaccggcgaggccggcaccgacggcgaccacaacgtgtaccccagaccccccgagcccagatag

SEQ ID NO: 20978 - DNA, 282 bp, Artificial Sequence
  Description of Artificial Sequence: Synthetic coding sequence
atggccggcctgcagagactggccagccacctgcccgtgggcgtgatgctgccccacaacaccaccgaggcccccggcccccacagcgccaagcaggacagctacgagcagggcgacagcagccagcagagcctgaagggccacctgagaaacaacttccagaagcagctgctgagcaacaaggagctgatcctggacaaggtgtacacccaccccaagtggaacacccagaccaaggccagaagctacagctacccccactgcaccggcatcagccagtag

SEQ ID NO: 20979 - DNA, 486 bp, Artificial Sequence
  Description of Artificial Sequence: Synthetic coding sequence
atggccggcctgcagagactggccagccacctgcccgtgggcgtgatgctgccccacaacaccaccgaggcccccggcccccacagcgccaagcaggacagctacgagcagggcgacagcagccagcagagcctgaagggccacctgagaaacaacttccagaagcagctgctgagcaacaaggagctgatcctggacaaggtgtacacccaccccaagtggaacacccagaccaaggccagaagctacagctacccccactgcaccggcatcagccagcaggaccccgagagcgacagccagggccagggcaacggcctgttctacagcagcggcccccagagctggtaccccaaggccaacaaccaggacttcatccccttcaccaagaagagagtgggcgtggacagagccttccccctgaagcccatggtgcacagaaagagctgcagcaccggcgaggccggcaccgacggcgaccactag

SEQ ID NO: 20980 - DNA, 828 bp, Artificial Sequence
  Description of Artificial Sequence: Synthetic coding sequence
atggccgtggccagcaccttcatccccggcctgaacccccagaacccccactacatccccggctacaccggccactgccccctgctgagattcagcgtgggccagacctacggccaggtgaccggccagctgctgagaggcccccccggcctggcctggccccccgtgcacagaaccctgctgccccccatcagaccccccagaagccccgaggtgcccagagagagcctgcccgtgagaagaggccaggagagactgagcagcagcatgatccccggctacaccggcttcgtgcccagagcccagttcatcttcgccaagaactgcagccaggtgtgggccgaggccctgagcgacttcacccacctgcacgagaagcagggcagcgaggagctgcccaaggaggccaagggcagaaaggacaccgagaaggaccaggtgcccgagcccgagggccagctggaggagcccaccctggaggtggtggagcaggccagcccctacagcatggacgacagagaccccagaaagttcttcatgagcggcttcaccggctacgtgccctgcgccagattcctgttcggcagcagcttccccgtgctgaccaaccaggccctgcaggagttcggccagaagcacagccccggcagcgcccaggaccccaagcacctgccccccctgcccagaacctacccccagaacctgggcctgctgcccaactacggcggctacgtgcccggctacaagttccagttcggccacaccttcggccacctgacccacgacgccctgggcctgagcaccttccagaagcagctgctggcctag

SEQ ID NO: 20981 - DNA, 651 bp, Artificial Sequence
  Description of Artificial Sequence: Synthetic coding sequence
atggccgtggccagcaccttcatccccggcctgaacccccagaacccccactacatccccggctacaccggccactgccccctgctgagattcagcgtgggccagacctacggccaggtgaccggccagctgctgagaggcccccccggcctggcctggccccccgtgcacagaaccctgctgccccccatcagaccccccagaagccccgaggtgcccagagagagcctgcccgtgagaagaggccaggagagactgagcagcagcatgatccccggctacaccggcttcgtgcccagagcccagttcatcttcgccaagaactgcagccaggtgtgggccgaggccctgagcgacttcacccacctgcacgagaagcagggcagcgaggagctgcccaaggaggccaagggcagaaaggacaccgagaaggaccaggtgcccgagcccgagggccagctggaggagcccaccctggaggtggtggagcaggccagcccctacagcatggacgacagagaccccagaaagttcttcatgagcggcaccgccggcatctgggccgaggccctgaccagacagtgccccggcccccagaccagcccccccaccagccagaacatccccagcgagcccggcagcttcacctag

SEQ ID NO: 20982 - DNA, 954 bp, Artificial Sequence
  Description of Artificial Sequence: Synthetic coding sequence
atgaccaccacccagaagcacgacctgttcacccccgagccccactacgtgcccggctacgccggcttcttcccccagctgagataccaggtgggcaacacctacggcagaaccaccggccagctgctgaccgaccccagcgtgcagaagagcccctgcagcgtgctgagccccatgagcaagcccaagttcatcgaggacttcagccagagcaagccccccagagtgccctgccaggacctgaccgagccctacatcccccactacaccagcctgaagcccagcaagaacttcgagatcctgggccagctgccccccctggaggtggacgcccaggagccccccggcgtggagaacatccccagacagatcctgctgcccgccggcttcacccccgacaccccccaccccccctgcccccccggcagaaagggcgacagcagagacctgggccaccccgtgtacggcgaggaggcctggaagagcgccacccccgtgtgcgaggcccccagacagcaccagctgtaccactgccagagagacgagtaccccccccccgccagaagacagcaggagaccctggacgtgggcagcttccagagactgccccagctggaccaccccaacctgatccagagaaaggccatcagcggctacgccggcttcatccccagattcacctgggtgatgggcctgaactacagagacggcgtgatgcaggccatggacgagttcgacaagagccagttcctgttcagaaacccccactgcgacctgggcgagaagctgcccggcacccactggcccagcaaccacatctacagcagccagggcctgatccccttctacatgggcttcatccccgccatgcaggacaactacgccctgaccttcggcaacagcaccagaagagcctactggaaggagtgggccaagagaaaccacaccctgtag

SEQ ID NO: 20983 - DNA, 816 bp, Artificial Sequence
  Description of Artificial Sequence: Synthetic coding sequence
atgaccaccacccagaagcacgacctgttcacccccgagccccactacgtgcccggctacgccggcttcttcccccagctgagataccaggtgggcaacacctacggcagaaccaccggccagctgctgaccgaccccagcgtgcagaagagcccctgcagcgtgctgagccccatgagcaagcccaagttcatcgaggacttcagccagagcaagccccccagagtgccctgccaggacctgaccgagccctacatcccccactacaccagcctgaagcccagcaagaacttcgagatcctgggccagctgccccccctggaggtggacgcccaggagccccccggcgtggagaacatccccagacagatcctgctgcccgccggcttcacccccgacaccccccaccccccctgcccccccggcagaaagggcgacagcagagacctgggccaccccgtgtacggcgaggaggcctggaagagcgccacccccgtgtgcgaggcccccagacagcaccagctgtaccactgccagagagacgagtaccccccccccgccagaagacagcaggagaccctggacgtgggcagcttccagagactgccccagctggaccaccccaacctgatccagagaaaggccatcagcgagcaggccagcggcctgggcggcccccccctgccccccagctgcttccaggagcccagcttcagccaggacgaggccgtgccctgcctgcccgtgcccatctggccccaccagaccgtggccaacgtgcagggcaccaagggcagcctggcctggctgccctag

SEQ ID NO: 20984 - DNA, 780 bp, Artificial Sequence
  Description of Artificial Sequence: Synthetic coding sequence
atggccgtggccagcaccttcatccccggcctgaacccccagaacccccactacatccccggctacaccggccactgccccctgctgagattcagcgtgggccagacctacggccaggtgaccggccagctgctgagaggcccccccggcctggcctggccccccgtgcacagaaccctgctgccccccatcagaccccccagaagccccgaggtgcccagagagagcctgcccgtgagaagaggccaggagagactgagcagcagcatgatccccggctacaccggcttcgtgcccagagcccagttcatcttcgccaagaactgcagccaggtgtgggccgaggccctgagcgacttcacccacctgcacgagaagcagggcagcgaggagctgcccaaggaggccaagggcagaaaggacaccgagaaggaccaggtgcccgagcccgagggccagctggaggagcccaccctggaggtggtggagcaggccagcccctacagcatggacgacagagaccccagaaagttcttcatgagcgccttcctgtgcagccccaccagacactgcagaaacctgggcagaagcacccaccaggccgtgcccagaacccccaacatcagcccccacttccccgagcacaccctgagaacctgggtgttctacaactacggcggctacgtgcccggctacaagttccagttcggccacaccttcggccacctgacccacgacgccctgggcctgagcaccttccagaagcagctgctggcctag

SEQ ID NO: 20985 - DNA, 492 bp, Artificial Sequence
  Description of Artificial Sequence: Synthetic coding sequence
atgagcctgggcctgctgaagttccaggccgtgggcgaggaggacgaggaggacgaggagggcgagagcctggacagcgtgaaggccctgaccgccaagctgcagctgcagaccagaagacccagctacctggagtggaccgcccaggtgcagagccaggcctggagaagagcccaggccaagcccggccccggcggccccggcgacatctgcggcttcgacagcatggacagcgccctggagtggctgagaagagagctgagagagatgcaggcccaggacagacagctggccggccagctgctgagactgagagcccagctgcacagactgaagatggaccaggcctgccacctgcaccaggagctgctggacgaggccgagctggagctggagctggagcccggcgccggcctggccctggcccccctgctgagacacctgggcctgaccagaatgaacatcagcgccagaagattcaccctgtgctag

SEQ ID NO: 20986 - DNA, 735 bp, Artificial Sequence
  Description of Artificial Sequence: Synthetic coding sequence
atgaaccccgtgtacagccccgtgcagcccggcgccccctacggcaaccccaagaacatggcctacaccggctaccccaccgcctaccccgccgccgcccccgcctacaaccccagcctgtaccccaccaacagccccagctacgcccccgagttccagttcctgcacagcgcctacgccaccctgctgatgaagcaggcctggccccagaacagcagcagctgcggcaccgagggcaccttccacctgcccgtggacaccggcaccgagaacagaacctaccaggccagcagcgccgccttcagatacaccgccggcaccccctacaaggtgccccccacccagagcaacaccgccccccccccctacagccccagccccaacccctaccagaccgccatgtaccccatcagaagcgcctacccccagcagaacctgtacgcccagggcgcctactacacccagcccgtgtacgccgcccagccccacgtgatccaccacaccaccgtggtgcagcccaacagcatccccagcgccatctaccccgcccccgtggccgcccccagaaccaacggcgtggccatgggcatggtggccggcaccaccatggccatgagcgccggcaccctgctgaccaccccccagcacaccgccatcggcgcccaccccgtgagcatgcccacctacagagcccagggcacccccgcctacagctacgtgcccccccactggtag

SEQ ID NO: 20987 - DNA, 708 bp, Artificial Sequence
  Description of Artificial Sequence: Synthetic coding sequence
atgaaccccgtgtacagccccgtgcagcccggcgccccctacggcaaccccaagaacatggcctacaccggctaccccaccgcctaccccgccgccgcccccgcctacaaccccagcctgtaccccaccaacagccccagctacgcccccgccaccctgctgatgaagcaggcctggccccagaacagcagcagctgcggcaccgagggcaccttccacctgcccgtggacaccggcaccgagaacagaacctaccaggccagcagcgccgccttcagatacaccgccggcaccccctacaaggtgccccccacccagagcaacaccgccccccccccctacagccccagccccaacccctaccagaccgccatgtaccccatcagaagcgcctacccccagcagaacctgtacgcccagggcgcctactacacccagcccgtgtacgccgcccagccccacgtgatccaccacaccaccgtggtgcagcccaacagcatccccagcgccatctaccccgcccccgtggccgcccccagaaccaacggcgtggccatgggcatggtggccggcaccaccatggccatgagcgccggcaccctgctgaccaccccccagcacaccgccatcggcgcccaccccgtgagcatgcccacctacagagcccagggcacccccgcctacagctacgtgcccccccactggtag

SEQ ID NO: 20988 - DNA, 390 bp, Artificial Sequence
  Description of Artificial Sequence: Synthetic coding sequence
atgaaccccgtgtacagccccgtgcagcccggcgccccctacggcaaccccaagaacatggcctacaccggctaccccaccgcctaccccgccgccgcccccgcctacaaccccagcctgtaccccaccaacagccccagctacgcccccgccaccctgctgatgaagcaggcctggccccagaacagcagcagctgcggcaccgagggcaccttccacctgcccgtggacaccggcaccgagaacagaacctaccaggccagcagcgccgccttcagcaccctgctgaccaccccccagcacaccgccatcggcgcccaccccgtgagcatgcccacctacagagcccagggcacccccgcctacagctacgtgcccccccactggtag

SEQ ID NO: 20989 - DNA, 372 bp, Artificial Sequence
  Description of Artificial Sequence: Synthetic coding sequence
atgaaccccgtgtacagccccggcagcagcggcgtgccctacgccaacgccaagggcatcggctaccccgccggcttccccatgggctacgccgccgccgcccccgcctacagccccaacatgtaccccggcgccaaccccaccttccagaccggctacacccccggcaccccctacaaggtgagctgcagccccaccagcggcgccgtgcccccctacagcagcagccccaacgccgtgcccatgagcccctgcgccgaccagtgggccagacagctgggccagatcagcggccagcccttcgtgctgctggccggcctgctgtgctggccccacggcgaggccctggagagcctgatggactgcaactag

SEQ ID NO: 20990 - DNA, 588 bp, Artificial Sequence
  Description of Artificial Sequence: Synthetic coding sequence
atgaaccccgtgtacagccccggcagcagcggcgtgccctacgccaacgccaagggcatcggctaccccgccggcttccccatgggctacgccgccgccgcccccgcctacagccccaacatgtaccccggcgccaaccccaccttccagaccggctacacccccggcaccccctacaaggtgagctgcagccccaccagcggcgccgtgcccccctacagcagcagccccaacccctaccagaccgccgtgtaccccgtgagaagcgcctacccccagcagagcccctacgcccagcagggcacctactacacccagcccctgtacgccgcccccccccacgtgatccaccacaccaccgtggtgcagcccaacggcatgcccgccaccgtgtaccccgcccccatccccccccccagaggcaacggcgtgaccatgggcatggtggccggcaccaccatggccatgagcgccggcaccctgctgaccgcccacagccccacccccgtggccccccaccccgtgaccgtgcccacctacagagcccccggcacccccacctacagctacgtgcccccccagtggtag

SEQ ID NO: 20991 - DNA, 588 bp, Artificial Sequence; identical to SEQ ID NO: 20990
  Description of Artificial Sequence: Synthetic coding sequence

SEQ ID NO: 20992 - DNA, 384 bp, Artificial Sequence
  Description of Artificial Sequence: Synthetic coding sequence
atggccttccccgtggacatgctggagaactgcagccacgaggagctggagaacagcgccgaggactacatgagcgacctgagatgcggcgaccccgagaaccccgagtgcttcagcctgctgaacatcaccatccccatcagcctgagcaacgtgggcttcgtgcccctgtacggcggcgaccagacccagaagatcctggccctgttcgcccccgaggacagcctgaccgccgtggccctgtacctggccgaccagtggtgggccatcgacgacatcgtgaagaccagcgtgcccagcagagagggcctgaagcaggaggcctacgtgcccctgttcctgcccaaggtgaccaactgccagttcctgatccagtgcttctag

SEQ ID NO: 20993 - DNA, 2013 bp, Artificial Sequence
  Description of Artificial Sequence: Synthetic coding sequence
atggccttccccgtggacatgctggagaactgcagccacgaggagctggagaacagcgccgaggactacatgagcgacctgagatgcggcgaccccgagaaccccgagtgcttcagcctgctgaacatcaccatccccatcagcctgagcaacgtgggcttcgtgcccctgtacggcggcgaccagacccagaagatcctggccctgttcgcccccgaggacagcctgaccgccgtggccctgtacctggccgaccagtggtgggccatcgacgacatcgtgaagaccagcgtgcccagcagagagggcctgaagcaggtgagcaccctgggcgagagagtggtgctgtacgtgctgaacagaatcatctacagaaagcaggagatggagagaaacgagatccccttcctgtgccacagcagcaccgactacgccaagatcctgtggaagaagggcgaggccatcggcttctacagcgtgaagcccaccggcagcatctgcgccagcttcctgacccagagctaccagctgcccgtgctggacaccatgttcctgagaaagaagtacagaggcaaggacttcggcctgcacatgctggaggacttcgtggacagcttcaccgaggacgccctgggcctgagataccccctgagcagcctgatgtacaccgcctgcaagcagtacttcgagaagtaccccggcgaccacgagctgctgtgggaggtggagggcgtgggccactggtaccagagaatccccgtgaccagagccctgcagagagaggccctgaagatcctggccctgagccagaacgagcccaagagacccatgagcggcgagtacggccccgccagcgtgcccgagtacgaggccagaaccgaggacaaccagagcagcgagatgcagctgaccatcgacagcctgaaggacgccttcgccagcaccagcgagggccacgacaagaccagcgtgagcacccacaccagaagcggcaacctgaagagacccaagatcggcaagagattccaggacagcgagttcagcagcagccagggcgaggacgagaagaccagccagaccagcctgaccgccagcatcaacaagctggagagcaccgccagacccagcgagagcagcgaggagttcctggaggaggagcccgagcagagaggcatcgagttcgaggacgagagcagcgacagagacgccagacccgccctggagacccagccccagcaggagaagcaggacggcgagaaggagagcgagctggagcccatgaacggcgagatcatggacgacagcctgaagaccagcctgatcaccgaggaggaggacagcaccagcgaggtgctggacgaggagctgaagctgcagcccttcaacagcagcgaggacagcaccaacctggtgcccctggtggtggagagcagcaagccccccgaggtggacgcccccgacaagacccccagaatccccgacagcgagatgctgatggacgagggcaccagcgacgagaagggccacatggaggagaagctgagcctgctgcccagaaagaaggcccacctgggcagcagcgacaacgtggccaccatgagcaacgaggagagaagcgacggcggcttccccaacagcgtgatcgccgagttcagcgaggagcccgtgagcgagaacctgagccccaacaccaccagcagcctggaggaccagggcgaggagggcgtgagcgagccccaggagaccagcaccgccctgccccagagcagcctgatcgaggtggagctggaggacgtgcccttcagccagaacgccggccagaagaaccagagcgaggagcagagcgaggccagcagcgagcagctggaccagttcacccagagcgccgagaaggccgtggacagcagcagcgaggagatcgaggtggaggtgcccgtggtggacagaagaaacctgagaagaaaggccaagggccacaagggccccgccaagaagaaggccaagctgacctag

SEQ ID NO: 20994 - DNA, 261 bp, Artificial Sequence
  Description of Artificial Sequence: Synthetic coding sequence
atggccttccccgtggacatgctggagaactgcagccacgaggagctggagaacagcgccgaggactacatgagcgacctgagatgcggcgaccccgagaaccccgagtgcttcagcctgctgaacatcaccatccccatcagcctgagcaacgtgggcttcgtgcccctgtacggcggcgaccagacccagaagatcctggccctgttcgcccccgaggacagcctgaccgccgtggccctgtacctggccgaccagtag

SEQ ID NO: 20995 - DNA, 672 bp, Artificial Sequence
  Description of Artificial Sequence: Synthetic coding sequence
atggccttccccgtggacatgctggagaactgcagccacgaggagctggagaacagcgccgaggactacatgagcgacctgagatgcggcgaccccgagaaccccgagtgcttcagcctgctgaacatcaccatccccatcagcctgagcaacgtgggcttcgtgcccctgtacggcggcgaccagacccagaagatcctggccctgttcgcccccgaggacagcctgaccgccgtggccctgtacctggccgaccagtggtgggccatcgacgacatcgtgaagaccagcgtgcccagcagagagggcctgaagcaggtgagcaccctgggcgagagagtggtgctgtacgtgctgaacagaatcatctacagaaagcaggagatggagagaaacgagatccccttcctgtgccacagcagcaccgactacgccaagatcctgtggaagaagggcgaggccatcggcttctacagcgtgaagcccaccggcagcatctgcgccagcttcctgacccagagctaccagctgcccgtgctggacaccatgttcctgagaaagaagtacagaggcaaggacttcggcctgcacatgctggaggacttcgtggacagcttcaccgaggacgccctgggcctgagataccccctgagcagcctgatgtacacctag

SEQ ID NO: 20996 - DNA, 528 bp, Artificial Sequence
  Description of Artificial Sequence: Synthetic coding sequence
atggccttccccgtggacatgctggagaactgcagccacgaggagctggagaacagcgccgaggactacatgagcgacctgagatgcggcgaccccgagaaccccgagtgcttcagcctgctgaacatcaccatccccatcagcctgagcaacgtgggcttcgtgcccctgtacggcggcgaccagacccagaagatcctggccctgttcgcccccgaggacagcctgaccgccgtggccctgtacctggccgaccagtggtgggccatcgacgacatcgtgaagaccagcgtgcccagcagagagggcctgaagcaggtgagcaccctgggcgagagagtggtgctgtacgtgctgaacagaatcatctacagaaagcaggagatggagagaaacgagatccccttcctgtgccacagcagcaccgactacgccaagatcctgtggaagaagggcgaggccatcggcttctacagcgtgaagcccaccggcagcatctgcgccagcttcctgacccagagctactag

SEQ ID NO: 20997 - DNA, 579 bp, Artificial Sequence
  Description of Artificial Sequence: Synthetic coding sequence
atgaaggtgcagagcttcggcgagagagtggtgctgttcatcctgaacgccatcatcttcggcagactggagagaaacctggacgacgacgacatgttcttcctgccccacagcgtgaaggagcaggccaagatcctgtggagaagaggcgccgccgtgggcttctacaccaccaagatgaagggcagactgtgcggcgacggcaccggcgcctgctacctgctgcccgtgttcgacaccgtgttcatcagaagaaagcactggcacagaggcctgggcaccgccatgctgagagacttctgcgagaccttccccgaggacgaggccctgggcgtgagctgcagcatgagccccgccatgtaccaggcccaccccggcaacagcgaggacgtgagcagacacgccagaaccagccagaacgacagacccagacagcccgcccccggcgacggcagcaaggagagaatgtgcggcgaggagctggaggacaccaaggacgaccccgagtgcggcgtggaggaggaggacgccggcctggccggccagccccccggcaagctgaccagaagcagcccctag

SEQ ID NO: 20998 - DNA, 579 bp, Artificial Sequence; identical to SEQ ID NO: 20997
  Description of Artificial Sequence: Synthetic coding sequence

SEQ ID NO: 20999 - DNA, 990 bp, Artificial Sequence
  Description of Artificial Sequence: Synthetic coding sequence
atgaagagaagacagaagagaaagcacctggagaacgaggagagccaggagaccgccgagaagggcggcggcatgagcaagagccaggaggacgccctgcagcccggcagcaccagagtggccaagggctggagccagggcgtgggcgaggtgaccagcaccagcgagtactgcagctgcgtgagcagcagcagaaagctgatccacagcggcatccagagaatccacagagacagcccccagccccagagccccctggcccaggtgcaggagagaggcgagaccccccccagaagccagcacgtgagcctgagcagctacagcagctacaagacctgcgtgagcagcctgtgcgtgaacaaggaggagagaggcatgaagatctactacatgcaggtgcagatgaacaagggcgtggccgtgagctgggagaccgaggagaccctggagagcctggagaagcagcccagaatggaggaggtgaccctgagcgaggtggtgagagtgggcaccccccccagcgacgtgagcaccagaaacctgctgagcgacagcgagcccagcggcgaggagaaggagcacgaggagagaaccgagagcgacagcctgcccggcagccccaccgtggaggacacccccagagccaagacccccgactggctggtgaccatggagaacggcttcagatgcatggcctgctgcagagtgttcaccaccatggaggccctgcaggagcacgtgcagttcggcatcagagagggcttcagctgccacgtgttccacctgaccatggcccagctgaccggcaacatggagagcgagagcacccaggacgagcaggaggaggagaacggcaacgagaaggaggaggaggagaagcccgaggccaaggaggaggagggccagcccaccgaggaggacctgggcctgagaagaagctggagccagtgccccggctgcgtgttccacagccccaaggacagaaactag

SEQ ID NO: 21000 - DNA, 849 bp, Artificial Sequence
  Description of Artificial Sequence: Synthetic coding sequence
atgaagagaagacagaagagaaagcacctggagaacgaggagagccaggagaccgccgagaagggcggcggcatccagagaatccacagagacagcccccagccccagagccccctggcccaggtgcaggagagaggcgagaccccccccagaagccagcacgtgagcctgagcagctacagcagctacaagacctgcgtgagcagcctgtgcgtgaacaaggaggagagaggcatgaagatctactacatgcaggtgcagatgaacaagggcgtggccgtgagctgggagaccgaggagaccctggagagcctggagaagcagcccagaatggaggaggtgaccctgagcgaggtggtgagagtgggcaccccccccagcgacgtgagcaccagaaacctgctgagcgacagcgagcccagcggcgaggagaaggagcacgaggagagaaccgagagcgacagcctgcccggcagccccaccgtggaggacacccccagagccaagacccccgactggctggtgaccatggagaacggcttcagatgcatggcctgctgcagagtgttcaccaccatggaggccctgcaggagcacgtgcagttcggcatcagagagggcttcagctgccacgtgttccacctgaccatggcccagctgaccggcaacatggagagcgagagcacccaggacgagcaggaggaggagaacggcaacgagaaggaggaggaggagaagcccgaggccaaggaggaggagggccagcccaccgaggaggacctgggcctgagaagaagctggagccagtgccccggctgcgtgttccacagccccaaggacagaaactag

SEQ ID NO: 21001 - DNA, 735 bp, Artificial Sequence
  Description of Artificial Sequence: Synthetic coding sequence
atgaagagaagacagaagagaaagcacctggagaacgaggagagccaggagaccgccgagaagggcggcggcatccagagaatccacagagacagcccccagccccagagccccctggcccaggtgcaggagagaggcgagaccccccccagaagccagcacgtgagcctgagcagctacagcagctacaagacctgcgtgagcagcctgtgcgtgaacaaggaggagagaggcatgaagatctactacatgcaggtgcagatgaacaagggcgtggccgtgagctgggagaccgaggagaccctggagagcctggagaagcagcccagaatggaggaggtgaccctgagcgaggtggtgagagtgggcaccccccccagcgacgtgagcaccagaaacctgctgagcgacagcgagcccagcggcgaggagaaggagcacgaggagagaaccgagagcgacagcctgcccggcagccccaccgtggaggacacccccagagccaagacccccgactggctggtgaccatggagaacggcttcagatgcatggcctgctgcagagtgttcaccaccatggaggccctgcaggagcacgtgcagttcggcatcagagagggcttcagctgccccaagatgagcagaagaagaaagatggagatgagaagaagaagaaagagaaaccagaagcagagaagaagaagaggcagcccccagaagaagaccctggcctag

SEQ ID NO: 21002 - DNA, 993 bp, Artificial Sequence
  Description of Artificial Sequence: Synthetic coding sequence
atgaagagaagacagaagagaaagcacctggagaacgaggagagccaggagaccgccgagaagggcggcggcatgagcaagagccaggaggacgccctgcagcccggcagcaccagagtggccaagggctggagccagggcgtgggcgaggtgaccagcaccagcgagtactgcagctgcgtgagcagcagcagaaagctgatccacagcggcatccagagaatccacagagacagcccccagccccagagccccctggcccaggtgcaggagagaggcgagaccccccccagaagccagcacgtgagcctgagcagctacagcagctacaagacctgcgtgagcagcctgtgcgtgaacaaggaggagagaggcatgaagatctactacatgcaggtgcagatgaacaagggcgtggccgtgagctgggagaccgaggagaccctggagagcctggagaagcagcccagaatggaggaggtgaccctgagcgaggtggtgagagtgggcaccccccccagcgacgtgagcaccagaaacctgctgagcgacagcgagcccagcggcgaggagaaggagcacgaggagagaaccgagagcgacagcctgcccggcagccccaccgtggaggacacccccagagccaagacccccgactggctggtgaccatggagaacggcttcagatgcatggcctgctgcagagtgttcaccaccatggaggccctgcaggagcacgtgcagttcggcatcagagagggcttcagctgccacgtgttccacctgaccatggcccagctgaccggcaacatggagagcgagagcacccaggacgagcaggaggaggagaacggcaacgagaaggaggaggaggagaagcccgaggccaaggaggaggagggccagcccaccgaggaggacctgggcctgagaagaagctggagccagtgccccggctgcgtgttccacagccccaaggacagaaacagctag

SEQ ID NO: 21003 - DNA, 852 bp, Artificial Sequence
  Description of Artificial Sequence: Synthetic coding sequence
atgaagtgctacttcaccgaccacagaggcgagcagagccccaccgacggcaccaccctgagcctgaccagccccgagagcaccgaggagagcgtggaggtgttctggcccggcaccatccagagagagggcagcagccccagacccggccccgccatccccagagaggagggcctgtacttcgccgccagagacagaggcatgagagactggagcagcagccccagcagcgagagcagcgagtaccagagctacagccagtaccagagctgctgcagctgcatgtgcgacgaggacaacgccgccccccagagcgtgtgcgccttctacacccacgtgcagaccgtgagaggcgtggccgtggcctgggagaccgaggccggcttcgagcccgtgaccagaaagcccagaatccacgaggcccagttcatcaagagacagagatggaacggcagcagcttcgagatggccagcaacaccgacatgagatgggacctggaggcctgcaagagcaactgcagccccgagcccgaggacatcgacctgctggagtgctgcctgcaggagctgagagagccccccgactggctggtgaccaccaactacggcgtgagatgcgtggcctgctgcagagtgctgcccagcctggacgccctgctggagcacgcccagcacggcatcagagagggcttcagctgccagatcttcttcgaggagatgctggagagaagaagagcccagggccaggcccacgaccagcagctggaggaggagcagagccccagcgacaacagcgagtgcagcagaccccagggcgaggtgctgagcgcccagcagcaggagaagcagtag

SEQ ID NO: 21004 - DNA, 498 bp, Artificial Sequence
  Description of Artificial Sequence: Synthetic coding sequence
atggacgcccccagaagagacatggagctgctgagcaacagcctggccgcctacgcccacatcagagccaaccccgagagcttcggcctgtacttcgtgctgggcgtgtgcttcggcctgctgctgaccctgtgcctgctggtgatcagcatcagctgggcccccagacccagacccagaggccccgcccagagaagagaccccagaagcagcaccctggagcccgaggacgacgacgaggacgaggaggacaccgtgaccagactgggccccgacgacaccctgcccggccccgagctgagcgccgagcccgacggccccctgaacgtgaacgtgttcaccagcgccgaggagctggagagagcccagagactggaggagagagagagaatcctgagagagatctggagaaccggccagcccgacctgctgggcaccggcaccctgggccccagccccaccgccaccggcaccctgggcagaatgcactactactag

SEQ ID NO: 21005 - DNA, 711 bp, Artificial Sequence
  Description of Artificial Sequence: Synthetic coding sequence
atggaggtgggcctgcccgccatcaccctgttcctgaccagcgccagcagccccgtggtggccaccaccatggaccaggagcccgtgggcggcgtggagagaggcgaggccgtggccgccagcggcgccgccgccgccgccgccttcggcgagagcgccggccagatgagcaacgagagaggcttcgagaacgtggagctgggcgtgatcggcaagaagaagaaggtgcccagaagagtgatccacttcgtgagcggcgagaccatggaggagtacagcaccgacgaggacgaggtggacggcctggagaagaaggacgtgctgcccaccgtggaccccaccaagctgacctggggcccctacctgtggttctacatgctgagagccgccaccagcaccctgagcgtgtgcgacttcctgggcgagaagatcgccagcgtgctgggcatcagcacccccaagtaccagtacgccatcgacgagtactacagaatgaagaaggaggaggaggaggaggaggaggagaacagaatgagcgaggaggccgagaagcagtaccagcagaacaagctgcagaccgacagcatcgtgcagaccgaccagcccgagaccgtgatcagcagcagcttcgtgaacgtgaacttcgagatggagggcgacagcgaggtgatcatggagagcaagcagaaccccgtgagcgtgcccccctag

SEQ ID NO: 21006 - DNA, 642 bp, Artificial Sequence
  Description of Artificial Sequence: Synthetic coding sequence
atggaccaggagcccgtgggcggcgtggagagaggcgaggccgtggccgccagcggcgccgccgccgccgccgccttcggcgagagcgccggccagatgagcaacgagagaggcttcgagaacgtggagctgggcgtgatcggcaagaagaagaaggtgcccagaagagtgatccacttcgtgagcggcgagaccatggaggagtacagcaccgacgaggacgaggtggacggcctggagaagaaggacgtgctgcccaccgtggaccccaccaagctgacctggggcccctacctgtggttctacatgctgagagccgccaccagcaccctgagcgtgtgcgacttcctgggcgagaagatcgccagcgtgctgggcatcagcacccccaagtaccagtacgccatcgacgagtactacagaatgaagaaggaggaggaggaggaggaggaggagaacagaatgagcgaggaggccgagaagcagtaccagcagaacaagctgcagaccgacagcatcgtgcagaccgaccagcccgagaccgtgatcagcagcagcttcgtgaacgtgaacttcgagatggagggcgacagcgaggtgatcatggagagcaagcagaaccccgtgagcgtgcccccctag

SEQ ID NO: 21007 - DNA, 642 bp, Artificial Sequence; identical to SEQ ID NO: 21006
  Description of Artificial Sequence: Synthetic coding sequence

SEQ ID NO: 21008 - DNA, 231 bp, Artificial Sequence
  Description of Artificial Sequence: Synthetic coding sequence
atggaccaggagcccgtgggcggcgtggagagaggcgaggccgtggccgccagcggcgccgccgccgccgccgccttcggcgagagcgccggccagatgagcaacgagagaggcttcgagaacgtggagctgggcgtgatcggcaagaagaagaaggtgcccagaagagtgatccacttcgtgagcggcgagaccatggaggagtacagcaccgacgaggacgaggtgtag

SEQ ID NO: 21009 - DNA, 477 bp, Artificial Sequence
  Description of Artificial Sequence: Synthetic coding sequence
atggagatcgacggcttccagcagctggacctggagaagagcgtgcccagcaagaagaccacccccaagagaatcatccacttcgtggacggcgacatcatggaggagtacagcaccgaggaggaggaggaggaggagaaggaggagcagagcaccaacagcaccctggaccccagcaagctgagctggggcccctacctgagattctgggccggcagaatcgccagcaccagcttcagcacctgcgagttcctgggcggcagattcgccgtgttcttcggcctgacccagcccaagtaccagtacgtgctgaacgagttctacagaatccagaacaagaagagcgacaacaagagcgagagaagaggcagcaaggcccaggccgccgaggtgcccaacgagaagtgccacctggaggccggcgtgcaggagtacggcaccatccagcaggacgtgaccgaggccatcccccagtag

SEQ ID NO: 21010 - DNA, 303 bp, Artificial Sequence
  Description of Artificial Sequence: Synthetic coding sequence
atggagatcgacggcttccagcagctggacctggagaagagcgtgcccagcaagaagaccacccccaagagaatcatccacttcgtggacggcgacatcatggaggagtacagcaccgaggaggaggaggaggaggagaaggaggagcagagcaccaacagcaccctggaccccagcaagctgagctggggcccctacctgagattctgggccggcagaatcgccagcaccagcttcagcacctgcgagttcctgggcggcagattcgccgtgttcttcggcctgacccagcccaagtactag

SEQ ID NO: 21011 - DNA, 477 bp, Artificial Sequence; identical to SEQ ID NO: 21009
  Description of Artificial Sequence: Synthetic coding sequence

SEQ ID NO: 21012 - DNA, 300 bp, Artificial Sequence
  Description of Artificial Sequence: Synthetic coding sequence
atggagatcgacggcttccagcagctggacctggagaagagcgtgcccagcaagaagaccacccccaagagaatcatccacttcgtggacggcgacatcatggaggagtacagcaccgaggaggaggaggaggaggagaaggaggagcagagcaccaacagcaccctggaccccagcaagctgagctggggcccctacctgagattctgggccggcagaatcgccagcaccagcttcagcacctgcgagttcctgggcggcagattcgccgtgttcttcggcctgacccagcccaagtag

SEQ ID NO: 21013 - DNA, 1944 bp, Artificial Sequence
  Description of Artificial Sequence: Synthetic coding sequence
atggccggcccccaggagaccgtgctggccctgcccctgagagagggcgtgcaggccgccgccaccgtgcccatcctgctgtacaacctggaggacggcctgagcgaccaccccctggaccagggccccagatgccccgccagaagaccctgcagccccgccagcgcccccgcccccaccagccccaagaagcccaagatccaggcccccggcgagaccttccccaccgactggagccccccccccgtggagttcctgaaccccagagtgctgcaggccagcagagaggcccccgcccagagatgggtgggcgtggtgggcccccagggcctgagaagactggccggcgagctgcccgaggagctggagcaggagcacctggacctggaccccaagagaggcctggccctgcccgagaagctgttctggaacaccagcggcctgagccagcaggccgccgcccccgagttcagctggggcggcagcggcagctacttcaacaacctggactacctgctgcaggagaagagagagcaggccctggagcaggagagagagagactgctgctgcaggagtgcctgaacctgaacagcctggacctggacgaggaggaggtgcccctgacccccgagcacagaatgctggtggagaagtacagcgtgagcctgcagaccatcccccccgtgcaccccggcgagaccgtgttcctgcccagatgccaccccctgccctgcatcctggacagcagcctgctgaagcccagaagccacctggagggcctgttcctgagcagcccccccgcccagcagctgagcttcctgagaagcggcctgctgaacatcctgtacctgcacatgcccgactgccccgtgagcctgctgcagtggctgttccagctgctgacctggccccccgagaccagcctgggcgccttcggcctgctgtgggacctgatcgtggacggcatcttcctgcagcccgacgaggacaagcacctgtggtgccccagcctgcaggaggtgagagaggccttccacagcctgggcgcccacagccccgccctgtaccccctgggccccttctggcacggcggcagagtgctgcccggcgaggccggcctgaacgagaacgaggagcaggacgccccccaggagatcgccctggacatcagcctgggccacatctacaagttcctggccctgtgcgcccaggcccagcccggcgcctacaccgacgagaacctgatgggcctgatcgagctgctgtgcagaaccagcctggacgtgggcctgagactgctgcccaaggtggacctgcagcagctgctgctgctgctgctggagaacatcagagagtggcccggcaagctgcaggagctgtgctgcaccctgagctgggtgagcgaccaccaccacaacctgctggccctggtgcagttcttccccgacatgaccagcagaagcagaagactgagaagccagctgagcctggtggtgatcgccagaatgctgggccagcaggagatgctgcccctgtggcaggagaagacccagctgagcagcctgagcagactgctgggcctgatgagacccagcagcctgagacagtacctggacagcgtgcccctgcccccctgccaggagcagcagcccaaggccagcgccgagctggaccacaaggcctgctacctgtgccacagcctgctgatgctggccggcgtggtggtgagctgccaggacatcacccccgaccagtggggcgagctgcagctgctgtgcatgcagctggacagacacatcagcacccagatcagagagagcccccaggccatgcacagaaccatgctgaaggacctggccacccagacctacatcagatggcaggagctgctgacccactgccagccccaggcccagtacttcagcccctggaaggacatctag

SEQ ID NO: 21014 - DNA, 360 bp, Artificial Sequence
  Description of Artificial Sequence: Synthetic coding sequence
atgagacccagcagcctgagacagtacctggacagcgtgcccctgcccccctgccaggagcagcagcccaaggccagcgccgagctggaccacaaggcctgctacctgtgccacagcctgctgatgctggccggcgtggtggtgagctgccaggacatcacccccgaccagtggggcgagctgcagctgctgtgcatgcagctggacagacacatcagcacccagatcagagagagcccccaggccatgcacagaaccatgctgaaggacctggccacccagacctacatcagatggcaggagctgctgacccactgccagccccaggcccagtacttcagcccctggaaggacatctag

SEQ ID NO: 21015 - DNA, 2484 bp, Artificial Sequence
  Description of Artificial Sequence: Synthetic coding sequence
atggcccacgagagagagatcctgaagggcatgtacgaggagctgaaggagaagagccacaagcccgacgtggagctgatccagcacagagcctggagaatcgacatggtgagcaccgagctggagagcttcagaaaggccagctacatcgagagcggccccgaggagttctaccagagattcaagaagtgcttcagcgccacccacatcttcatcagcatcaagggcaaggacagccagaacaccgcccacggctacctgatcctgaacagaaccctgcaccagcagctgaagatcaagaaccccttcctggcccccagcagcgaggccgtgagaatccccgccaccctgccccaccccggcgccctgcccttccccccctacgtggccaaggccagcagcgacgagctgctgaacctgcagaagcccctgcagagcgccctgggcttcgtgatcctgagaagcagccagaactggaacagcaagaacagacagagatggagcagaaccaaggccggccagatgagccacggcctgcagatggccggcccccaggagaccgtgctggccctgcccctgagagagggcgtgcaggccgccgccaccgtgcccatcctgctgtacaacctggaggacggcctgagcgaccaccccctggaccagggccccagatgccccgccagaagaccctgcagccccgccagcgcccccgcccccaccagccccaagaagcccaagatccaggcccccggcgagaccttccccaccgactggagccccccccccgtggagttcctgaaccccagagtgctgcaggccagcagagaggcccccgcccagagatgggtgggcgtggtgggcccccagggcctgagaagactggccggcgagctgcccgaggagctggagcaggagcacctggacctggaccccaagagaggcctggccctgcccgagaagctgttctggaacaccagcggcctgagccagcaggccgccgcccccgagttcagctggggcggcagcggcagctacttcaacaacctggactacctgctgcaggagaagagagagcaggccctggagcaggagagagagagactgctgctgcaggagtgcctgaacctgaacagcctggacctggacgaggaggaggtgcccctgacccccgagcacagaatgctggtggagaagtacagcgtgagcctgcagaccatcccccccgtgcaccccggcgagaccgtgttcctgcccagatgccaccccctgccctgcatcctggacagcagcctgctgaagcccagaagccacctggagggcctgttcctgagcagcccccccgcccagcagctgagcttcctgagaagcggcctgctgaacatcctgtacctgcacatgcccgactgccccgtgagcctgctgcagtggctgttccagctgctgacctggccccccgagaccagcctgggcgccttcggcctgctgtgggacctgatcgtggacggcatcttcctgcagcccgacgaggacaagcacctgtggtgccccagcctgcaggaggtgagagaggccttccacagcctgggcgcccacagccccgccctgtaccccctgggccccttctggcacggcggcagagtgctgcccggcgaggccggcctgaacgagaacgaggagcaggacgccccccaggagatcgccctggacatcagcctgggccacatctacaagttcctggccctgtgcgcccaggcccagcccggcgcctacaccgacgagaacctgatgggcctgatcgagctgctgtgcagaaccagcctggacgtgggcctgagactgctgcccaaggtggacctgcagcagctgctgctgctgctgctggagaacatcagagagtggcccggcaagctgcaggagctgtgctgcaccctgagctgggtgagcgaccaccaccacaacctgctggccctggtgcagttcttccccgacatgaccagcagaagcagaagactgagaagccagctgagcctggtggtgatcgccagaatgctgggccagcaggagatgctgcccctgtggcaggagaagacccagctgagcagcctgagcagactgctgggcctgatgagacccagcagcctgagacagtacctggacagcgtgcccctgcccccctgccaggagcagcagcccaaggccagcgccgagctggaccacaaggcctgctacctgtgccacagcctgctgatgctggccggcgtggtggtgagctgccaggacatcacccccgaccagtggggcgagctgcagctgctgtgcatgcagctggacagacacatcagcacccagatcagagagagcccccaggccatgcacagaaccatgctgaaggacctggccacccagacctacatcagatggcaggagctgctgacccactgccagccccaggcccagtacttcagcccctggaaggacatctag

SEQ ID NO: 21016 - DNA, 2040 bp, Artificial Sequence
  Description of Artificial Sequence: Synthetic coding sequence
atgtggcccagactgcccggcgccggcctggccccccagctgagaagacaggaccagagactgcacttcaccggccagatgagccacggcctgcagatggccggcccccaggagaccgtgctggccctgcccctgagagagggcgtgcaggccgccgccaccgtgcccatcctgctgtacaacctggaggacggcctgagcgaccaccccctggaccagggccccagatgccccgccagaagaccctgcagccccgccagcgcccccgcccccaccagccccaagaagcccaagatccaggcccccggcgagaccttccccaccgactggagccccccccccgtggagttcctgaaccccagagtgctgcaggccagcagagaggcccccgcccagagatgggtgggcgtggtgggcccccagggcctgagaagactggccggcgagctgcccgaggagctggagcaggagcacctggacctggaccccaagagaggcctggccctgcccgagaagctgttctggaacaccagcggcctgagccagcaggccgccgcccccgagttcagctggggcggcagcggcagctacttcaacaacctggactacctgctgcaggagaagagagagcaggccctggagcaggagagagagagactgctgctgcaggagtgcctgaacctgaacagcctggacctggacgaggaggaggtgcccctgacccccgagcacagaatgctggtggagaagtacagcgtgagcctgcagaccatcccccccgtgcaccccggcgagaccgtgttcctgcccagatgccaccccctgccctgcatcctggacagcagcctgctgaagcccagaagccacctggagggcctgttcctgagcagcccccccgcccagcagctgagcttcctgagaagcggcctgctgaacatcctgtacctgcacatgcccgactgccccgtgagcctgctgcagtggctgttccagctgctgacctggccccccgagaccagcctgggcgccttcggcctgctgtgggacctgatcgtggacggcatcttcctgcagcccgacgaggacaagcacctgtggtgccccagcctgcaggaggtgagagaggccttccacagcctgggcgcccacagccccgccctgtaccccctgggccccttctggcacggcggcagagtgctgcccggcgaggccggcctgaacgagaacgaggagcaggacgccccccaggagatcgccctggacatcagcctgggccacatctacaagttcctggccctgtgcgcccaggcccagcccggcgcctacaccgacgagaacctgatgggcctgatcgagctgctgtgcagaaccagcctggacgtgggcctgagactgctgcccaaggtggacctgcagcagctgctgctgctgctgctggagaacatcagagagtggcccggcaagctgcaggagctgtgctgcaccctgagctgggtgagcgaccaccaccacaacctgctggccctggtgcagttcttccccgacatgaccagcagaagcagaagactgagaagccagctgagcctggtggtgatcgccagaatgctgggccagcaggagatgctgcccctgtggcaggagaagacccagctgagcagcctgagcagactgctgggcctgatgagacccagcagcctgagacagtacctggacagcgtgcccctgcccccctgccaggagcagcagcccaaggccagcgccgagctggaccacaaggcctgctacctgtgccacagcctgctgatgctggccggcgtggtggtgagctgccaggacatcacccccgaccagtggggcgagctgcagctgctgtgcatgcagctggacagacacatcagcacccagatcagagagagcccccaggccatgcacagaaccatgctgaaggacctggccacccagacctacatcagatggcaggagctgctgacccactgccagccccaggcccagtacttcagcccctggaaggacatctag

SEQ ID NO: 21017 - DNA, 3060 bp, Artificial Sequence
  Description of Artificial Sequence: Synthetic coding sequence
atgggcaccagagacgacgtgcccgaggccaaggtgctggtgcccgtggccgtgtactgcggcagcatccccagaaccagcgccggccccagagtgctgccccccggcagcatcaacagcagcctgccccacggcgagggcagcctgcagcccgagcccagagccctgctgaacaacgaggagcccagccagctgctgagaggcctgggccagctgggcggcctgaagctggacacccccagcaagggctggcaggccagaaacggccaccccagaaacctgagagccctgagcctgggcgaccagcccctggtgctgctgcccagccccgagagcgaggccaacagcgtggccagagacaccatccagatcaaggacaagctgaagaagagaagactgagcgagggcctggccgccagcagcagagccagcctggaccccggcggcggcccccagggcgtgcccctgcacagcaccatccccagagccaccagccagagactgctgagagtgcccagacccatgcccctgatccagagcatccccaccacccccgaggccagcggcgtgaaggagaagggcctggacctgcccggcagcatccccggcccccacgagctgagacccggcgcccaggaggcccagatcagctggcagtacctgcactgcaacgacgagaagatgcagaagagcctgggcgccatcgtgatcccccccatccccaaggccagaaccgtggccgccacccccagcagagtgcccggcagcctgcccagccccctgccccccggccagggcgtgctgaccggcctgagagcccccagaaccagactggccagaggcagcggccccagagagaagacccccgccagcctggagcccaagcccctggccagccccatcagagacagacccgccgccgccaagaagcccgccctgcccttcagccagagcgcccccaccctgaccgccttcagcttcgactgcgccagagaggcctgcccccccctgaaggaggaggaccagaaggagatcggcaccaagatccaggtgaccatcagcaagagcgccagagagaagatgcagctgaagcagatgaaggagatggagctgctgagaagactggaggagcccagaaccggccaggagctgaccagccagtgcctgggcagccagagagccttcatgaaggagggcctgctgcccctgagaggcagcggcaccctgagcgtgcccaccagactgagcggcccctgcagaaacgacgtgagcatcatcctgagaaagtgggccagcagagccagcctgcccagcatccccatcagcagacaggagcccagattcgccagacacgccagcgccaacagcctgcccgccgtgctgaccctgggcagccccgagtgggaggaggaggaggagatggacctgagagcctgcaaggagctgagacccttcagcaaccccgagctgggcctgagagacgccctgcagtgcctgaacagcagcgactggcagatgaaggagaagggcctggtgagcatccagagactggccgcctgccacagcgaggtgctgaccggcaagctgcacgacgtgtgcctggtggtgaccggcgaggtgaccaacctgagaagcaaggtgagccacctggccatcagcaccctgggcgacctgttccaggccctgaagaagaacatggaccaggaggccgaggagatcgccagatgcctgctgcagaagatggccgacaccaacgagttcatccagagagccgccggccagagcctgagagccatggtggagaacgtgaccctggccagaagcctggtggtgctgaccagcgccggcgtgtaccacagaaaccccctgatcagaaagtacgccgccgagcacctgagcgccgtgctggagcagatcggcgccgagaagctgctgagcggcaccagagacagcaccgacatgctggtgcacaacctggtgagactggcccaggacagcaaccaggacaccagattctacggcagaaagatggtgaacatcctgatggccaacaccaagttcgacgccttcctgaagcagagcctgcccagctacgacctgcagaaggtgatggccgccatcaagcagcagggcatcgaggacaacgacgagctgcccagcgccaagggcagaaaggtgctgagaagcctggtggtgtgcgagaacggcctgcccatcaaggagggcctgagctgcaacggccccagactggtgggcctgagaagcaccctgcagggcagaggcgagatggtggagcagctgagagagctgaccagactgctggaggccaaggacttcagaagcagaatggagggcgtgggccagctgctggagctgtgcaaggccaagaccgagctggtgaccgcccacctggtgcaggtgttcgacgccttcacccccagactgcaggacagcaacaagaaggtgaaccagtgggccctggagagcttcgccaagatgatccccctgctgagagagagcctgcaccccatgctgctgagcatcatcatcaccgtggccgacaacctgaacagcaagaacagcggcatctacgccgccgccgtggccgtgctggacgccatggtggagagcctggacaacctgtgcctgctgcccgccctggccggcagagtgagattcctgagcggcagagccgtgctggacgtgaccgacagactggccgtgctggtggccagcgtgtaccccagaaagccccaggccgtggagagacacgtgctgcccatcctgtggcacttcctgaacaccgccaccagaaacggcaccctgcccggccccagcggcaacatcagaggcgtggtgtgcagactgagcagaagcctgcaggagcacatgggcagcagactgctggacttcgccgccagccagcccaagcacgtgctgaagaccctgcaggagctgctggacagcgagagcctgggcggcagcagaaaggccaccgacagaggcgtggcccccgacagcaagaccaccggcagcagctaccccttccagctggactag

SEQ ID NO: 21018 - DNA, 2895 bp, Artificial Sequence
  Description of Artificial Sequence: Synthetic coding sequence
atgggcaccagagacgacgtgcccgaggccaaggtgctggtgcccgtggccgtgtactgcggcagcatccccagaaccagcgccggccccagagtgctgccccccggcagcatcaacagcagcctgccccacggcgagggcagcctgcagcccgagcccagagccctgctgaacaacgaggagcccagccagctgctgagaggcctgggccagctgggcggcctgaagctggacacccccagcaagggctggcaggccagaaacggccaccccagaaacctgagagccctgagcctgggcgaccagcccctggtgctgctgcccagccccgagagcgaggccaacagcgtggccagagacaccatccagatcaaggacaagctgaagaagagaagactgagcgagggcctggccgccagcagcagagccagcctggaccccggcggcggcccccagggcgtgcccctgcacagcaccatccccagagccaccagccagagactgctgagagtgcccagacccatgcccctgatccagagcatccccaccacccccgaggccagcggcgtgaaggagaagggcctggacctgcccggcagcatccccggcccccacgagctgagacccggcgcccaggaggcccagatcagctggcagtacctgcactgcaacgacgagaagatgcagaagagcctgggcgccatcgtgatcccccccatccccaaggccagaaccgtggccgccacccccagcagagtgcccggcagcctgcccagccccctgccccccggccagggcgtgctgaccggcctgagagcccccagaaccagactggccagaggcagcggccccagagagaagacccccgccagcctggagcccaagcccctggccagccccatcagagacagacccgccgccgccaagaagcccgccctgcccttcagccagagcgcccccaccctgaccgccttcagcttcgactgcgccagagaggcctgcccccccctgaaggaggaggaccagaaggagatcggcaccaagatccaggtgaccatcagcaagagcgccagagagaagatgcagctgaagcagatgaaggagatggagctgctgagaagactggaggagcccagaaccggccaggagctgaccagccagtgcctgggcagccagagagccttcatgaaggaggccaacagcctgcccgccgtgctgaccctgggcagccccgagtgggaggaggaggaggagatggacctgagagcctgcaaggagctgagacccttcagcaaccccgagctgggcctgagagacgccctgcagtgcctgaacagcagcgactggcagatgaaggagaagggcctggtgagcatccagagactggccgcctgccacagcgaggtgctgaccggcaagctgcacgacgtgtgcctggtggtgaccggcgaggtgaccaacctgagaagcaaggtgagccacctggccatcagcaccctgggcgacctgttccaggccctgaagaagaacatggaccaggaggccgaggagatcgccagatgcctgctgcagaagatggccgacaccaacgagttcatccagagagccgccggccagagcctgagagccatggtggagaacgtgaccctggccagaagcctggtggtgctgaccagcgccggcgtgtaccacagaaaccccctgatcagaaagtacgccgccgagcacctgagcgccgtgctggagcagatcggcgccgagaagctgctgagcggcaccagagacagcaccgacatgctggtgcacaacctggtgagactggcccaggacagcaaccaggacaccagattctacggcagaaagatggtgaacatcctgatggccaacaccaagttcgacgccttcctgaagcagagcctgcccagctacgacctgcagaaggtgatggccgccatcaagcagcagggcatcgaggacaacgacgagctgcccagcgccaagggcagaaaggtgctgagaagcctggtggtgtgcgagaacggcctgcccatcaaggagggcctgagctgcaacggccccagactggtgggcctgagaagcaccctgcagggcagaggcgagatggtggagcagctgagagagctgaccagactgctggaggccaaggacttcagaagcagaatggagggcgtgggccagctgctggagctgtgcaaggccaagaccgagctggtgaccgcccacctggtgcaggtgttcgacgccttcacccccagactgcaggacagcaacaagaaggtgaaccagtgggccctggagagcttcgccaagatgatccccctgctgagagagagcctgcaccccatgctgctgagcatcatcatcaccgtggccgacaacctgaacagcaagaacagcggcatctacgccgccgccgtggccgtgctggacgccatggtggagagcctggacaacctgtgcctgctgcccgccctggccggcagagtgagattcctgagcggcagagccgtgctggacgtgaccgacagactggccgtgctggtggccagcgtgtaccccagaaagccccaggccgtggagagacacgtgctgcccatcctgtggcacttcctgaacaccgccaccagaaacggcaccctgcccggccccagcggcaacatcagaggcgtggtgtgcagactgagcagaagcctgcaggagcacatgggcagcagactgctggacttcgccgccagccagcccaagcacgtgctgaagaccctgcaggagctgctggacagcgagagcctgggcggcagcagaaaggccaccgacagaggcgtggcccccgacagcaagaccaccggcagcagctaccccttccagctggactag

SEQ ID NO: 21019 - DNA, 210 bp, Artificial Sequence
  Description of Artificial Sequence: Synthetic coding sequence
atgggcaccagagacgacgtgcccgaggccaaggtgctggtgcccgtggccgtgtactgcggcagcatccccagaaccagcgccggccccagagtgctgccccccggcagcatcaacagcagcctgccccacggcgagggcagcctgcagcccgagcccagagccctgctgaacaacgaggagcccagccagctgctgagaggcctgtag

SEQ ID NO: 21020 - DNA, 5163 bp, Artificial Sequence
  Description of Artificial Sequence: Synthetic coding sequence
atggccgccgcccccagcgccctgctgctgctgccccccttccccgtgctgagcacctacagactgcagagcagaagcagacccagcgcccccgagaccgacgacagcagagtgggcggcatcatgagaggcgagaagaactactacttcagaggcgccgccggcgaccacggcagctgccccaccaccaccagccccctggccagcgccctgctgatgcccagcgaggccgtgagcagcagctggagcgagagcggcggcggcctgagcggcggcgacgaggaggacaccagactgctgcagctgctgagaaccgccagagaccccagcgaggccttccaggccctgcaggccgccctgcccagaagaggcggcagactgggcttccccagaagaaaggaggccctgtacagagccctgggcagagtgctggtggagggcggcagcgacgagaagagactgtgcctgcagctgctgagcgacgtgctgagaggccagggcgaggccggccagctggaggaggccttcagcctggccctgctgccccagctggtggtgagcctgagagaggagaaccccgccctgagaaaggacgccctgcagatcctgcacatctgcctgaagagaagccccggcgaggtgctgagaaccctgatccagcagggcctggagagcaccgacgccagactgagagccagcaccgccctgctgctgcccatcctgctgaccaccgaggacctgctgctgggcctggacctgaccgaggtgatcatcagcctggccagaaagctgggcgaccaggagaccgaggaggagagcgagaccgccttcagcgccctgcagcagatcggcgagagactgggccaggacagattccagagctacatcagcagactgcccagcgccctgagaagacactacaacagaagactggagagccagttcggcagccaggtgccctactacctggagctggaggccagcggcttccccgaggaccccctgccctgcgccgtgaccctgagcaacagcaacctgaagttcggcatcatcccccaggagctgcacagcagactgctggaccaggaggactacaagaacagaacccaggccgtggaggagctgaagcaggtgctgggcaagttcaaccccagcagcaccccccacagcagcctggtgggcttcatcagcctgctgtacaacctgctggacgacagcaacttcaaggtggtgcacggcaccctggaggtgctgcacctgctggtgatcagactgggcgagcaggtgcagcagttcctgggccccgtgatcgccgccagcgtgaaggtgctggccgacaacaagctggtgatcaagcaggagtacatgaagatcttcctgaagctgatgaaggaggtgggcccccagcaggtgctgtgcctgctgctggagcacctgaagcacaagcacagcagagtgagagaggaggtggtgaacatctgcatctgcagcctgctgacctaccccagcgaggacttcgacctgcccaagctgagcttcgacctggcccccgccctggtggacagcaagagaagagtgagacaggccgccctggaggccttcgccgtgctggccagcagcatgggcagcggcaagaccagcatcctgttcaaggccgtggacaccgtggagctgcaggacaacggcgacggcgtgatgaacgccgtgcaggccagactggccagaaagaccctgcccagactgaccgagcagggcttcgtggagtacgccgtgctgatgcccagcagcgccggcggcagaagcaaccacctggcccacggcgccgacaccgactggctgctggccggcaacagaacccagagcgcccactgccactgcggcgaccacgtgagagacagcatgcacatctacggcagctacagccccaccatctgcaccagaagagtgctgagcgccggcaagggcaagaacaagctgccctgggagaacgagcagcccggcatcatgggcgagaaccagaccagcaccagcaaggacatcgagcagttcagcacctacgacttcatccccagcgccaagctgaagctgagccagggcatgcccgtgaacgacgacctgtgcttcagcagaaagagagtgagcagaaacctgttccagaacagcagagacttcaaccccgactgcctgcccctgtgcgccgccggcaccaccggcacccaccagaccaacctgagcggcaagtgcgcccagctgggcttcagccagatctgcggcaagaccggcagcgtgggcagcgacctgcagttcctgggcaccaccagcagccaccaggagaaggtgtacgccagcctgaacttcggcagcaagacccagcagaccttcggcagccagaccgagtgcaccagcagcaacggccagaaccccagccccggcgcctacatcctgcccagctaccccgtgagcagccccagaaccagccccaagcacaccagccccctgatcatcagccccaagaagagccaggacaacagcgtgaacttcagcaacagctggcccctgaagagcttcgagggcctgagcaagcccagcccccagaagaagctggtgagccagaagagcagcgaccccaccggcagaaaccacggcgagaacagccaggagaagccccccgtgcagctgacccccgccctggtgagaagccccagcagcagaagaggcctgaacggcaccaagcccgtgccccccatccccagaggcatcagcctgctgcccgacaaggccgacctgagcaccgtgggccacaagaagaaggagcccgacgacatctggaagtgcgagaaggacagcctgcccatcgacctgagcgagctgaacttcaaggacaaggacctggaccaggaggagatgcacagcagcctgagaagcctgagaaacagcgccgccaagaagagagccaagctgagcggcagcaccagcgacctggagagccccgacagcgccatgaagctggacctgaccatggacagccccagcctgagcagcagccccaacatcaacagctacagcgagagcggcgtgtacagccaggagagcctgaccagcagcctgagcaccaccccccagggcaagagaatcatgagcgacatcttccccaccttcggcagcaagccctgccccaccagactgagcagcgccaagaagaagatcagccacatcgccgagcagagccccagcgccggcagcagcagcaacccccagcagatcagcagcttcgacttcaccaccaccaaggccctgagcgaggacagcgtggtggtggtgggcaagggcgtgttcggcagcctgagcagcgcccccgccacctgcagccagagcgtgatcagcagcgtggagaacggcgacaccttcagcatcaagcagagcatcgagccccccagcggcatctacggcagaagcgtgcagcagaacatcagcagctacctggacgtggagaacgagaaggacgccaaggtgagcatcagcaagagcacctacaacaagatgagacagaagagaaaggaggagaaggagctgttccacaacaaggactgcgagaagaaggagaagaacagctgggagagaatgagacacaccggcaccgagaagatggccagcgagagcgagacccccaccggcgccatcagccagtacaaggagagaatgcccagcgtgacccacagccccgagatcatggacctgagcgagctgagacccttcagcaagcccgagatcgccctgaccgaggccctgagactgctggccgacgaggactgggagaagaagatcgagggcctgaacttcatcagatgcctggccgccttccacagcgagatcctgaacaccaagctgcacgagaccaacttcgccgtggtgcaggaggtgaagaacctgagaagcggcgtgagcagagccgccgtggtgtgcctgagcgacctgttcacctacctgaagaagagcatggaccaggagctggacaccaccgtgaaggtgctgctgcacaaggccggcgagagcaacaccttcatcagagaggacgtggacaaggccctgagagccatggtgaacaacgtgacccccgccagagccgtggtgagcctgatcaacggcggccagagatactacggcagaaagatgctgttcttcatgatgtgccaccccaacttcgagaagatgctggagaagtacgtgcccagcaaggacctgccctacatcaaggacagcgtgagaaacctgcagcagaagggcctgggcgagatccccctggacacccccagcgccaagggcagaagaagccacaccggcagcgtgggcaacaccagaagcagcagcgtgagcagagacgccttcaacagcgccgagagagccgtgaccgaggtgagagaggtgaccagaaagagcgtgcccagaaacagcctggagagcgccgagtacctgaagctgatcaccggcctgctgaacgccaaggacttcagagacagaatcaacggcatcaagcagctgctgagcgacaccgagaacaaccaggacctggtggtgggcaacatcgtgaagatcttcgacgccttcaagagcagactgcacgacagcaacagcaaggtgaacctggtggccctggagaccatgcacaagatgatccccctgctgagagaccacctgagccccatcatcaacatgctgatccccgccatcgtggacaacaacctgaacagcaagaaccccggcatctacgccgccgccaccaacgtggtgcaggccctgagccagcacgtggacaactacctgctgctgcagcccttctgcaccaaggcccagttcctgaacggcaaggccaagcaggacatgaccgagaagctggccgacatcgtgaccgagctgtaccagagaaagccccacgccaccgagcagaaggtgctggtggtgctgtggcacctgctgggcaacatgaccaacagcggcagcctgcccggcgccggcggcaacatcagaaccgccaccgccaagctgagcaaggccctgttcgcccagatgggccagaacctgctgaaccaggccgccagccagcccccccacatcaagaagagcctggaggagctgctggacatgaccatcctgaacgagctgtag

SEQ ID NO: 21021 - DNA, 2988 bp, Artificial Sequence
  Description of Artificial Sequence: Synthetic coding sequence
atggccgccgcccccagcgccctgctgctgctgccccccttccccgtgctgagcacctacagactgcagagcagaagcagacccagcgcccccgagaccgacgacagcagagtgggcggcatcatgagaggcgagaagaactactacttcagaggcgccgccggcgaccacggcagctgccccaccaccaccagccccctggccagcgccctgctgatgcccagcgaggccgtgagcagcagctggagcgagagcggcggcggcctgagcggcggcgacgaggaggacaccagactgctgcagctgctgagaaccgccagagaccccagcgaggccttccaggccctgcaggccgccctgcccagaagaggcggcagactgggcttccccagaagaaaggaggccctgtacagagccctgggcagagtgctggtggagggcggcagcgacgagaagagactgtgcctgcagctgctgagcgacgtgctgagaggccagggcgaggccggccagctggaggaggccttcagcctggccctgctgccccagctggtggtgagcctgagagaggagaaccccgccctgagaaaggacgccctgcagatcctgcacatctgcctgaagagaagccccggcgaggtgctgagaaccctgatccagcagggcctggagagcaccgacgccagactgagagccagcaccgccctgctgctgcccatcctgctgaccaccgaggacctgctgctgggcctggacctgaccgaggtgatcatcagcctggccagaaagctgggcgaccaggagaccgaggaggagagcgagaccgccttcagcgccctgcagcagatcggcgagagactgggccaggacagattccagagctacatcagcagactgcccagcgccctgagaagacactacaacagaagactggagagccagttcggcagccaggtgccctactacctggagctggaggccagcggcttccccgaggaccccctgccctgcgccgtgaccctgagcaacagcaacctgaagttcggcatcatcccccaggagctgcacagcagactgctggaccaggaggactacaagaacagaacccaggccgtggaggagctgaagcaggtgctgggcaagttcaaccccagcagcaccccccacagcagcctggtgggcttcatcagcctgctgtacaacctgctggacgacagcaacttcaaggtggtgcacggcaccctggaggtgctgcacctgctggtgatcagactgggcgagcaggtgcagcagttcctgggccccgtgatcgccgccagcgtgaaggtgctggccgacaacaagctggtgatcaagcaggagtacatgaagatcttcctgaagctgatgaaggaggtgggcccccagcaggtgctgtgcctgctgctggagcacctgaagcacaagcacagcagagtgagagaggaggtggtgaacatctgcatctgcagcctgctgacctaccccagcgaggacttcgacctgcccaagctgagcttcgacctggcccccgccctggtggacagcaagagaagagtgagacaggccgccctggaggccttcgccgtgctggccagcagcatgggcagcggcaagaccagcatcctgttcaaggccgtggacaccgtggagctgcaggacaacggcgacggcgtgatgaacgccgtgcaggccagactggccagaaagaccctgcccagactgaccgagcagggcttcgtggagtacgccgtgctgatgcccagcagcgccggcggcagaagcaaccacctggcccacggcgccgacaccgactggctgctggccggcaacagaacccagagcgcccactgccactgcggcgaccacgtgagagacagcatgcacatctacggcagctacagccccaccatctgcaccagaagagtgctgagcgccggcaagggcaagaacaagctgccctgggagaacgagcagcccggcatcatgggcgagaaccagaccagcaccagcaaggacatcgagcagttcagcacctacgacttcatccccagcgccaagctgaagctgagccagggcatgcccgtgaacgacgacctgtgcttcagcagaaagagagtgagcagaaacctgttccagaacagcagagacttcaaccccgactgcctgcccctgtgcgccgccggcaccaccggcacccaccagaccaacctgagcggcaagtgcgcccagctgggcttcagccagatctgcggcaagaccggcagcgtgggcagcgacctgcagttcctgggcaccaccagcagccaccaggagaaggtgtacgccagcctgaacttcggcagcaagacccagcagaccttcggcagccagaccgagtgcaccagcagcaacggccagaaccccagccccggcgcctacatcctgcccagctaccccgtgagcagccccagaaccagccccaagcacaccagccccctgatcatcagccccaagaagagccaggacaacagcgtgaacttcagcaacagctggcccctgaagagcttcgagggcctgagcaagcccagcccccagaagaagctggtgagccagaagagcagcgaccccaccggcagaaaccacggcgagaacagccaggagaagccccccgtgcagctgacccccgccctggtgagaagccccagcagcagaagaggcctgaacggcaccaagcccgtgccccccatccccagaggcatcagcctgctgcccgacaaggccgacctgagcaccgtgggccacaagaagaaggagcccgacgacatctggaagtgcgagaaggacagcctgcccatcgacctgagcgagctgaacttcaaggacaaggacctggaccaggaggaggtgagacacatcagcaacatctgggtgaagaccctgagcaacaagaccttcttctgcaaggagaagaacttcagctactgctag

SEQ ID NO: 21022 - DNA, 3483 bp, Artificial Sequence
  Description of Artificial Sequence: Synthetic coding sequence
atggccgccgcccccagcgccctgctgctgctgccccccttccccgtgctgagcacctacagactgcagagcagaagcagacccagcgcccccgagaccgacgacagcagagtgggcggcatcatgagaggcgagaagaactactacttcagaggcgccgccggcgaccacggcagctgccccaccaccaccagccccctggccagcgccctgctgatgcccagcgaggccgtgagcagcagctggagcgagagcggcggcggcctgagcggcggcgacgaggaggacaccagactgctgcagctgctgagaaccgccagagaccccagcgaggccttccaggccctgcaggccgccctgcccagaagaggcggcagactgggcttccccagaagaaaggaggccctgtacagagccctgggcagagtgctggtggagggcggcagcgacgagaagagactgtgcctgcagctgctgagcgacgtgctgagaggccagggcgaggccggccagctggaggaggccttcagcctggccctgctgccccagctggtggtgagcctgagagaggagaaccccgccctgagaaaggacgccctgcagatcctgcacatctgcctgaagagaagccccggcgaggtgctgagaaccctgatccagcagggcctggagagcaccgacgccagactgagagccagcaccgccctgctgctgcccatcctgctgaccaccgaggacctgctgctgggcctggacctgaccgaggtgatcatcagcctggccagaaagctgggcgaccaggagaccgaggaggagagcgagaccgccttcagcgccctgcagcagatcggcgagagactgggccaggacagattccagagctacatcagcagactgcccagcgccctgagaagacactacaacagaagactggagagccagttcggcagccaggtgccctactacctggagctggaggccagcggcttccccgaggaccccctgccctgcgccgtgaccctgagcaacagcaacctgaagttcggcatcatcccccaggagctgcacagcagactgctggaccaggaggactacaagaacagaacccaggccgtggaggagctgaagcaggtgctgggcaagttcaaccccagcagcaccccccacagcagcctggtgggcttcatcagcctgctgtacaacctgctggacgacagcaacttcaaggtggtgcacggcaccctggaggtgctgcacctgctggtgatcagactgggcgagcaggtgcagcagttcctgggccccgtgatcgccgccagcgtgaaggtgctggccgacaacaagctggtgatcaagcaggagtacatgaagatcttcctgaagctgatgaaggaggtgggcccccagcaggtgctgtgcctgctgctggagcacctgaagcacaagcacagcagagtgagagaggaggtggtgaacatctgcatctgcagcctgctgacctaccccagcgaggacttcgacctgcccaagctgagcttcgacctggcccccgccctggtggacagcaagagaagagtgagacaggccgccctggaggccttcgccgtgctggccagcagcatgggcagcggcaagaccagcatcctgttcaaggccgtggacaccgtggagctgcaggacaacggcgacggcgtgatgaacgccgtgcaggccagactggccagaaagaccctgcccagactgaccgagcagggcttcgtggagtacgccgtgctgatgcccagcagcgccggcggcagaagcaaccacctggcccacggcgccgacaccgactggctgctggccggcaacagaacccagagcgcccactgccactgcggcgaccacgtgagagacagcatgcacatctacggcagctacagccccaccatctgcaccagaagagtgctgagcgccggcaagggcaagaacaagctgccctgggagaacgagcagcccggcatcatgggcgagaaccagaccagcaccagcaaggacatcgagcagttcagcacctacgacttcatccccagcgccaagctgaagctgagccagggcatgcccgtgaacgacgacctgtgcttcagcagaaagagagtgagcagaaacctgttccagaacagcagagacttcaaccccgactgcctgcccctgtgcgccgccggcaccaccggcacccaccagaccaacctgagcggcaagtgcgcccagctgggcttcagccagatctgcggcaagaccggcagcgtgggcagcgacctgcagttcctgggcaccaccagcagccaccaggagaaggtgtacgccagcctgaacttcggcagcaagacccagcagaccttcggcagccagaccgagtgcaccagcagcaacggccagaaccccagccccggcgcctacatcctgcccagctaccccgtgagcagccccagaaccagccccaagcacaccagccccctgatcatcagccccaagaagagccaggacaacagcgtgaacttcagcaacagctggcccctgaagagcttcgagggcctgagcaagcccagcccccagaagaagctggtgagccagaagagcagcgaccccaccggcagaaaccacggcgagaacagccaggagaagccccccgtgcagctgacccccgccctggtgagaagccccagcagcagaagaggcctgaacggcaccaagcccgtgccccccatccccagaggcatcagcctgctgcccgacaaggccgacctgagcaccgtgggccacaagaagaaggagcccgacgacatctggaagtgcgagaaggacagcctgcccatcgacctgagcgagctgaacttcaaggacaaggacctggaccaggaggagatgcacagcagcctgagaagcctgagaaacagcgccgccaagaagagagccaagctgagcggcagcaccagcgacctggagagccccgacagcgccatgaagctggacctgaccatggacagccccagcctgagcagcagccccaacatcaacagctacagcgagagcggcgtgtacagccaggagagcctgaccagcagcctgagcaccaccccccagggcaagagaatcatgagcgacatcttccccaccttcggcagcaagccctgccccaccagactgagcagcgccaagaagaagatcagccacatcgccgagcagagccccagcgccggcagcagcagcaacccccagcagatcagcagcttcgacttcaccaccaccaaggccctgagcgaggacagcgtggtggtggtgggcaagggcgtgttcggcagcctgagcagcgcccccgccacctgcagccagagcgtgatcagcagcgtggagaacggcgacaccttcagcatcaagcagagcatcgagccccccagcggcatctacggcagaagcgtgcagcagaacttcatcatcagctag

SEQ ID NO: 21023 - DNA, 1032 bp, Artificial Sequence
  Description of Artificial Sequence: Synthetic coding sequence
atgaagctgctgcagatgctgctgagaggcaacccctgctgcccccagcccgagatcagcccccagggcagcagcgtgcccttcctgggcgccgccggccaccagcagagcctgcccagcagctggaaggccagctgcagcggccccctggtgatggccagcgacagcgacgtgaagatgctgctgaacttcgtgaacctggccagcagcgacatcaaggccgccctggacaagagcgccccctgcagaagaagcgtggaccacagaaagtacctgcagaagcagctgaagagattcagccagaagtacagcagactgcccagaggcctgcccggcagagccgccgagccctacctgaagagaggcagcgaggacagacccagaagactgctgctggacctgggccccgacagcagccccggcggcggcggcggctgcaaggagaaggtgctgagaaacccctacagagaggagtgcctggccaaggagcagctgccccagagacagcaccccgaggccgcccagcccggccaggtgcccatgagaaagagacagctgcccgccagcttctgggaggagcccagacccacccacagctaccacgtgggcctggagggcggcctgggccccagagagggccccccctacgagggcaagaagaactgcaagggcctggagcccctgggccccgagaccaccctggtgagcatgagccccagagccctggccgagaaggagcccctgaagatgcccggcgtgagcctggtgggcagagtgaacgcctggagctgctgccccttccagtaccacggccagcccatctaccccggccccctgggcgccctgccccagagccccgtgcccagcctgggcctgtggagaaagagccccgccttccccggcgagctggcccacctgtgcaaggacgtggacggcctgggccagaaggtgtgcagacccgtggtgctgaagcccatccccaccaagcccgccgtgcccccccccatcttcaacgtgttcggctacctgtag

SEQ ID NO: 21024 - DNA, 1065 bp, Artificial Sequence
  Description of Artificial Sequence: Synthetic coding sequence
atgcccctggaggagagaagaagcagcggcgagagaaacgacgccgcccccaccaaccacagaagacccggcgagaagagagccagcaccgccaagcaggtgagcagcgtgcccttcctgggcgccgccggccaccagcagagcctgcccagcagctggaaggccagctgcagcggccccctggtgatggccagcgacagcgacgtgaagatgctgctgaacttcgtgaacctggccagcagcgacatcaaggccgccctggacaagagcgccccctgcagaagaagcgtggaccacagaaagtacctgcagaagcagctgaagagattcagccagaagtacagcagactgcccagaggcctgcccggcagagccgccgagccctacctgaagagaggcagcgaggacagacccagaagactgctgctggacctgggccccgacagcagccccggcggcggcggcggctgcaaggagaaggtgctgagaaacccctacagagaggagtgcctggccaaggagcagctgccccagagacagcaccccgaggccgcccagcccggccaggtgcccatgagaaagagacagctgcccgccagcttctgggaggagcccagacccacccacagctaccacgtgggcctggagggcggcctgggccccagagagggccccccctacgagggcaagaagaactgcaagggcctggagcccctgggccccgagaccaccctggtgagcatgagccccagagccctggccgagaaggagcccctgaagatgcccggcgtgagcctggtgggcagagtgaacgcctggagctgctgccccttccagtaccacggccagcccatctaccccggccccctgggcgccctgccccagagccccgtgcccagcctgggcctgtggagaaagagccccgccttccccggcgagctggcccacctgtgcaaggacgtggacggcctgggccagaaggtgtgcagacccgtggtgctgaagcccatccccaccaagcccgccgtgcccccccccatcttcaacgtgttcggctacctgtag

SEQ ID NO: 21025 - DNA, 699 bp, Artificial Sequence
  Description of Artificial Sequence: Synthetic coding sequence
atggccagcgacagcgacgtgaagatgctgctgaacttcgtgaacctggccagcagcgacatcaaggccgccctggacaagagcgccccctgcagaagaagcgtggaccacagaaagtacctgcagaagcagctgaagagattcagccagaagtacagcagactgcccagaggcctgcccggcagagccgccgagccctacctgaagagaggcagcgaggacagacccagaagactgctgctggacctgggccccgacagcagccccggcggcggcggcggctgcaaggagaaggtgctgagaaacccctacagagaggagtgcctggccaaggagcagctgccccagagacagcaccccgaggccgcccagcccggccaggtgcccatgagaaagagacagctgcccgccagcttctgggaggagcccagacccacccacagctaccacgtgggcctggagggcggcctgggccccagagagggccccccctacgagggcaagaagaactgcaagggcctggagcccctgggccccgagaccaccctggtgagcatgagccccagagccctggccgagaaggagcccctgaagatgcccggcgtgagcctggtgggcagagtgaacgcctggagctgctgccccttccagtaccacggccagcccatctaccccggccccctgggcgccctgccctag

SEQ ID NO: 21026 - DNA, 879 bp, Artificial Sequence
  Description of Artificial Sequence: Synthetic coding sequence
atggccagcgacagcgacgtgaagatgctgctgaacttcgtgaacctggccagcagcgacatcaaggccgccctggacaagagcgccccctgcagaagaagcgtggaccacagaaagtacctgcagaagcagctgaagagattcagccagaagtacagcagactgcccagaggcctgcccggcagagccgccgagccctacctgaagagaggcagcgaggacagacccagaagactgctgctggacctgggccccgacagcagccccggcggcggcggcggctgcaaggagaaggtgctgagaaacccctacagagaggagtgcctggccaaggagcagctgccccagagacagcaccccgaggccgcccagcccggccaggtgcccatgagaaagagacagctgcccgccagcttctgggaggagcccagacccacccacagctaccacgtgggcctggagggcggcctgggccccagagagggccccccctacgagggcaagaagaactgcaagggcctggagcccctgggccccgagaccaccctggtgagcatgagccccagagccctggccgagaaggagcccctgaagatgcccggcgtgagcctggtgggcagagtgaacgcctggagctgctgccccttccagtaccacggccagcccatctaccccggccccctgggcgccctgccccagagccccgtgcccagcctgggcctgtggagaaagagccccgccttccccggcgagctggcccacctgtgcaaggacgtggacggcctgggccagaaggtgtgcagacccgtggtgctgaagcccatccccaccaagcccgccgtgcccccccccatcttcaacgtgttcggctacctgtag

SEQ ID NO: 21027 - DNA, 879 bp, Artificial Sequence; identical to SEQ ID NO: 21026
  Description of Artificial Sequence: Synthetic coding sequence

SEQ ID NO: 21028 - DNA, 1281 bp, Artificial Sequence
  Description of Artificial Sequence: Synthetic coding sequence
atggccgtgcaggccgccctgctgagcacccaccccttcgtgcccttcggcttcggcggcagccccgacggcctgggcggcgccttcggcgccctggacaagggctgctgcttcgaggacgacgagaccggcgcccccgccggcgccctgctgagcggcgccgagggcggcgacgtgagagaggccaccagagacctgctgagcttcatcgacagcgccagcagcaacatcaagctggccctggacaagcccggcaagagcaagagaaaggtgaaccacagaaagtacctgcagaagcagatcaagagatgcagcggcctgatgggcgccgccccccccggcccccccagccccagcgccgccgacacccccgccaagagacccctggccgcccccagcgcccccaccgtggccgcccccgcccacggcaaggccgcccccagaagagaggccagccaggccgccgccgccgccagcctgcagagcagaagcctggccgccctgttcgacagcctgagacacgtgcccggcggcgccgagcccgccggcggcgaggtggccgcccccgccgccggcctgggcggcgccggcaccggcggcgccggcggcgacgtggccggccccgccggcgccaccgccatccccggcgccagaaaggtgcccctgagagccagaaacctgccccccagcttcttcaccgagcccagcagagccggcggcggcggctgcggccccagcggccccgacgtgagcctgggcgacctggagaagggcgccgaggccgtggagttcttcgagctgctgggccccgactacggcgccggcaccgaggccgccgtgctgctggccgccgagcccctggacgtgttccccgccggcgccagcgtgctgagaggcccccccgagctggagcccggcctgttcgagcccccccccgccgtggtgggcaacctgctgtaccccgagccctggagcgtgcccggctgcagccccaccaagaagagccccctgaccgcccccagaggcggcctgaccctgaacgagcccctgagccccctgtaccccgccgccgccgacagccccggcggcgaggacggcagaggccacctggccagcttcgcccccttcttccccgactgcgccctgcccccccccccccccccccaccaggtgagctacgactacagcgccggctacagcagaaccgcctacagcagcctgtggagaagcgacggcgtgtgggagggcgcccccggcgaggagggcgcccacagagactag

SEQ ID NO: 21029 - DNA, 465 bp, Artificial Sequence
  Description of Artificial Sequence: Synthetic coding sequence
atgcagggcatcgacagatggatccccagcatcccccccctgcagaaccacagcgccgtgaacagaagacacttcagcgccccccagaagctgcacgccgactgcgagaaggagatgctggacggcggcgtgcccggcaccaccgtgagagtgagcttcgacttcagctgcctggagatggtgagagagctgtggatgtggaacgtggaggaggaggagcacgaggtgggcatcagcacctggggcggccagcactgcggctgccccgccaagagcctgcccggcccccaccccggcggcgtgagcgccccccagagcgccagccagctgatggtgaagctgctggtgtggcagaagagcgtgcacaagctgagaaagatcgccgcccagagcgaggagtggagctgcgtgctgaacaagatcagcacccaccccttcgtgagcaaggagcacgacggcacctag

SEQ ID NO: 21030 - DNA, 234 bp, Artificial Sequence
  Description of Artificial Sequence: Synthetic coding sequence
atggtgagagagctgtggatgtggaacgtggaggaggaggagcacgaggtgggcatcagcacctggggcggccagcactgcggctgccccgccaagagcctgcccggcccccaccccggcggcgtgagcgccccccagagcgccagccagctgatggtgaagctgctggtgtggcagaagagcgtgcacaagctgagaaagaacagaaacgcctacagctgcggccccctgtag

SEQ ID NO: 21031 - DNA, 234 bp, Artificial Sequence
  Description of Artificial Sequence: Synthetic coding sequence
atggtgagagagctgtggatgtggaacgtggaggaggaggagcacgaggtgggcatctgcacctggggcggccagcactgcggctgccccgccaagagcctgcccggcccccaccccggcggcgtgagcgccccccagagcgccagccagctgatggtgaagctgctggtgtggcagaagagcgtgcacaagctgagaaagaacagaaacgcctacagctgcggccccctgtag

SEQ ID NO: 21032 - DNA, 405 bp, Artificial Sequence
  Description of Artificial Sequence: Synthetic coding sequence
atggccggccaccccaaggagaaggtgatccccgacgaggtgcaccagaaccagatcctgagagagctgtacctgaaggagctgagaacccagaagctgtacacccagtaccacgtgaaccccctgagaaagatccacaccgtgaccagaaagcccatgagctggcacgacaacctggaggagcccgccgacgccagattcctgaacctgatccaccacgccgcccagggccccagaaagaagtaccccgagacccagaccgagaaccaggaggtgggctgggacctggagcccctgatcaaccccgagagacacgacagaagactgaaccacttcagagtgtgcagcgacatcaccctgtacaaggccaagacctggggcctgggcgacgaccaccacaagtag

SEQ ID NO: 21033 - DNA, 3423 bp, Artificial Sequence
  Description of Artificial Sequence: Synthetic coding sequence
atggccacccccggcatgagctggcagcagcactactacggcggcagcgccgccaagttcgcccccagccccgccaccgcccagctggccggccacagcatggactacagccaggagatgcacctgaagatgagcaagaagatcgcccagctgaccaaggtgatctacgccctgaacaccaagaacgacgagcacgagagcgccatccaggccctgaaggacgcccacgaggaggagatccagcagatcctggccgagaccagagagaagatcctgcagtacaagagcaaggtgaccgaggagctggacctgagaagaaagatccaggtgctggagagcagcctggaggaccacatcaagatgaagcagcaggccctgaccgagttcgaggcctacaagcacagagtggaggacatgcagctgtgcgccgaggcccagcacgtgcagagaatcgtgaccatgagcagagaggtggaggagatcagaagaaagttcgaggagaagctgagaagcttcggccagctgcaggtgcagttcgagaaggacaagagactggccctggaggacctgcaggccgcccacagaagagagatccaggagctgctgaagagccagcaggaccacagcgccagcgtgaacaagggccaggagaaggccgaggagctgcacagaatggaggtggagagcctgaacaagatgctggaggagctgagactggagagaaagaagctgatcgaggactacgagggcaagctgaacaaggcccagagcttctacgagagagagctggacaccctgaagagaagccagctgttcaccgccgagagcctgcaggccagcaaggagaaggaggccgacctgagaaaggagttccagggccaggaggccatcctgagaaagaccatcggcaagctgaagaccgagctgcagatggtgcaggacgaggccggcagcctgctggacaagtgccagaagctgcagaccgccctggccatcgccgagaacaacgtgcaggtgctgcagaagcagctggacgacgccaaggagggcgagatggccctgctgagcaagcacaaggaggtggagagcgagctggccgccgccagagagagactgcagcagcaggccagcgacctggtgctgaaggccagccacatcggcatgctgcaggccacccagatgacccaggaggtgaccatcaaggacctggagagcgagaagagcagagtgaacgagagactgagccagctggaggaggagagagccttcctgagaagcaagacccagagcctggacgaggagcagaagcagcagatcctggagctggagaagaaggtgaacgaggccaagagaacccagcaggagtactacgagagagagctgaagaacctgcagagcagactggaggaggaggtgacccagctgaacgaggcccacagcaagaccctggaggagctggcctggaagcaccacatggccatcgaggccgtgcacagcaacgccatcagagacaagaagaagctgcagatggacctggaggagcagcacaacaaggacaagctgaacctggaggaggacaagaaccagctgcagcaggagctggagaacctgaaggaggtgctggaggacaagctgaacaccgccaaccaggagatcggccacctgcaggacatggtgagaaagagcgagcagggcctgggcagcgccgagggcctgatcgccagcctgcaggacagccaggagagactgcagaacgagctggacctgaccaaggacagcctgaaggagaccaaggacgccctgctgaacgtggagggcgagctggagcaggagagacagcagcacgaggagaccatcgccgccatgaaggaggaggagaagctgaaggtggacaagatggcccacgacctggagatcaagtggaccgagaacctgagacaggagtgcagcaagctgagagaggagctgagactgcagcacgaggaggacaagaagagcgccatgagccagctgctgcagctgaaggacagagagaagaacgccgccagagacagctggcagaagaaggtggaggacctgctgaaccagatcagcctgctgaagcagaacctggagatccagctgagccagagccagaccagcctgcagcagctgcaggcccagttcacccaggagagacagagactgacccaggagctggaggagctggaggagcagcaccagcagagacacaagagcctgaaggaggcccacgtgctggccttccagaccatggaggaggagaaggagaaggagcagagagccctggagaaccacctgcagcagaagcacagcgccgagctgcagagcctgaaggacgcccacagagagagcatggagggcttcagaatcgagatggagcaggagctgcagaccctgagattcgagctggaggacgagggcaaggccatgctggccagcctgagaagcgagctgaaccaccagcacgccgccgccatcgacctgctgagacacaaccaccaccaggagctggccgccgccaagatggagctggagagaagcatcgacatcagcagaagacagagcaaggagcacatctgcagaatcaccgacctgcaggaggagctgagacacagagagcaccacatcagcgagctggacaaggaggtgcagcacctgcacgagaacatcagcgccctgaccaaggagctggagttcaagggcaaggagatcctgagaatcagaagcgagagcaaccagcagatcagactgcacgagcaggacctgaacaagagactggagaaggagctggacgtgatgaccgccgaccacctgagagagaagaacatcatgagagccgacttcaacaagaccaacgagctgctgaaggagatcaacgccgccctgcaggtgagcctggaggagatggaggagaagtacctgatgagagagagcaagcccgaggacatccagatgatcaccgagctgaaggccatgctgaccgagagagaccagatcatcaagaagctgatcgaggacaacaagttctaccagctggagctggtgaacagagagaccaacttcaacaaggtgttcaacagcagccccaccgtgggcgtgatcaaccccctggccaagcagaagaagaagaacgacaagagccccaccaacagattcgtgagcgtgcccaacctgagcgccctggagagcggcggcgtgggcaacggccaccccaacagactggaccccatccccaacagccccgtgcacgacatcgagttcaacagcagcaagcccctgccccagcccgtgccccccaagggccccaagaccttcctgagccccgcccagagcgaggccagccccgtggccagccccgacccccagagacaggagtggttcgccagatacttcaccttctag

SEQ ID NO: 21034 - DNA, 2916 bp, Artificial Sequence
  Description of Artificial Sequence: Synthetic coding sequence
atgaagcagcaggccctgaccgagttcgaggcctacaagcacagagtggaggacatgcagctgtgcgccgaggcccagcacgtgcagagaatcgtgaccatgagcagagaggtggaggagatcagaagaaagttcgaggagaagctgagaagcttcggccagctgcaggtgcagttcgagaaggacaagagactggccctggaggacctgcaggccgcccacagaagagagatccaggagctgctgaagagccagcaggaccacagcgccagcgtgaacaagggccaggagaaggccgaggagctgcacagaatggaggtggagagcctgaacaagatgctggaggagctgagactggagagaaagaagctgatcgaggactacgagggcaagctgaacaaggcccagagcttctacgagagagagctggacaccctgaagagaagccagctgttcaccgccgagagcctgcaggccagcaaggagaaggaggccgacctgagaaaggagttccagggccaggaggccatcctgagaaagaccatcggcaagctgaagaccgagctgcagatggtgcaggacgaggccggcagcctgctggacaagtgccagaagctgcagaccgccctggccatcgccgagaacaacgtgcaggtgctgcagaagcagctggacgacgccaaggagggcgagatggccctgctgagcaagcacaaggaggtggagagcgagctggccgccgccagagagagactgcagcagcaggccagcgacctggtgctgaaggccagccacatcggcatgctgcaggccacccagatgacccaggaggtgaccatcaaggacctggagagcgagaagagcagagtgaacgagagactgagccagctggaggaggagagagccttcctgagaagcaagacccagagcctggacgaggagcagaagcagcagatcctggagctggagaagaaggtgaacgaggccaagagaacccagcaggagtactacgagagagagctgaagaacctgcagagcagactggaggaggaggtgacccagctgaacgaggcccacagcaagaccctggaggagctggcctggaagcaccacatggccatcgaggccgtgcacagcaacgccatcagagacaagaagaagctgcagatggacctggaggagcagcacaacaaggacaagctgaacctggaggaggacaagaaccagctgcagcaggagctggagaacctgaaggaggtgctggaggacaagctgaacaccgccaaccaggagatcggccacctgcaggacatggtgagaaagagcgagcagggcctgggcagcgccgagggcctgatcgccagcctgcaggacagccaggagagactgcagaacgagctggacctgaccaaggacagcctgaaggagaccaaggacgccctgctgaacgtggagggcgagctggagcaggagagacagcagcacgaggagaccatcgccgccatgaaggaggaggagaagctgaaggtggacaagatggcccacgacctggagatcaagtggaccgagaacctgagacaggagtgcagcaagctgagagaggagctgagactgcagcacgaggaggacaagaagagcgccatgagccagctgctgcagctgaaggacagagagaagaacgccgccagagacagctggcagaagaaggtggaggacctgctgaaccagatcagcctgctgaagcagaacctggagatccagctgagccagagccagaccagcctgcagcagctgcaggcccagttcacccaggagagacagagactgacccaggagctggaggagctggaggagcagcaccagcagagacacaagagcctgaaggaggcccacgtgctggccttccagaccatggaggaggagaaggagaaggagcagagagccctggagaaccacctgcagcagaagcacagcgccgagctgcagagcctgaaggacgcccacagagagagcatggagggcttcagaatcgagatggagcaggagctgcagaccctgagattcgagctggaggacgagggcaaggccatgctggccagcctgagaagcgagctgaaccaccagcacgccgccgccatcgacctgctgagacacaaccaccaccaggagctggccgccgccaagatggagctggagagaagcatcgacatcagcagaagacagagcaaggagcacatctgcagaatcaccgacctgcaggaggagctgagacacagagagcaccacatcagcgagctggacaaggaggtgcagcacctgcacgagaacatcagcgccctgaccaaggagctggagttcaagggcaaggagatcctgagaatcagaagcgagagcaaccagcagatcagactggaggagatggaggagaagtacctgatgagagagagcaagcccgaggacatccagatgatcaccgagctgaaggccatgctgaccgagagagaccagatcatcaagaagctgatcgaggacaacaagttctaccagctggagctggtgaacagagagaccaacttcaacaaggtgttcaacagcagccccaccgtgggcgtgatcaaccccctggccaagcagaagaagaagaacgacaagagccccaccaacagattcgtgagcgtgcccaacctgagcgccctggagagcggcggcgtgggcaacggccaccccaacagactggaccccatccccaacagccccgtgcacgacatcgagttcaacagcagcaagcccctgccccagcccgtgccccccaagggccccaagaccttcctgagccccgcccagagcgaggccagccccgtggccagccccgacccccagagacaggagtggttcgccagatacttcaccttctag

SEQ ID NO: 21035 - DNA, 3183 bp, Artificial Sequence
  Description of Artificial Sequence: Synthetic coding sequence
atggccagcgccctgaacagcaagatcaacccccccggcacctgccagggcagcaaggccgacggcggcgccggctggagaatggactgcgacccccagatgcacgtgaagatgtgcaagaagatcgcccagctgaccaaggtgatctacgccctgaacaccagacaggacgaggccgaggccagcatggaggccctgagagaggcccaccaggaggagctgcagaacgccgtggccgagaccaaggccagactgctgcaggagcagggctgcgccgaggaggaggccctgctgcagagaatccaggccctggagagcgccctggagctgcagaagagactgaccgaggaggccctggccgagagcgccagctgcagactggagaccaaggagagagagctgagagtggaggccgagcacgccgagagagtgctgaccctgagcagagagatgctggagctgaaggccgactacgagagaagactgcagcacctgaccagccacgaggccaccccccagggcagactgccccaggagagccccgagaccaagagcgagcccggccagggccccgagatgcaggaggtgctgctggaggtgcagagactgagagtggagaaccagcagctgagcaaggactacgccagaaaggccgaggagctgcaggccacctacgagagagagaacgaggccatcagacaggccatgcagcagagcgtgagccaggccctgtggcagtggcaggagaaggagagcgacctgagaaagaacttccaggtgcaggagagcgccctgcaggcccaggtgagaaagctggagggcgacctggagcacagaggcagaaagatcagcgacctgaagaagtacgcccagaagctgaaggagagaatccaggacctggacgtgcagctgaaggaggccagacaggagaacagcgagctgaagggcaccgccaagaagctgggcgagaagctggccgtggccaaggacagaatgatgctgcaggagtgcagaggcacccagcagaccgacgccatgaagaccgagctggtgagcgagaacaaggtgctgagagaggagaacgacctggaggccggcaacctgcacccccagcaggaccagagctgcctgaaggagtgcccctgcatgaagggcggcaccgacatgcagaccaagaaggaggccagcgccgagaccgagtacatgaagcagcagtacgaggaggacctgagaaagatcaagcaccagaccgaggaggagaagaagcacctgaaggaccagctggtgaagagactggaggacctggtgaagaagcacaccgtggagatcaagagcgtgagaagcagcgtggaggccgagagaaagaagctgcagagagaggtggaggcccagctggaggaggtgagaaagaagagcgagaaggagatcaagcagctggaggaggagaaggccgccctgaacgtgaagctgcagaacagcctgctggaggtgctgagactggaggagttcatccagcagaacaagaccagacccaccggcgccgaggagagcccccaggagctgggcagacagcactgcagcatcctggagacccaggacccctgcctgaagctggacgagaccagccccagaggcgaggagtaccaggacaagctggccgccgaggagggcaccagcagcgacgaggaggagagaaccaaggtgctgctgaaggagggcagcgacccccagccccccctgggcagcctgctgaaggagaagaccagcaagatccagagactggaggaggactggcagagccagaaggccaagctgcaggcccaggtgagccagatgcagcaggccctggagcagtgcaccagcaactacagagaggacctgcaggccctgaagcagctgagcgacctggagagagagaagctgcagagagagctgcaggagaccacccagcagaaccacgccatgaaggcccagctggaggccagccaccagagagccctgagaatgctggagaaggccagacaccaggagctgaaggccaccgaggagagactgaagaaggagagcagccacagcctgcagatccagcaccagacccacagactggagctgcaggccctggaggagaaggccagacaggagctgcaggaggagagagagagaatgcaggcccagcaggccctgctgctggagagcctgagacaggagctgagcgagcagcaggccgcctgcagcggccaccagaaggacctggaggccctgcaggccgagctgagagccctgggcagacagcaggccagcagccagtgccccggcgacagcaaggaccacatcatcgccaccgaggagagaggcggccccggccaggccggcagcccccccggcgccgccggccagggcagcggcgagggctgcggcctgtgggaggagaacgcccagctgcaggacgccgtgagaagactgagagccgaggtggagcagcaccagcaggaggcccagaagctgagagaccagagaagattcctggaggagacccagcaggcccagagagccagagaggtggagaccctgagacaggagcacagaaaggagatgcaggccatggtggccgacttcagcagcgcccaggcccagctgcaggccagactggccgccctggaggccgagctgaaggacagcggcgagaagcccggcaagggcgccagcagacccgaggacctgcagctgatcggcagactgcagaccagactgaaggagagagaggacatcatcaagcagctgaccgaggagagaagattccactacgccgccttccccagcgccatgagccacagaaacagaagcttcagcttcaacccccaccccggctacctgacccccagcatgaagaagaagaaggtggaggacgtgcccagcagagtggtgagcgtgcccaacctggccagctacgccaagaacttcctgagcggcgacctgagcagcagaatcaacgccccccccatcaccaccagccccagcctggaccccagccccagctgcggcagaacctacaagcccaaccagagcaccgacgccaagaccgccaccagaacccccgacggcgagaccgcccaggccaaggaggtgcagcagaagcagggcagcccccaccaggagtggttcaccaagtacttcagcttctag

SEQ ID NO: 21036 - DNA, 828 bp, Artificial Sequence
  Description of Artificial Sequence: Synthetic coding sequence
atgctggccccctgcagcggctgggagctgggctgcttcagactgtgcctgagacaggtgagactgtgggccggcgccggcagatgggcctgctgggcctgccaggccagaccctacagcagcggcggcagcgagagatggcccggcagcgagaccgaggtgcccccccccggccccggcagaagaaccctgaaggagtggaccctgcagggccagaagctgcacgtgcagaccaagggcggcaaggtgatctgcctgggcaccgtgtacggcaacatcgacatccacgccagcgacaagagcgccgtgaccatcgacaagctgcagggcagcagcgtgaccgtgagcaccgaggacggcctgctgaaggccaagtacctgtacaccgagagcagcttcctgagcagcgccgccggcgacatcaccctgggcagcgtgcacggcaacatcaccctgcagagcaagatgggcaacatcaccgtggacagcagcagcggctgcctgaaggccagcaccaaccagggcgccatcgacgtgtacgtgagccagctgggcaaggtggagctgaagagccacaagggcagcatcatcgtgaaggtgcccagcagcctgcaggcccacctgcagctgagcggcaaggaggtggacgtgaacagcgaggtgcacgtgcaggagatggccgaggtgagaaaggacgacgtggtgaccgtgaccggcctgatgaaccaggccagcaagagagagaagtggatcaaggccgacgcccccaagggcaccgtgagcttcagaagacagagctggttccagagcctgaagctgcaggactag

SEQ ID NO: 21037 - DNA, 1179 bp, Artificial Sequence
  Description of Artificial Sequence: Synthetic coding sequence
atgctggccccctgcagcggctgggagctgggctgcttcagactgtgcctgagacaggtgagactgtgggccggcgccggcagatgggcctgctgggcctgccaggccagaccctacagcagcggcggcagcgagagatggcccggcagcgagaccgaggtgcccccccccggccccggcagaagaaccctgaaggagtggaccctgcaggtgagccccttcggcagactgagagccagactgccctgccacctggccgtgagacccctggaccccctgacctaccccgacggcgacagagtgctggtggccgtgtgcggcgtggagggcggcgtgagaggcctggacggcctgcaggtgaagtacgacgaggacctggaggagatggccatcgtgagcgacaccatccacccccaggccagcgtggaggtgaacgcccccctgaagttcggcctggacatcaagagcagcggcagcggctgcgtgaaggtgcagagcatcgagggcgacaactgcaagatcgagaccgagcacggcaccagcatcctgcagagcgtgaagggccagaagctgcacgtgcagaccaagggcggcaaggtgatctgcctgggcaccgtgtacggcaacatcgacatccacgccagcgacaagagcgccgtgaccatcgacaagctgcagggcagcagcgtgaccgtgagcaccgaggacggcctgctgaaggccaagtacctgtacaccgagagcagcttcctgagcagcgccgccggcgacatcaccctgggcagcgtgcacggcaacatcaccctgcagagcaagatgggcaacatcaccgtggacagcagcagcggctgcctgaaggccagcaccaaccagggcgccatcgacgtgtacgtgagccagctgggcaaggtggagctgaagagccacaagggcagcatcatcgtgaaggtgcccagcagcctgcaggcccacctgcagctgagcggcaaggaggtggacgtgaacagcgaggtgcacgtgcaggagatggccgaggtgagaaaggacgacgtggtgaccgtgaccggcctgatgaaccaggccagcaagagagagaagtggatcaaggccgacgcccccaagggcaccgtgagcttcagaagacagagctggttccagagcctgaagctgcaggactag

SEQ ID NO: 21038 - DNA, 900 bp, Artificial Sequence
  Description of Artificial Sequence: Synthetic coding sequence
atgttcagaacccccagccaggccaacagactggccctggtgagcgccaaccccgacctgagactgctgttcgacctgagaagacacagcggccaggtggactggccctggcaggtgaccctgcccgtggccgagggcgtggacaccgccggcctggacatcaagagcagcggcagcggctgcgtgaaggtgcagagcatcgagggcgacaactgcaagatcgagaccgagcacggcaccagcatcctgcagagcgtgaagggccagaagctgcacgtgcagaccaagggcggcaaggtgatctgcctgggcaccgtgtacggcaacatcgacatccacgccagcgacaagagcgccgtgaccatcgacaagctgcagggcagcagcgtgaccgtgagcaccgaggacggcctgctgaaggccaagtacctgtacaccgagagcagcttcctgagcagcgccgccggcgacatcaccctgggcagcgtgcacggcaacatcaccctgcagagcaagatgggcaacatcaccgtggacagcagcagcggctgcctgaaggccagcaccaaccagggcgccatcgacgtgtacgtgagccagctgggcaaggtggagctgaagagccacaagggcagcatcatcgtgaaggtgcccagcagcctgcaggcccacctgcagctgagcggcaaggaggtggacgtgaacagcgaggtgcacgtgcaggagatggccgaggtgagaaaggacgacgtggtgaccgtgaccggcctgatgaaccaggccagcaagagagagaagtggatcaaggccgacgcccccaagggcaccgagtggagcagaagccacatcctgctgagccaggccagcagatgcctggccgccagcaccttcagcccctag

SEQ ID NO: 21039 - DNA, 7056 bp, Artificial Sequence
  Description of Artificial Sequence: Synthetic coding sequence
atgttcttcaagatgaagaacgagatcgacaacgaccccgagagcgagaagtgcatcaaggacagcaccatcatgagaagagagccccagaacatcctgagccccctgatgctgcccaacctggagatccccttcagcgtgaaggacatcatcagcagaatcgagagagcccagctgcacagagccagagaggacatcgacatgcagctgagcgagatcatgaacaacgtgcacagaatcatgaccagatacaccctggtgttcaacagcagcagcgagagaaacgtgagcctgaccgagcacaagaagaagcagagaaccaacttcctggagaagatggccacctacgccaagaccatcgagatcagagagaagaccctggccaacatcctggcctggctggaggagtggaacgacgtgctgagcgagatgaccctgatggacgtggacgagcaccaccactggatcgcccagatggagctgctgcccgacaccctgaaggccatcgagaacaacgtgaagatcctgagcagattcagcaccagcttcctggacgagaagaagaagcagaagaagaagatcctgagcagaggcaccctgtggaagagctggaaggagagagtgatcaagagacccagcaccgccagagccctgagacccgaccagatgatcagcgaccagctggccaccaacaccaaggtgagcgagatccagggcatgctgcaggagctgatcggcaccaccatgttcagcaccctggagaacaacgccatcaagtacatcagcagcaccatcgtgaacctgagcaccgccctgagcatgctgaacgacgagctgaagtgcgtgaacttccagagcagcaccgtgtacgcccacgagaccagcgaggccgagaaggagctgagcctgaagatcatcagagacctgagcaacgagaacgagatgctgcagcagaagctgcaggacgccgaggagaagtgcgagcagctgatcagaagcaagatcgtgatcgagcagctgtacgccaagctgagcaccagcagcaccctgaaggtgctgcccggccccagcccccagagcagcagagccatcatcaaggtgggcgacaccgaggacaacatggacaacatcctggacaaggagctggagaacatcgtggacgaggtgcagagaaaggagaccaaggacagcggcatcaagtgggacagcaccatcagctacaccgcccaggccgagagaacccccgacctgaccgagctgagacagcagcccgtggccagcgaggacatcagcgaggacagcaccaaggacaacgtgagcctgaagaagggcgacttctaccaggaggacgagaccgacgagtaccagagctggaagagaagccacaagaaggccacctacgtgtacgagaccagcggccccaacctgagcgacaacaagagcggccagaaggtgagcgaggccaagcccagccagtactacgagctgcaggtgctgaagaagaagagaaaggagatgaagagcttcagcgaggacaagagcaagagccccaccgaggccaagagaaagcacctgagcctgaccgagaccaagagccagggcggcaagagcggcaccagcatgatgatgctggagcagttcagaaaggtgaagagagagagccccttcgacaagagacccaccgccgccgagatcaaggtggagcccaccaccgagagcctggacaaggagggcaagggcgagatcagaagcctggtggagcccctgagcatgatccagttcgacgacaccgccgagccccagaagggcaagatcaagggcaagaagcaccacatcagcagcggcaccatcaccagcaaggaggagaagaccgaggagaaggaggagctgaccaagcaggtgaagagccaccagctggtgaagagcctgagcagagtggccaaggagaccagcgagagcaccagagtgctggagagccccgacggcaagagcgagcagagcaacctggaggagttccaggaggccatcatggccttcctgaagcagaagatcgacaacatcggcaaggccttcgacaagaagaccgtgcccaaggaggaggagctgctgaagagagccgaggccgagaagctgggcatcatcaaggccaagatggaggagtacttccagaaggtggccgagaccgtgaccaagatcctgagaaagtacaaggacaccaagaaggaggagcaggtgggcgagaagcccatcaagcagaagaaggtggtgagcttcatgcccggcctgcacttccagaagagccccatcagcgccaagagcgagagcagcaccctgctgagctacgagagcaccgaccccgtgatcaacaacctgatccagatgatcctggccgagatcgagagcgagagagacatccccaccgtgagcaccgtgcagaaggaccacaaggagaaggagaagcagagacaggagcagtacctgcaggagggccaggagcagatgagcggcatgagcctgaagcagcagctgctgggcgagagaaacctgctgaaggagcactacgagaagatcagcgagaactgggaggagaagaaggcctggctgcagatgaaggagggcaagcaggagcagcagagccagaagcagtggcaggaggaggagatgtggaaggaggagcagaagcaggccacccccaagcaggccgagcaggaggagaagcagaagcagagaggccaggaggaggaggagctgcccaagagcagcctgcagagactggaggagggcacccagaagatgaagacccagggcctgctgctggagaaggagaacggccagatgagacagatccagaaggaggccaagcacctgggcccccacagaagaagagagaagggcaaggagaagcagaagcccgagagaggcctggaggacctggagagacagatcaagaccaaggaccagatgcagatgaaggagacccagcccaaggagctggagaagatggtgatccagacccccatgaccctgagccccagatggaagagcgtgctgaaggacgtgcagagaagctacgagggcaaggagttccagagaaacctgaagaccctggagaacctgcccgacgagaaggagcccatcagcatcacccccccccccagcctgcagtacagcctgcccggcgccctgcccatcagcggccagcccctgaccaagtgcatccacctgaccccccagcaggcccaggaggtgggcatcaccctgaccccccagcaggcccaggcccagggcatcaccctgaccctgcagcaggcccaggagctgggcatccccctgaccccccagcaggcccaggccctggagatcctgttcaccccccagcaggcccaggccctgggcatccccctgaccccccagcagacccaggtgcagggcatcaccctgaccccccagcaggaccaggcccccggcatcagcctgaccacccagcaggcccagaagctgggcatccccctgaccccccagcaggcccaggccctgggcatccccctgaccccccagcaggcccaggagctgggcatccccctgaccccccagcaggcccaggccctgagagtgagcctgaccccccagcaggcccaggagctgggcatccccctgaccccccagcaggcccaggccctgggcatcaccctgaccctgcagcaggcccagcagctgggcatccccctgaccccccagcaggcccaggccctgggcatcaccctgacccccaagcaggtgcaggagctgggcatccccctgaccccccagcaggcccaggccctgggcatcaccctgacccccaagcaggcccaggagctgggcatccccctgaacccccagcaggcccagaccctgggcatccccctgacccccaagcaggcccaggccctgggcatccccttcaccccccagcaggcccaggccctgggcatccccctgaccccccagcaggcccagacccaggagatcaccctgaccccccagcaggcccaggccctgggcatgcccctgaccacccagcaggcccaggagctgggcatccccctgaccccccagcacgcccaggccctgggcatgcccctgaccacccagcaggcccaggagctgggcatccccctgaccccccagcaggcccaggccctgggcatgcccctgaccacccagcaggcccaggagctgggcatccccctgaccccccagcaggcccaggagctgggcatccccttcaccccccagcaggcccaggcccaggagatcaccctgaccccccagcaggcccaggccctgggcatgcccctgaccgcccagcaggcccaggagctgggcatcaccctgaccccccagcaggcccaggagctgggcatccccctgaccccccagcaggcccaggccctgggcatccccctgatccccccccaggcccaggagctgggcatccccctgaccccccagcaggcccaggccctgggcatcctgctgatccccccccaggcccaggagctgggcatccccctgaccccccagcaggcccaggccctgggcatccccctgatccccccccaggcccaggagctgggcatccccctgaccccccagcaggtgcaggccctgggcatccccctgatccccccccaggcccaggagctggagatccccctgaccccccagcaggcccaggccctgggcatccccctgaccccccagcaggcccaggagctgggcatccccctgaccccccagcaggcccaggagctgggcatccccctgaccccccagcaggcccaggcccagggcatccccctgaccccccagcaggcccaggccctgggcatcagcctgaccccccagcaggcccaggcccagggcatcaccctgaccccccagcaggcccaggccctgggcgtgcccatcacccccgtgaacgcctgggtgagcgccgtgaccctgaccagcgagcagacccacgccctggagagccccatgaacctggagcaggcccaggagcagctgctgaagctgggcgtgcccctgaccctggacaaggcccacaccctgggcagccccctgaccctgaagcaggtgcagtggagccacagacccttccagaagagcaaggccagcctgcccaccggccagagcatcatcagcagactgagccccagcctgagactgagcctggccagcagcgcccccaccgccgagaagagcagcatcttcggcgtgagcagcacccccctgcagatcagcagagtgcccctgaaccagggccccttcgcccccggcaagcccctggagatgggcatcctgagcgagcccggcaagctgggcgccccccagaccctgagaagcagcggccagaccctggtgtacggcggccagagcaccagcgcccagttccccgccccccaggccccccccagccccggccagctgcccatcagcagagccccccccacccccggccagcccttcatcgccggcgtgccccccaccagcggccagatccccagcctgtgggcccccctgagccccggccagcccctggtgcccgaggccagcagcatccccggcgacctgctggagagcggccccctgaccttcagcgagcagctgcaggagttccagccccccgccaccgccgagcagagcccctacctgcaggcccccagcacccccggccagcacctggccacctggaccctgcccggcagagccagcagcctgtggatcccccccaccagcagacacccccccaccctgtggcccagccccgcccccggcaagccccagaagagctggagccccagcgtggccaagaagagactggccatcatcagcagcctgaagagcaagagcgtgctgatccaccccagcgcccccgacttcaaggtggcccaggtgcccttcaccaccaagaagttccagatgagcgaggtgagcgacaccagcgaggagacccagatcctgagagacaccttcgccatcgagagcttcagaaccttccagagccacttcaccaagtacagaacccccgtgtaccagaccccctacaccgacgagagagccctgctgaccctgatgaagcccaccaccagccccagcagcctgaccaccctgctgagaaccagccagatcagccccctggagtggtaccagaagagcagattcccccccatcgacaagccctggatcctgagcagcgtgagcgacaccaagaagcccaaggtgatggtgccccccagcagcccccaggagctggaggagaagagatacttcgtggacgtggaggcccagaagaagaacctgatcctgctgaaccaggccatcaagacctgcggcctgcccagccagctgcacaccatggccagaaccctgatcatcgagatcctgcacatggacaccgtgcagctgggctacctgttcagaaagtacatcgcctacagactgatccagcacgccagaaacaacatcatgaagagactgaaggccatccagaacaccggcaagggctacgaggccagaaacctgcacatgatgctgagcagactggacgactacggcaagaaggtgatgcaggtgtggaccgagaagcagaagagcctgggccagaagagaaaccagtgcctgaagaagatgatccacgtgttcaaccagctgaagaagatccacgagctgaacctgagccagcccatccccctgatcatcgaggagaagcagatccccgccagcaccaccttcgtgcagaagcccttcctgaagctgctgatggaggaggacagaaccagcgacatctgcaagaagttcagacagcaggaggaccagaccgaggccatctggaacgtggacctgagcaccagcagctaccccatcgccgagaagaccagcatgcacagcctgtgggcccagctgggcggctaccccgacatccccagactgctgcagctggaggtgcagagcaccttcagaaagagcctggccagcctgcagagcagagtgaagaagatccccaagtag

SEQ ID NO: 21040 - DNA, 1080 bp, Artificial Sequence
  Description of Artificial Sequence: Synthetic coding sequence
atgagcgaggtgagcgacaccagcgaggagacccagatcctgagagacaccttcgccatcgagagcttcagaaccttccagagccacttcaccaagtacagaacccccgtgtaccagaccccctacaccgacgagagagccctgctgaccctgatgaagcccaccaccagccccagcagcctgaccaccctgctgagaaccagccagatcagccccctggagtggtaccagaagagcagattcccccccatcgacaagccctggatcctgagcagcgtgagcgacaccaagaagcccaaggtgatggtgccccccagcagcccccaggagctggaggagaagagatacttcgtggacgtggaggcccagaagaagaacctgatcctgctgaaccaggccatcaagacctgcggcctgcccagccagctgcacaccatggccagaaccctgatcatcgagatcctgcacatggacaccgtgcagctgggctacctgttcagaaagtacatcgcctacagactgatccagcacgccagaaacaacatcatgaagagactgaaggccatccagaacaccggcaagggctacgaggccagaaacctgcacatgatgctgagcagactggacgactacggcaagaaggtgatgcaggtgtggaccgagaagcagaagagcctgggccagaagagaaaccagtgcctgaagaagatgatccacgtgttcaaccagctgaagaagatccacgagctgaacctgagccagcccatccccctgatcatcgaggagaagcagatccccgccagcaccaccttcgtgcagaagcccttcctgaagctgctgatggaggaggacagaaccagcgacatctgcaagaagttcagacagcaggaggaccagaccgaggccatctggaacgtggacctgagcaccagcagctaccccatcgccgagaagaccagcatgcacagcctgtgggcccagctgggcggctaccccgacatccccagactgctgcagctggaggtgcagagcaccttcagaaagagcctggccagcctgcagagcagaagcagcggctag

SEQ ID NO: 21041 - DNA, 2682 bp, Artificial Sequence
  Description of Artificial Sequence: Synthetic coding sequence
atggagaaggacgaccccccccagctggtgacccccaccagcgtgaaggccatcatcctgagaatcgaggccgcccagctgaccagagcccaggaggacatcagcacccagctgagcgacatcctggacaacgtgaactgcgtgatcaacagattccaggaggagctgggctacgacctgaaggagaacgccaagagccagcagagagaccccaagggcaagaagagattcatcctgctggagaagatcgccagcttcagcaaggacgccatgatgaaggagaagcacctgtacgacatcctgagatggctgggcgactggggcgacaccctgacctacgagatcggccccagaaagagcgaggaggaggccgccgccctggacgagtggatcgaggtgaccgagaaggtgctgcccctgagcctgatcgccaccaagagaggcatcgagagcctgaccgccctgtgcagcaccctgatcgagggccagaagaagagaagccaggtgagcaagagaaccttctggcagggctggcagggcagaagcccccagaccagccccagccacccccagcccctgagccccgagcagatgctgcaggaccagcacaccatgaacaccaaggccagcgaggtgaccagcatgctgcaggagctgctggacagcaccatgttcagcaagggcgaggtgagagccatcagatacatggccaccgtggtggagaacctgaacaaggccctgatcctgcagcacaaggagaacagaagcctggagaccaagtacagacacctgcagatgcaggccaccaaggagctgagcagccagagactgcacttccagcagttcatggaggtgctggagagcagaagagacgccctgctgaagcaggtggagatcctgggcggcagataccacgacctgctgctgatgaagcaggccctggagttccagctgaagaaggcccagaacgccaccggccaggccgaggacctggccgaggtgagcgtggacagccccggccccagcgagagagagaccctgcccagaaaggagaccgtgatggaggagagccagcaggagcccatgaaggaggagcagctgttcagccccctgccccccagccccatggccatgatcagagacagcggcgccatcgccgccggccaccagcccctgagcaccatgaccgtgagaagcagagtggccgacgtgttcggcagcaaggacaccgagagcctggagcccgtgctgctgcccctggtggacagaagattccccaagaagtgggagagacccgtggccgagagcctgggccacaaggacaaggaccaggaggactacttccagaagggcggcctgcagatcaagttccactgcagcaagcagctgagcctggagagcagcagacaggtgaccagcgagagccaggaggagccctgggaggaggagttcggcagagagatgagaagacagctgtggctggaggaggaggagatgtggcagcagagacagaagaagtgggccctgctggagcaggagcaccaggagaagctgagacagtggaacctggaggacctggccagagagcagcagagaagatgggtgcagctggagaaggagcaggagagccccagaagagagcccgagcagctgggcgaggacgtggagagaagaatcttcacccccaccagcagatggagagacctggagaaggccgagctgagcctggtgcccgcccccagcagaacccagagcgcccaccagagcagaagaccccacctgcccatgagccccagcacccagcagcccgccctgggcaagcagagacccatgagcagcgtggagttcacctacagacccagaaccagaagagtgcccaccaagcccaagaagagcgccagcttccccgtgaccggcaccagcatcagaagactgacctggcccagcctgcagatcagccccgccaacatcaagaagaaggtgtaccacatggacatggaggcccagagaaagaacctgcagctgctgagcgaggagagcgagctgagactgccccactacctgagaagcaaggccctggagctgaccaccaccaccatggagctgggcgccctgagactgcagtacctgtgccacaagtacatcttctacagaagactgcagagcctgagacaggaggccatcaaccacgtgcagatcatgaaggagaccgaggccagctacaaggcccagaacctgtacatcttcctggagaacatcgacagactgcagagcctgagactgcaggcctggaccgacaagcagaagggcctggaggagaagcacagagagtgcctgagcagcatggtgaccatgttccccaagctgcagctggagtggaacgtgcacctgaacatccccgaggtgaccagccccaagcccaagaagtgcaagctgcccgccgccagccccagacacatcagacccagcggccccacctacaagcagcccttcctgagcagacacagagcctgcgtgcccctgcagatggccagacagcagggcaagcagatggaggccgtgtggaagaccgaggtggccagcagcagctacgccatcgagaagaagacccccgccagcctgcccagagaccagctgagaggccaccccgacatccccagactgctgaccctggacgtgtag

SEQ ID NO: 21042 - DNA, 1521 bp, Artificial Sequence
  Description of Artificial Sequence: Synthetic coding sequence
ggccaccagcccctgagcaccatgaccgtgagaagcagagtggccgacgtgttcggcagcaaggacaccgagagcctggagcccgtgctgctgcccctggtggacagaagattccccaagaagtgggagagacccgtggccgagagcctgggccacaaggacaaggaccaggaggactacttccagaagggcggcctgcagatcaagttccactgcagcaagcagctgagcctggagagcagcagacaggtgaccagcgagagccaggaggagccctgggaggaggagttcggcagagagatgagaagacagctgtggctggaggaggaggagatgtggcagcagagacagaagaagtgggccctgctggagcaggagcaccaggagaagctgagacagtggaacctggaggacctggccagagagcagcagagaagatgggtgcagctggagaaggagcaggagagccccagaagagagcccgagcagctgggcgaggacgtggagagaagaatcttcacccccaccagcagatggagagacctggagaaggccgagctgagcctggtgcccgcccccagcagaacccagagcgcccaccagagcagaagaccccacctgcccatgagccccagcacccagcagcccgccctgggcaagcagagacccatgagcagcgtggagttcacctacagacccagaaccagaagagtgcccaccaagcccaagaagagcgccagcttccccgtgaccggcaccagcatcagaagactgacctggcccagcctgcagatcagccccgccaacatcaagaagaaggtgtaccacatggacatggaggcccagagaaagaacctgcagctgctgagcgaggagagcgagctgagactgccccactacctgagaagcaaggccctggagctgaccaccaccaccatggagctgggcgccctgagactgcagtacctgtgccacaagtacatcttctacagaagactgcagagcctgagacaggaggccatcaaccacgtgcagatcatgaaggagaccgaggccagctacaaggcccagaacctgtacatcttcctggagaacatcgacagactgcagagcctgagactgcaggcctggaccgacaagcagaagggcctggaggagaagcacagagagtgcctgagcagcatggtgaccatgttccccaagctgcagctggagtggaacgtgcacctgaacatccccgaggtgaccagccccaagcccaagaagtgcaagctgcccgccgccagccccagacacatcagacccagcggccccacctacaagcagcccttcctgagcagacacagagcctgcgtgcccctgcagatggccagacagcagggcaagcagatggaggccgtgtggaagaccgaggtggccagcagcagctacgccatcgagaagaagacccccgccagcctgcccagagaccagctgagaggccaccccgacatccccagactgctgaccctggacgtgtag

SEQ ID NO: 21043 - DNA, 2346 bp, Artificial Sequence
  Description of Artificial Sequence: Synthetic coding sequence
atgatgaaggagaagcacctgtacgacatcctgagatggctgggcgactggggcgacaccctgacctacgagatcggccccagaaagagcgaggaggaggccgccgccctggacgagtggatcgaggtgaccgagaaggtgctgcccctgagcctgatcgccaccaagagaggcatcgagagcctgaccgccctgtgcagcaccctgatcgagggccagaagaagagaagccaggtgagcaagagaaccttctggcagggctggcagggcagaagcccccagaccagccccagccacccccagcccctgagccccgagcagatgctgcaggaccagcacaccatgaacaccaaggccagcgaggtgaccagcatgctgcaggagctgctggacagcaccatgttcagcaagggcgaggtgagagccatcagatacatggccaccgtggtggagaacctgaacaaggccctgatcctgcagcacaaggagaacagaagcctggagaccaagtacagacacctgcagatgcaggccaccaaggagctgagcagccagagactgcacttccagcagttcatggaggtgctggagagcagaagagacgccctgctgaagcaggtggagatcctgggcggcagataccacgacctgctgctgatgaagcaggccctggagttccagctgaagaaggcccagaacgccaccggccaggccgaggacctggccgaggtgagcgtggacagccccggccccagcgagagagagaccctgcccagaaaggagaccgtgatggaggagagccagcaggagcccatgaaggaggagcagctgttcagccccctgccccccagccccatggccatgatcagagacagcggcgccatcgccgccggccaccagcccctgagcaccatgaccgtgagaagcagagtggccgacgtgttcggcagcaaggacaccgagagcctggagcccgtgctgctgcccctggtggacagaagattccccaagaagtgggagagacccgtggccgagagcctgggccacaaggacaaggaccaggaggactacttccagaagggcggcctgcagatcaagttccactgcagcaagcagctgagcctggagagcagcagacaggtgaccagcgagagccaggaggagccctgggaggaggagttcggcagagagatgagaagacagctgtggctggaggaggaggagatgtggcagcagagacagaagaagtgggccctgctggagcaggagcaccaggagaagctgagacagtggaacctggaggacctggccagagagcagcagagaagatgggtgcagctggagaaggagcaggagagccccagaagagagcccgagcagctgggcgaggacgtggagagaagaatcttcacccccaccagcagatggagagacctggagaaggccgagctgagcctggtgcccgcccccagcagaacccagagcgcccaccagagcagaagaccccacctgcccatgagccccagcacccagcagcccgccctgggcaagcagagacccatgagcagcgtggagttcacctacagacccagaaccagaagagtgcccaccaagcccaagaagagcgccagcttccccgtgaccggcaccagcatcagaagactgacctggcccagcctgcagatcagccccgccaacatcaagaagaaggtgtaccacatggacatggaggcccagagaaagaacctgcagctgctgagcgaggagagcgagctgagactgccccactacctgagaagcaaggccctggagctgaccaccaccaccatggagctgggcgccctgagactgcagtacctgtgccacaagtacatcttctacagaagactgcagagcctgagacaggaggccatcaaccacgtgcagatcatgaaggagaccgaggccagctacaaggcccagaacctgtacatcttcctggagaacatcgacagactgcagagcctgagactgcaggcctggaccgacaagcagaagggcctggaggagaagcacagagagtgcctgagcagcatggtgaccatgttccccaagctgcagctggagtggaacgtgcacctgaacatccccgaggtgaccagccccaagcccaagaagtgcaagctgcccgccgccagccccagacacatcagacccagcggccccacctacaagcagcccttcctgagcagacacagagcctgcgtgcccctgcagatggccagactgctggccctgtgcctgagaggcctggtggccgagctggccctggtgatggaggacttcgacctgctgcacgtgctgtag

SEQ ID NO: 21044 - DNA, 354 bp, Artificial Sequence
  Description of Artificial Sequence: Synthetic coding sequence
tgatgcctgagcagcatggtgaccatgttccccaagctgcagctggagtggaacgtgcacctgaacatccccgaggtgaccagccccaagcccaagaagtgcaagctgcccgccgccagccccagacacatcagacccagcggccccacctacaagcagcccttcctgagcagacacagagcctgcgtgcccctgcagatggccagacagcagggcaagcagatggaggccgtgtggaagaccgaggtggccagcagcagctacgccatcgagaagaagacccccgccagcctgcccagagaccagctgagaggccaccccgacatccccagactgctgaccctggacgtgtag

SEQ ID NO: 21045 - DNA, 1242 bp, Artificial Sequence
  Description of Artificial Sequence: Synthetic coding sequence
atgcacctggccctgaccaccgtgctgctgtgggcctggggcctgcaggccttcgagatcgtggagaaggagaacatcttccagagaaccccctgccccgccttcctgatgttcgagaacgccgcctacctggccgacatgagcttcgagctgccctgccactgcaagcccgaggaggtgcccgccgtggtgtggttctaccagaagcacctgggcagcagccacaccaaggtgctgaccgacttcgacggcagagtgctgaccgaggccgcccaggtgagagtgggcagcgacatgctgaccagattcagcatcagaatgttcagcctgctggtgttcagagcccagagcgaggacagcggcctgtacttctgcggcaccagaaagggcgactacttctacgcctacgacgtggacatccagaacagcgagggcatggtggccaccttccaggacaagggccaggagcccttcgccgacgagtactacggccacctgcacgtgttcaccaccttctgggagtggaccccctgcgacagatgcggcgtgagaggcgagcagtggagaatcggcctgtgctacctgcagagccccgacctgagccccagatacctgaaggccgtgcccgacgtggtgagctgcggcagcagagccgtgcccagaaagctgagaaccaaggccagagaccacacccccgaggtgctggtgagaagctgcctggtgccctgcgagaagaccaagaccatcagagagggcgtgctggccatcatcaactacgtgagcaaggtgggcagcagaccctgggtgccccaggtgcccatccagttccaccagcagagactgggccacggcctgatcatcagctgccccggcgccagacccgagcacgccgtggcctgggacaaggacagacagcacctgtacagaacccagtacctgaagggcgtgaacagaagcatgagagtgttcatcgaccacggcaaccagctgcacatcagattcacccagctggacgacagaggcatctactactgctggagacagggcgtgctggtggccggcttcagactgggcgtgaccagccacggccactaccccgccagcttcagcgaccccgagaccagaagcgccgtggagctgaccctgatcggctacctgctgatcaccgccgtgttcgtgaccatccacttctgcagatgctgctgctacctgttccactgctgccccagcttcagcccctag

SEQ ID NO: 21046 - DNA, 1242 bp, Artificial Sequence; identical to SEQ ID NO: 21045
  Description of Artificial Sequence: Synthetic coding sequence

SEQ ID NO: 21047 - DNA, 2274 bp, Artificial Sequence
  Description of Artificial Sequence: Synthetic coding sequence
atggacagcctgttcgtggaggaggtggccgccagcctggtgagagagttcctgagcagaaagggcctgaagaagacctgcgtgaccatggaccaggagagacccagaagcgacctgagcatcaacaacagaaacgacctgagaaaggtgctgcacctggagttcctgtacaaggagaacaaggccaaggagaaccccctgaagaccagcctggagctgatcaccagatacttcctggaccacttcggcaacaccgccaacaacttcacccaggacacccccatccccgccctgagcgtgcccaagaagaacaacaaggtgcccagcagatgcagcgagaccaccctggtgaacatctacgacctgagcgacgaggacgccggctggagaaccagcctgagcgagaccagcaaggccagacacgacaacctggacggcgacgtgctgggcaacttcgtgagcagcaagagacccccccacaagagcaagcccatgcagaccgtgcccggcgagacccccgtgctgaccagcgcctgggagaagatcgacaagctgcacagcgagcccagcctggacgtgaagagaatgggcgagaacagcagacccaagagcggcctgatcgtgagaggcatgatgagcggccccatcgccagcagcccccaggacagcttccacagacactacctgagaagaagcagccccagcagcagcagcacccagccccaggaggagagcagaaaggtgcccgagctgttcgtgtgcacccagcaggacatcctggccagcagcaacagcagccccagcagaaccagcctgggccagctgagcgagctgaccgtggagagacagaagaccaccgccagcagccccccccacctgcccagcaagagactgcccccctgggacagagccagacccagagaccccagcgaggacacccccgccgtggacggcagcaccgacaccgacagaatgcccctgaagctgtacctgcccggcggcaacagcagaatgacccaggagagactggagagagccttcaagagacagggcagccagcccgcccccgtgagaaagaaccagctgctgcccagcgacaaggtggacggcgagctgggcgccctgagactggaggacgtggaggacgagctgatcagagaggaggtgatcctgagccccgtgcccagcgtgctgaagctgcagaccgccagcaagcccatcgacctgagcgtggccaaggagatcaagaccctgctgttcggcagcagcttctgctgcttcaacgaggagtggaagctgcagagcttcagcttcagcaacaccgccagcctgaagtacggcatcgtgcagaacaagggcggcccctgcggcgtgctggccgccgtgcagggctgcgtgctgcagaagctgctgttcgagggcgacagcaaggccgactgcgcccagggcctgcagcccagcgacgcccacagaaccagatgcctggtgctggccctggccgacatcgtgtggagagccggcggcagagagagagccgtggtggccctggccagcagaacccagcagttcagccccaccggcaagtacaaggccgacggcgtgctggagaccctgaccctgcacagcctgacctgctacgaggacctggtgaccttcctgcagcagagcatccaccagttcgaggtgggcccctacggctgcatcctgctgaccctgagcgccatcctgagcagaagcaccgagctgatcagacaggacttcgacgtgcccaccagccacctgatcggcgcccacggctactgcacccaggagctggtgaacctgctgctgaccggcaaggccgtgagcaacgtgttcaacgacgtggtggagctggacagcggcgacggcaacatcaccctgctgagaggcatcgccgccagaagcgacatcggcttcctgagcctgttcgagcactacaacatgtgccaggtgggctgcttcctgaagacccccagattccccatctgggtggtgtgcagcgagagccacttcagcatcctgttcagcctgcagcccggcctgctgagagactggagaaccgagagactgttcgacctgtactactacgacggcctggccaaccagcaggagcagatcagactgaccatcgacaccacccagaccatcagcgaggacaccgacaacgacctggtgccccccctggagctgtgcatcagaaccaagtggaagggcgccagcgtgaactggaacggcagcgaccccatcctgtag

SEQ ID NO: 21048 - DNA, 1953 bp, Artificial Sequence
  Description of Artificial Sequence: Synthetic coding sequence
atgatgcccagccccagcgacagcagcagaagcctgaccagcagacccagcaccagaggcctgacccacctgagactgcacagaccctggctgcaggccctgctgaccctgggcctggtgcaggtgctgctgggcatcctggtggtgaccttcagcatggtggccagcagcgtgaccaccaccgagagcatcaagagaagctgccccagctgggccggcttcagcatcagcttcttcagcctgctgagcgtgctgtgcgtgatgctgagcatggccggcagcgtgctgagctgcaagaacgcccagctggccagagacttccagcagtgcagcctggagggcaaggtgtgcgtgtgctgccccagcgtgcccctgctgagaccctgccccgagagcggccaggagctgaaggtggcccccaacagcacctgcgacgaggccagaggcgccctgaagaacctgctgttcagcgtgtgcggcctgaccatctgcgccgccatcatctgcaccctgagcgccatcgtgtgctgcatccagatcttcagcctggacctggtgcacacccagctggcccccgagagaagcgtgagcggccccctgggccccctgggctgcaccagccccccccccgcccccctgctgcacaccatgctggacctggaggagttcgtgccccccgtgcccccccccccctactacccccccgagtacacctgcagcagcgagaccgacgcccagagcatcacctacaacggcagcatggacagccccgtgcccctgtaccccaccgactgcccccccagctacgaggccgtgatgggcctgagaggcgacagccaggccaccctgttcgacccccagctgcacgacggcagctgcatctgcgagagagtggccagcatcgtggacgtgagcatggacagcggcagcctggtgctgagcgccatcggcgacctgcccggcggcagcagccccagcgaggacagctgcctgctggagctgcagggcagcgtgagaagcgtggactacgtgctgttcagaagcatccagagaagcagagccggctactgcctgagcctggactgcggcctgagaggccccttcgaggagagccccctgcccagaagaccccccagagccgccagaagctacagctgcagcgcccccgaggcccccccccccctgggcgcccccaccgccgccagaagctgccacagactggagggctggcccccctgggtgggcccctgcttccccgagctgagaagaagagtgcccagaggcggcggcagacccgccgccgccccccccaccagagcccccaccagaagattcagcgacagcagcggcagcctgaccccccccggccacagacccccccaccccgccagccccccccccctgctgctgcccagaagccacagcgaccccggcatcaccaccagcagcgacaccgccgacttcagagacctgtacaccaaggtgctggaggaggaggccgccagcgtgagcagcgccgacaccggcctgtgcagcgaggcctgcctgttcagactggccagatgccccagccccaagctgctgagagccagaagcgccgagaagagaagacccgtgcccaccttccagaaggtgcccctgcccagcggccccgcccccgcccacagcctgggcgacctgaagggcagctggcccggcagaggcctggtgaccagattcctgcagatcagcagaaaggcccccgaccccagcggcaccggcgcccacggccacaagcaggtgcccagaagcctgtggggcagacccggcagagagagcctgcacctgagaagctgcggcgacctgagcagcagcagcagcctgagaagactgctgagcggcagaagactggagagaggcaccagaccccacagcctgagcctgaacggcggcagcagagagaccggcctgtag

SEQ ID NO: 21049 - DNA, 2703 bp, Artificial Sequence
  Description of Artificial Sequence: Synthetic coding sequence
atgggcgacagcggcagcagaagaagcaccctggtgagcagactgcccatcttcagaagaagcatcaacagaagacacgacagcctgcccagcagccccagcagcagcaacaccgtgggcgtgcacagcagcagccccagcagcaccaacagcagcagcggcagcaccggcaagagaagaagcatcttcagaacccccagcatcagcttccaccacaagaagggcagcgagcccaagcaggagcccaccaaccagaacctgagcatcagcaacggcgcccagcccggccacagcaacatgcagaagctgagcctggaggagcacatcaagaccagaggcagacacagcgtgggcttcagcagcagcagaaacaagaagatcaccagaagcctgaccgaggacttcgagagagagaaggagcacagcaccaacaagaacgtgttcatcaactgcctgagcagcggcaagagcgagggcgacgacagcggcttcaccgaggaccagaccagaagaagcgtgaagcagagcaccagaaagctgctgcccaagagcttcagcagccactacaagttcagcaagcccgtgctgcagagccagagcatcagcctggtgcagcagagcgagttcagcctggaggtgacccagtaccaggagagagagcccgtgctggtgagagccagccccagctgcagcgtggacgtgaccgagagagccggcagcagcctgcagagccccctgctgagcgccgacctgaccaccgcccagacccccagcgagttcctggccctgaccgaggacagcgtgagcgagatggacgccttcagcaagagcggcagcatggccagccactgcgacaacttcggccacaacgacagcaccagccagatgagcctgaacagcgccgccgtgaccaagaccaccaccgagctgaccggcaccgtgccctgcgccatcatgagccccggcaagtacagactggagggccagtgcagcaccgagagcaacagcctgcccgagaccagcgccgccaaccagaaggaggtgctgctgcagatcgccgagctgcccgccaccagcgtgagccacagcgagagcaacctgcccgccgacagcgagagagaggagaacatcggcctgcagaacggcgagaccatgctgggcaccaacagccccagaaagctgggcttctacgagcagcacaaggccatcgccgagcacgtgaagggcatccaccccatcagcgacagcaagatcatccccaccagcggcgaccaccacatcttcaacaagaccagccacggctacgaggccaaccccgccaaggtgctggccagcagcctgagccccttcagagagggcagattcatcgagagaagactgagaagcagcagcgagggcaccgccggcagcagcagaatgatcctgaagcccaaggacggcaacatcgaggaggtgaacagcctgagaaagcagagagccggcagcagcagcagcaagatgaacagcctggacgtgctgaacaacctgggcagctgcgagctggacgaggacgacctgatgctggacctggagttcctggaggagcagagcctgcaccccagcgtgtgcagagaggacagctaccacagcgtggtgagctgcgccgccgtggtgctgacccccatggagcccatgatcgagatgaagaagagagaggagcccgagttccccgagcccagcaagcagaacctgagcctgaagctgaccaaggacgtggaccaggaggccagatgcagccacatcagcagaatgcccaacagccccagcgccgactggcccctgcagggcgtggaggagaacggcggcatcgacagcctgcccttcagactgatgctgcaggactgcaccgccgtgaagaccctgctgctgaagatgaagagagtgctgcaggagagcgccgacatgagccccgccagcagcaccaccagcctgcccgtgagccccctgaccgaggagcccgtgcccttcaaggacatcatgaaggacgagtgcagcatgctgaagctgcagctgaaggagaaggacgagctgatcagccagctgcaggaggagctgggcaaggtgagacacctgcagaaggccttcgccagcagagtggacaagagcacccagaccgagctgctgtgctacgacggcctgaacctgaagagactggagaccgtgcagggcggcagagaggccacctacagaaacagaatcgtgagccagaacctgagcaccagagacagaaaggccatccacacccccaccgaggacagattcagatacagcgccgccgaccagaccagcccctacaagaacaagacctgccagctgcccagcctgtgcctgagcaacttcctgaaggacaaggagctggccgaggtgatcaagcacagcagaggcacctacgagaccctgaccagcgacgtgacccagaacctgagagccaccgtgggccagagcagcctgaagcccaccgccaagaccgagggcctgagcaccttcctggagaagcccaaggaccaggtggccaccgccagacagcacagcaccttcaccggcagattcggccagccccccagaggccccatcagcctgcacatgtacagcagaaagaacgtgttcctgcaccacaacctgcacagcaccgagctgcagaccctgggccagcaggacggctag

SEQ ID NO: 21050 - DNA, 2034 bp, Artificial Sequence
  Description of Artificial Sequence: Synthetic coding sequence
atgggcgacagcggcagcagaagaagcaccctggtgagcagactgcccatcttcagaagaagcatcaacagaagacacgacagcctgcccagcagccccagcagcagcaacaccgtgggcgtgcacagcagcagccccagcagcaccaacagcagcagcggcagcaccggcaagagaagaagcatcttcagaacccccagcatcagcttccaccacaagaagggcagcgagcccaagcaggagcccaccaaccagaacctgagcatcagcaacggcgcccagcccggccacagcaacatgcagaagctgagcctggaggagcacatcaagaccagaggcagacacagcgtgggcttcagcagcagcagaaacaagaagatcaccagaagcctgaccgaggacttcgagagagagaaggagcacagcaccaacaagaacgtgttcatcaactgcctgagcagcggcaagagcgagggcgacgacagcggcttcaccgaggaccagaccagaagaagcgtgaagcagagcaccagaaagctgctgcccaagagcttcagcagccactacaagttcagcaagcccgtgctgcagagccagagcatcagcctggtgcagcagagcgagttcagcctggaggtgacccagtaccaggagagagagcccgtgctggtgagagccagccccagctgcagcgtggacgtgaccgagagagccggcagcagcctgcagagccccctgctgagcgccgacctgaccaccgcccagacccccagcgagttcctggccctgaccgaggacagcgtgagcgagatggacgccttcagcaagagcggcagcatggccagccactgcgacaacttcggccacaacgacagcaccagccagatgagcctgaacagcgccgccgtgaccaagaccaccaccgagctgaccggcaccgtgccctgcgccatcatgagccccggcaagtacagactggagggccagtgcagcaccgagagcaacagcctgcccgagaccagcgccgccaaccagaaggaggtgctgctgcagatcgccgagctgcccgccaccagcgtgagccacagcgagagcaacctgcccgccgacagcgagagagaggagaacatcggcctgcagaacggcgagaccatgctgggcaccaacagccccagaaagctgggcttctacgagcagcacaaggccatcgccgagcacgtgaagggcatccaccccatcagcgacagcaagatcatccccaccagcggcgaccaccacatcttcaacaagaccagccacggctacgaggccaaccccgccaaggtgctggccagcagcctgagccccttcagagagggcagattcatcgagagaagactgagaagcagcagcgagggcaccgccggcagcagcagaatgatcctgaagcccaaggacggcaacatcgaggaggtgaacagcctgagaaagcagagagccggcagcagcagcagcaagatgaacagcctggacgtgctgaacaacctgggcagctgcgagctggacgaggacgacctgatgctggacctggagttcctggaggagcagagcctgcaccccagcgtgtgcagagaggacagctaccacagcgtggtgagctgcgccgccgtggtgctgacccccatggagcccatgatcgagatgaagaagagagaggagcccgagttccccgagcccagcaagcagaacctgagcctgaagctgaccaaggacgtggaccaggaggccagatgcagccacatcagcagaatgcccaacagccccagcgccgactggcccctgcagggcgtggaggagaacggcggcatcgacagcctgcccttcagactgatgctgcaggactgcaccgccgtgaagaccctgctgctgaagatgaagagagtgctgcaggagagcgccgacatgagccccgccagcagcaccaccagcctgcccgtgagccccctgaccgaggagcccgtgcccttcaagaccacctaccccagagagttctag

SEQ ID NO: 21051 - DNA, 2034 bp, Artificial Sequence
  Description of Artificial Sequence: Synthetic coding sequence
atgggcgacagcggcagcagaagaagcaccctggtgagcagactgcccatcttcagaagaagcatcaacagaagacacgacagcctgcccagcagccccagcagcagcaacaccgtgggcgtgcacagcagcagccccagcagcaccaacagcagcagcggcagcaccggcaagagaagaagcatcttcagaacccccagcatcagcttccaccacaagaagggcagcgagcccaagcaggagcccaccaaccagaacctgagcatcagcaacggcgcccagcccggccacagcaacatgcagaagctgagcctggaggagcacatcaagaccagaggcagacacagcgtgggcttcagcagcagcagaaacaagaagatcaccagaagcctgaccgaggacttcgagagagagaaggagcacagcaccaacaagaacgtgttcatcaactgcctgagcagcggcaagagcgagggcgacgacagcggcttcaccgaggaccagaccagaagaagcgtgaagcagagcaccagaaagctgctgcccaagagcttcagcagccactacaagttcagcaagcccgtgctgcagagccagagcatcagcctggtgcagcagagcgagttcagcctggaggtgacccagtaccaggagagagagcccgtgctggtgagagccagccccagctgcagcgtggacgtgaccgagagagccggcagcagcctgcagagccccctgctgagcgccgacctgaccaccgcccagacccccagcgagttcctggccctgaccgaggacagcgtgagcgagatggacgccttcagcaagagcggcagcatggccagccactgcgacaacttcggccacaacgacagcaccagccagatgagcctgaacagcgccgccgtgaccaagaccaccaccgagctgaccggcaccgtgccctgcgccatcatgagccccggcaagtacagactggagggccagtgcagcaccgagagcaacagcctgcccgagaccagcgccgccaaccagaaggaggtgctgctgcagatcgccgagctgcccgccaccagcgtgagccacagcgagagcaacctgcccgccgacagcgagagagaggagaacatcggcctgcagaacggcgagaccatgctgggcaccaacagccccagaaagctgggcttctacgagcagcacaaggccatcgccgagcacgtgaagggcatccaccccatcagcgacagcaagatcatccccaccagcggcgaccaccacatcttcaacaagaccagccacggctacgaggccaaccccgccaaggtgctggccagcagcctgagccccttcagagagggcagattcatcgagagaagactgagaagcagcagcgagggcaccgccggcagcagcagaatgatcctgaagcccaaggacggcaacatcgaggaggtgaacagcctgagaaagcagagagccggcagcagcagcagcaagatgaacagcctggacgtgctgaacaacctgggcagctgcgagctggacgaggacgacctgatgctggacctggagttcctggaggagcagagcctgcaccccagcgtgtgcagagaggacagctaccacagcgtggtgagctgcgccgccgtggtgctgacccccatggagcccatgatcgagatgaagaagagagaggagcccgagttccccgagcccagcaagcagaacctgagcctgaagctgaccaaggacgtggaccaggaggccagatgcagccacatcagcagaatgcccaacagccccagcgccgactggcccctgcagggcgtggaggagaacggcggcatcgacagcctgcccttcagactgatgctgcaggactgcaccgccgtgaagaccctgctgctgaagatgaagagagtgctgcaggagagcgccgacatgagccccgccagcagcaccaccagcctgcccgtgagccccctgaccgaggagcccgtgcccttcaaggactactacaagagacccttctag

SEQ ID NO: 21052 - DNA, 2703 bp, Artificial Sequence; identical to SEQ ID NO: 21049
  Description of Artificial Sequence: Synthetic coding sequence

SEQ ID NO: 21053 - DNA, 10074 bp, Artificial Sequence
  Description of Artificial Sequence: Synthetic coding sequence
atgggcagacacgtggccaccagctgccacgtggcctggctgctggtgctgatcagcggctgctggggccaggtgaacagactgcccttcttcaccaaccacttcttcgacacctacctgctgatcagcgaggacacccccgtgggcagcagcgtgacccagctgctggcccaggacatggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgaggtgggcgccaccggcaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccaccgaccaggacaagaccagacccctgagcaccctggccaacctggccatcatcatcaccgacgtgcaggacatggaccccatcttcatcaacctgccctacagcaccaacatctacgagcacagcccccccggcaccaccgtgagaatcatcaccgccatcgaccaggacaagggcagacccagaggcatcggctacaccatcgtgagcggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggccaccgacaacgacgccggcaccttcggcgaggtgagctacttcttcagcgacgaccccgacagattcagcctggacaaggacaccggcctgatcatgctgatcgccagactggactacgagctgatccagagattcaccctgaccatcatcgccagagacggcggcggcgaggagaccaccggcagagtgagaatcaacgtgctggacgtgaacgacaacgtgcccaccttccagaaggacgcctacgtgggcgccctgagagagaacgagcccagcgtgacccagctggtgagactgagagccaccgacgaggacagcccccccaacaaccagatcacctacagcatcgtgagcgccagcgccttcggcagctacttcgacatcagcctgtacgagggctacggcgtgatcagcgtgagcagacccctggactacgagcagatcagcaacggcctgatctacctgaccgtgatggccatggacgccggcaacccccccctgaacagcaccgtgcccgtgaccatcgaggtgttcgacgagaacgacaacccccccaccttcagcaagcccgcctacttcgtgagcgtggtggagaacatcatggccggcgccaccgtgctgttcctgaacgccaccgacctggacagaagcagagagtacggccaggagagcatcatctacagcctggagggcagcacccagttcagaatcaacgccagaagcggcgagatcaccaccaccagcctgctggacagagagaccaagagcgagtacatcctgatcgtgagagccgtggacggcggcgtgggccacaaccagaagaccggcatcgccaccgtgaacatcaccctgctggacatcaacgacaaccaccccacctggaaggacgccccctactacatcaacctggtggagatgaccccccccgacagcgacgtgaccaccgtggtggccgtggaccccgacctgggcgagaacggcaccctggtgtacagcatccagccccccaacaagttctacagcctgaacagcaccaccggcaagatcagaaccacccacgccatgctggacagagagaaccccgacccccacgaggccgagctgatgagaaagatcgtggtgagcgtgaccgactgcggcagaccccccctgaaggccaccagcagcgccaccgtgttcgtgaacctgctggacctgaacgacaacgaccccaccttccagaacctgcccttcgtggccgaggtgctggagggcatccccgccggcgtgagcatctaccaggtggtggccatcgacctggacgagggcctgaacggcctggtgagctacagaatgcccgtgggcatgcccagaatggacttcctgatcaacagcagcagcggcgtggtggtgaccaccaccgagctggacagagagagaatcgccgagtaccagctgagagtggtggccagcgacgccggcacccccaccaagagcagcaccagcaccctgaccatccacgtgctggacgtgaacgacgagacccccaccttcttccccgccgtgtacaacgtgagcgtgagcgaggacgtgcccagagagttcagagtggtgtggctgaactgcaccgacaacgacgtgggcctgaacgccgagctgagctacttcatcaccggcggcaacgtggacggcaagttcagcgtgggctacagagacgccgtggtgagaaccgtggtgggcctggacagagagaccaccgccgcctacatgctgatcctggaggccatcgacaacggccccgtgggcaagagacacaccggcaccgccaccgtgttcgtgaccgtgctggacgtgaacgacaacagacccatcttcctgcagagcagctacgaggccagcgtgcccgaggacatccccgagggccacagcatcctgcagctgaaggccaccgacgccgacgagggcgagttcggcagagtgtggtacagaatcctgcacggcaaccacggcaacaacttcagaatccacgtgagcaacggcctgctgatgagaggccccagacccctggacagagagagaaacagcagccacgtgctgatcgtggaggcctacaaccacgacctgggccccatgagaagcagcgtgagagtgatcgtgtacgtggaggacatcaacgacgaggcccccgtgttcacccagcagcagtacagcagactgggcctgagagagaccgccggcatcggcaccagcgtgatcgtggtgcaggccaccgacagagacagcggcgacggcggcctggtgaactacagaatcctgagcggcgccgagggcaagttcgagatcgacgagagcaccggcctgatcatcaccgtgaactacctggactacgagaccaagaccagctacatgatgaacgtgagcgccaccgaccaggccccccccttcaaccagggcttctgcagcgtgtacatcaccctgctgaacgagctggacgaggccgtgcagttcagcaacgccagctacgaggccgccatcctggagaacctggccctgggcaccgagatcgtgagagtgcaggcctacagcatcgacaacctgaaccagatcacctacagattcaacgcctacaccagcacccaggccaaggccctgttcaagatcgacgccatcaccggcgtgatcaccgtgcagggcctggtggacagagagaagggcgacttctacaccctgaccgtggtggccgacgacggcggccccaaggtggacagcaccgtgaaggtgtacatcaccgtgctggacgagaacgacaacagccccagattcgacttcaccagcgacagcgccgtgagcatccccgaggactgccccgtgggccagagagtggccaccgtgaaggcctgggaccccgacgccggcagcaacggccaggtggtgttcagcctggccagcggcaacatcgccggcgccttcgagatcgtgaccaccaacgacagcatcggcgaggtgttcgtggccagacccctggacagagaggagctggaccactacatcctgcaggtggtggccagcgacagaggcaccccccccagaaagaaggaccacatcctgcaggtgaccatcctggacatcaacgacaacccccccgtgatcgagagccccttcggctacaacgtgagcgtgaacgagaacgtgggcggcggcaccgccgtggtgcaggtgagagccaccgacagagacatcggcatcaacagcgtgctgagctactacatcaccgagggcaacaaggacatggccttcagaatggacagaatcagcggcgagatcgccaccagacccgccccccccgacagagagagacagagcttctaccacctggtggccaccgtggaggacgagggcacccccaccctgagcgccaccacccacgtgtacgtgaccatcgtggacgagaacgacaacgcccccatgttccagcagccccactacgaggtgctgctggacgagggccccgacaccctgaacaccagcctgatcaccatccaggccctggacctggacgagggccccaacggcaccgtgacctacgccatcgtggccggcaacatcgtgaacaccttcagaatcgacagacacatgggcgtgatcaccgccgccaaggagctggactacgagatcagccacggcagatacaccctgatcgtgaccgccaccgaccagtgccccatcctgagccacagactgaccagcaccaccaccgtgctggtgaacgtgaacgacatcaacgacaacgtgcccaccttccccagagactacgagggccccttcgaggtgaccgagggccagcccggccccagagtgtggaccttcctggcccacgacagagacagcggccccaacggccaggtggagtacagcatcatggacggcgaccccctgggcgagttcgtgatcagccccgtggagggcgtgctgagagtgagaaaggacgtggagctggacagagagaccatcgccttctacaacctgaccatctgcgccagagacagaggcatgccccccctgagcagcaccatgctggtgggcatcagagtgctggacatcaacgacaacgaccccgtgctgctgaacctgcccatgaacatcaccatcagcgagaacagccccgtgagcagcttcgtggcccacgtgctggccagcgacgccgacagcggctgcaacgccagactgaccttcaacatcaccgccggcaacagagagagagccttcttcatcaacgccaccaccggcatcgtgaccgtgaacagacccctggacagagagagaatccccgagtacaagctgaccatcagcgtgaaggacaaccccgagaaccccagaatcgccagaagagactacgacctgctgctgatcttcctgagcgacgagaacgacaaccaccccctgttcaccaagagcacctaccaggccgaggtgatggagaacagccccgccggcacccccctgaccgtgctgaacggccccatcctggccctggacgccgaccaggacatctacgccgtggtgacctaccagctgctgggcgcccagagcggcctgttcgacatcaacagcagcaccggcgtggtgaccgtgagaagcggcgtgatcatcgacagagaggccttcagcccccccatcctggagctgctgctgctggccgaggacatcggcctgctgaacagcaccgcccacctgctgatcaccatcctggacgacaacgacaacagacccaccttcagccccgccaccctgaccgtgcacctgctggagaactgcccccccggcttcagcgtgctgcaggtgaccgccaccgacgaggacagcggcctgaacggcgagctggtgtacagaatcgaggccggcgcccaggacagattcctgatccacctggtgaccggcgtgatcagagtgggcaacgccaccatcgacagagaggagcaggagagctacagactgaccgtggtggccaccgacagaggcaccgtgcccctgagcggcaccgccatcgtgaccatcctgatcgacgacatcaacgacagcagacccgagttcctgaaccccatccagaccgtgagcgtgctggagagcgccgagcccggcaccgtgatcgccaacatcaccgccatcgaccacgacctgaaccccaagctggagtaccacatcgtgggcatcgtggccaaggacgacaccgacagactggtgcccaaccaggaggacgccttcgccgtgaacatcaacaccggcagcgtgatggtgaagagccccatgaacagagagctggtggccacctacgaggtgaccctgagcgtgatcgacaacgccagcgacctgcccgagagaagcgtgagcgtgcccaacgccaagctgaccgtgaacgtgctggacgtgaacgacaacaccccccagttcaagcccttcggcatcacctactacatggagagaatcctggagggcgccacccccggcaccaccctgatcgccgtggccgccgtggaccccgacaagggcctgaacggcctggtgacctacaccctgctggacctggtgccccccggctacgtgcagctggaggacagcagcgccggcaaggtgatcgccaacagaaccgtggactacgaggaggtgcactggctgaacttcaccgtgagagccagcgacaacggcagcccccccagagccgccgagatccccgtgtacctggagatcgtggacatcaacgacaacaaccccatcttcgaccagcccagctaccaggaggccgtgttcgaggacgtgcccgtgggcaccatcatcctgaccgtgaccgccaccgacgccgacagcggcaacttcgccctgatcgagtacagcctgggcgacggcgagagcaagttcgccatcaaccccaccaccggcgacatctacgtgctgagcagcctggacagagagaagaaggaccactacatcctgaccgccctggccaaggacaaccccggcgacgtggccagcaacagaagagagaacagcgtgcaggtggtgatccaggtgctggacgtgaacgactgcagaccccagttcagcaagccccagttcagcaccagcgtgtacgagaacgagcccgccggcaccagcgtgatcaccatgatggccaccgaccaggacgagggccccaacggcgagctgacctacagcctggagggccccggcgtggaggccttccacgtggacatggacagcggcctggtgaccacccagagacccctgcagagctacgagaagttcagcctgaccgtggtggccaccgacggcggcgagccccccctgtggggcaccaccatgctgctggtggaggtgatcgacgtgaacgacaacagacccgtgttcgtgagaccccccaacggcaccatcctgcacatcagagaggagatccccctgagaagcaacgtgtacgaggtgtacgccaccgacaaggacgagggcctgaacggcgccgtgagatacagcttcctgaagaccgccggcaacagagactgggagttcttcatcatcgaccccatcagcggcctgatccagaccgcccagagactggacagagagagccaggccgtgtacagcctgatcctggtggccagcgacctgggccagcccgtgccctacgagaccatgcagcccctgcaggtggccctggaggacatcgacgacaacgagcccctgttcgtgagaccccccaagggcagcccccagtaccagctgctgaccgtgcccgagcacagccccagaggcaccctggtgggcaacgtgaccggcgccgtggacgccgacgagggccccaacgccatcgtgtactacttcatcgccgccggcaacgaggagaagaacttccacctgcagcccgacggctgcctgctggtgctgagagacctggacagagagagagaggccatcttcagcttcatcgtgaaggccagcagcaacagaagctggaccccccccagaggccccagccccaccctggacctggtggccgacctgaccctgcaggaggtgagagtggtgctggaggacatcaacgaccagccccccagattcaccaaggccgagtacaccgccggcgtggccaccgacgccaaggtgggcagcgagctgatccaggtgctggccctggacgccgacatcggcaacaacagcctggtgttctacagcatcctggccatccactacttcagagccctggccaacgacagcgaggacgtgggccaggtgttcaccatgggcagcatggacggcatcctgagaaccttcgacctgttcatggcctacagccccggctacttcgtggtggacatcgtggccagagacctggccggccacaacgacaccgccatcatcggcatctacatcctgagagacgaccagagagtgaagatcgtgatcaacgagatccccgacagagtgagaggcttcgaggaggagttcatccacctgctgagcaacatcaccggcgccatcgtgaacaccgacaacgtgcagttccacgtggacaagaagggcagagtgaacttcgcccagaccgagctgctgatccacgtggtgaacagagacaccaacagaatcctggacgtggacagagtgatccagatgatcgacgagaacaaggagcagctgagaaacctgttcagaaactacaacgtgctggacgtgcagcccgccatcagcgtgagactgcccgacgacatgagcgccctgcagatggccatcatcgtgctggccatcctgctgttcctggccgccatgctgttcgtgctgatgaactggtactacagaaccgtgcacaagagaaagctgaaggccatcgtggccggcagcgccggcaacagaggcttcatcgacatcatggacatgcccaacaccaacaagtacagcttcgacggcgccaaccccgtgtggctggaccccttctgcagaaacctggagctggccgcccaggccgagcacgaggacgacctgcccgagaacctgagcgagatcgccgacctgtggaacagccccaccagaacccacggcaccttcggcagagagcccgccgccgtgaagcccgacgacgacagatacctgagagccgccatccaggagtacgacaacatcgccaagctgggccagatcatcagagagggccccatcaagggcagcctgctgaaggtggtgctggaggactacctgagactgaagaagctgttcgcccagagaatggtgcagaaggccagcagctgccacagcagcatcagcgagctgatccagaccgagctggacgaggagcccggcgaccacagccccggccagggcagcctgagattcagacacaagccccccgtggagctgaagggccccgacggcatccacgtggtgcacggcagcaccggcaccctgctggccaccgacctgaacagcctgcccgaggaggaccagaagggcctgggcagaagcctggagaccctgaccgccgccgaggccaccgccttcgagagaaacgccagaaccgagagcgccaagagcacccccctgcacaagctgagagacgtgatcatggagacccccctggagatcaccgagctgtag

SEQ ID NO: 21054 - DNA, 3144 bp, Artificial Sequence
  Description of Artificial Sequence: Synthetic coding sequence
atggaggagaagacccagatcaagaccttcctgggcagcaagctgcccaagtacggcaccaagagcgtgagaagcaccctgcagcccatgcccaacggcacccccgtgaacctgctgggcaccagcaagaacagcaacgtgaagagctacatcaagaacaacggcagcgactgccccagcagccacagcttcaactggagaaaggccaacaagtaccagctgtgcgcccagggcgtggaggagcccaacaacacccagaacagccacgacaagatcatcgaccccgagaagagagtgcccacccagggcatgttcgacaagaacggcatcaagggcggcctgaagagcgtgagcctgttcaccagcaagctggccaagcccagcaccatgttcgtgagcagcaccgaggagctgaaccagaagagcttcagcggccccagcaacctgggcaagttcaccaagggcaccctgctgggcagaaccagctacagcagcatcaacacccccaagagccagctgaacggcttctacggcaacagaagcgccggcagcatgcagagacccagagccaacagctgcgccaccagaagcagcagcggcgagagcctggcccagagccccgacagcagcaagagcatcaactgcgagaagatggtgagaagccagagcttcagccacagcatccagaacagcttcctgccccccagcagcatcaccagaagccacagcttcaacagagccgtggacctgaccaagccctaccagaaccagcagctgagcatcagagtgcccctgagaagcagcatgctgaccagaaacagcagacagcccgaggtgctgaacggcaacgagcacctgggctacggcttcaacagaccctacgccgccggcggcaagaagctggccctgcccaacggccccggcgtgaccagcaccctgggctacagaatggtgcaccccagcctgctgaagagcagcagaagccccttcagcggcaccatgaccgtggacggcaacaagaacagccccgccgacacctgcgtggaggaggacgccaccgtgctggccaaggacagagccgccaacaaggaccaggagctgatcgagaacgagagctacagaaccaagaacaaccagaccatgaagcacgacgccaagatgagatacctgagcgacgacgtggacgacatcagcctgagcagcctgagcagcagcgacaagaacgacctgagcgaggacttcagcgacgacttcatcgacatcgaggacagcaacagaaccagaatcacccccgaggagatgagcctgaaggaggagaagcacgagaacggccccccccaggacatgttcgacagccccaaggagaacgagaaggccttcagcaagaccgacgagtggatcgacatcagcgtgagcgacagaagcgagtgcaccaagcacaccagcggcaacaacctggtgagccccgacaccgactacagagccggcagcagcttcgagctgagccccagcgacagcagcgacggcacctacatgtgggacgaggagggcctggagcccatcggcaacgtgcaccccgtgggcagctacgagagcagcgagatgaacagcatcgacatcctgaacaacctggagagctgcgacctggaggacgacgacctgatgctggacgtggacctgcccgaggacgcccccctggagaacgtggagtgcgacaacatgaacagattcgacagacccgacagaaacgtgagacagccccaggagggcttctggaagagacccccccagagatggagcggccaggagcactaccacctgagccaccccgaccactaccaccaccacggcaagagcgacctgagcagaggcagcccctacagagagagccccctgggccacttcgagagctacggcggcatgcccttcttccaggcccagaagatgttcgtggacgtgcccgagaacaccgtgatcctggacgagatgaccctgagacacatggtgcaggactgcaccgccgtgaagacccagctgctgaagctgaagagactgctgcaccagcacgacggcagcggcagcctgcacgacatccagctgagcctgcccagcagccccgagcccgaggacggcgacaaggtgtacaagaacgaggacctgctgaacgagatcaagcagctgaaggacgagatcaagaagaaggacgagaagatccagctgctggagctgcagctggccacccagcacatctgccaccagaagtgcaaggaggagaagtgcacctacgccgacaagtacacccagaccccctggagaagaatccccccccaggtgctgcagcccagcagcagcctgcccagacccaccgaccacacccagggcaagctgatcaagccccagagaatcgaggccagaagcgagtgcagcatccaggacatgcaccagggcggcgcccaccccgaggagagcttcacccacgtgctgcaccaggagagcaactacggcctggaggagcagcccttcagcagcggcccccagctgaccatggacgtggccaagagcacccccagcgaggccaacctgaacatcaccgtgaacgcccaggagccctaccacctggccaacaaccagatcagcgacatgcagttcatccccaccagcctgcagaccccccccgagagcagcaccgtggaccaggccaagagagtgggcagaaaccagagcccccccgtgggctacatgagccagcccaagagcctgcagctgctgaagcccagcatcctgagcagcctggtgcccccccccgtgagcgagagcagccccagcagaacccccacctgcaagaagagccccatcatcaccacctgcaacagcgccaagctgcagcccaccagcagccagaccaacctggccaacaaccagaacctgaaggccagcaagctgagaccccccagcggcagcttcaagcagaagcagaccaacagcccccagctggagccccagagcttccaggccaagaccagcatccccagacccctgacccagagaaaggagatcatgcagaaccccaacggcaacctgcacagcggcgactgcctggccagcaacagatacagcagactgcccaagcccaagatccactag

SEQ ID NO: 21055 - DNA, 786 bp, Artificial Sequence
  Description of Artificial Sequence: Synthetic coding sequence
atgaacagattcgacagacccgacagaaacgtgagacagccccaggagggcttctggaagagacccccccagagatggagcggccaggagcactaccacctgagccaccccgaccactaccaccaccacggcaagagcgacctgagcagaggcagcccctacagagagagccccctgggccacttcgagagctacggcggcatgcccttcttccaggcccagaagatgttcgtggacgtgcccgagaacaccgtgatcctggacgagatgaccctgagacacatggtgcaggactgcaccgccgtgaagacccagctgctgaagctgaagagactgctgcaccagcacgacggcagcggcagcctgcacgacatccagctgagcctgcccagcagccccgagcccgaggacggcgacaaggtgtacaagaacgaggacctgctgaacgagatcaagcagctgaaggacgagatcaagaagaaggacgagaagatccagctgctggagctgcagctggccacccagcacatctgccaccagaagtgcaaggaggagaagtgcacctacgccgacaagtacacccagaccccctggagaagaatccccggcggctacagcgcccccagcttcagcccctggcagggcagcttccagggcatccccagaaccgtgcccccccacagaagacagaccagcagcaccaccgccttccagcagcccagccagacccacagaagccaccccggcaagaccaacaaggccaccacctacagaggcccccagtag

SEQ ID NO: 21056 - DNA, 3741 bp, Artificial Sequence
  Description of Artificial Sequence: Synthetic coding sequence
atgaaggtgagactgctgagacagctgagcgccgccgccaaggtgaaggcccccagcggcctgcagggccccccccaggcccaccagttcatcagcctgctgctggaggagtacggcgccctgtgccaggccgccagaagcatcagcaccttcctgggcaccctggagaacgagcacctgaagaagttccaggtgacctgggagctgcacaacaagcacctgttcgagaacctggtgttcagcgagcccctgctgcagagcaacctgcccgccctggtgagccagatcagactgggcaccaccacccacgacacctgcagcgaggacacctacagcaccctgctgcagagataccagagaagcgaggaggagctgagaagagtggccgaggagtggctggagtgccagaagagaatcgacgcctacgtggacgagcaggacctgcagaccagcgtgaacaagagcatcgacaccggcaccctggtgcagagctggctgagaggcgccgccatgaccatgaagaccaagcagagaatgctgaccgaggactgggagctgttcaagcagagaagattcatcgaggagcagctgaccaacaagaaggccgtgaccggcgagaacaacttcaccgacaccatgagacacatgctgagcagcagactgagcatgcccgactgccccaactgcaactacagaagaagatgcgcctgcgacgactgcagcctgagccacatcctgacctgcggcatcatggacccccccgtgaccgacgacatccacatccaccagctgcccctgcaggtggaccccgcccccgactacctggccgagagaagcccccccagcgtgagcagcgccagcagcggcagcggcagcagcagccccatcaccatccagcagcaccccagactgatcctgaccgacagcggcagcgcccccaccttcgacgacgaggacgtggcccccctgagcgccaagttcgccgacatctaccccctgagcaactacgacgacaccgaggtggtggccaacatgaacggcatccacagcgagctgaacggcggcggcgagaacatggccctgaaggacgagagcccccagatcagcagcaccagcagcagcagcagcgaggccgacgacgaggaggccgacggcgagagcagcggcgagccccccggcgcccccaaggaggacggcgtgctgggcagcagaagccccagaaccgaggagagcaaggccgacagccccccccccagctaccccacccagcaggccgagcaggcccccaacacctgcgagtgccacgtgtgcaagcaggaggccagcggcctgacccccagcgccatgaccgccggcgccctgccccccggccaccagttcctgagccccgagaagcccacccaccccgccctgcacctgtacccccacatccacggccacgtgcccctgcacaccgtgccccacctgcccagacccctgatccaccccaccctgtacgccaccccccccttcacccacagcaaggccctgccccccgcccccgtgcagaaccacaccaacaagcaccaggtgttcaacgccagcctgcaggaccacatctaccccagctgcttcggcaacacccccgagtggaacagcagcaagttcatcagcctgtggggcagcgaggtgatgaacgacaagaactggaaccccggcaccttcctgcccgacaccatcagcggcagcgagatcctgggccccaccctgagcgagaccagacccgaggccctgcccccccccagcagcaacgagacccccgccgtgagcgacagcaaggagaagaagaacgccgccaagaagaagtgcctgtacaacttccaggacgccttcatggaggccaacaaggtggtgatggccaccagcagcgccaccagcagcgtgagctgcaccgccaccaccgtgcagagcagcaacagccagttcagagtgagcagcaagagaccccccagcgtgggcgacgtgttccacggcatcagcaaggaggaccacagacacagcgcccccgccgcccccagaaacagccccaccggcctggcccccctgcccgccctgagccccgccgccctgagccccgccgccctgagccccgccagcaccccccacctggccaacctggccgcccccagcttccccaagaccgccaccaccacccccggcttcgtggacaccagaaagagcttctgccccgcccccctgccccccgccaccgacggcagcatcagcgccccccccagcgtgtgcagcgaccccgactgcgagggccacagatgcgagaacggcgtgtacgacccccagcaggacgacggcgacgagagcgccgacgaggacagctgcagcgagcacagcagcagcaccagcaccagcaccaaccagaaggagggcaagtactgcgactgctgctactgcgagttcttcggccacggcggcccccccgccgcccccaccagcagaaactacgccgagatgagagagaagctgagactgagactgaccaagagaaaggaggagcagcccaagaagatggaccagatcagcgagagagagagcgtggtggaccacagaagagtggaggacctgctgcagttcatcaacagcagcgagaccaagcccgtgagcagcaccagagccgccaagagagccagacacaagcagagaaagctggaggagaaggccagactggaggccgaggccagagccagagagcacctgcacctgcaggaggagcagagaagaagagaggaggaggaggacgaggaggaggaggaggacagattcaaggaggagttccagagactgcaggagctgcagaagctgagagccgtgaagaagaagaagaaggagagacccagcaaggactgccccaagctggacatgctgaccagaaacttccaggccgccaccgagagcgtgcccaacagcggcaacatccacaacggcagcctggagcagaccgaggagcccgagaccagcagccacagccccagcagacacatgaaccacagcgagcccagacccggcctgggcgccgacggcgacgccgccgaccccgtggacaccagagacagcaagttcctgctgcccaaggaggtgaacggcaagcagcacgagcccctgagcttcttcttcgacatcatgcagcaccacaaggagggcaacggcaagcagaagctgagacagaccagcaaggccagcagcgagcccgccagaagacccaccgagccccccaaggccaccgagggccagagcaagcccagagcccagaccgagagcaaggccaaggtggtggacctgatgagcatcaccgagcagaagagagaggagagaaaggtgaacagcaacaacaacaacaagaagcagctgaaccacatcaaggacgagaagagcaaccccacccccatggagcccaccagccccggcgagcaccagcagaacagcaagctggtgctggccgagagcccccagcccaagggcaagaacaagaagaacaagaagaagaagggcgacagagtgaacaacagcatcgacgacgtgttcctgcccaaggacatcgacctggacagcgtggacatggacgagaccgagagagaggtggagtacttcaagagattctgcctggacagcgccagacagaccagacagagactgagcatcaactggagcaacttcagcctgaagaaggccaccttcgccgcccactag

SEQ ID NO: 21057 - DNA, 3636 bp, Artificial Sequence
  Description of Artificial Sequence: Synthetic coding sequence
atgaaggtgagactgctgagacagctgagcgccgccgccaaggtgaaggcccccagcggcctgcagggccccccccaggcccaccagttcatcagcctgctgctggaggagtacggcgccctgtgccaggccgccagaagcatcagcaccttcctgggcaccctggagaacgagcacctgaagaagttccaggtgacctgggagctgcacaacaagcacctgttcgagaacctggtgttcagcgagcccctgctgcagagcaacctgcccgccctggtgagccagatcagactgggcaccaccacccacgacacctgcagcgaggacacctacagcaccctgctgcagagataccagagaagcgaggaggagctgagaagagtggccgaggagtggctggagtgccagaagagaatcgacgcctacgtggacgagcagatgaccatgaagaccaagcagagaatgctgaccgaggactgggagctgttcaagcagagaagattcatcgaggagcagctgaccaacaagaaggccgtgaccggcgagaacaacttcaccgacaccatgagacacatgctgagcagcagactgagcatgcccgactgccccaactgcaactacagaagaagatgcgcctgcgacgactgcagcctgagccacatcctgacctgcggcatcatggacccccccgtgaccgacgacatccacatccaccagctgcccctgcaggtggaccccgcccccgactacctggccgagagaagcccccccagcgtgagcagcgccagcagcggcagcggcagcagcagccccatcaccatccagcagcaccccagactgatcctgaccgacagcggcagcgcccccaccttctgcagcgacgacgaggacgtggcccccctgagcgccaagttcgccgacatctaccccctgagcaactacgacgacaccgaggtggtggccaacatgaacggcatccacagcgagctgaacggcggcggcgagaacatggccctgaaggacgagagcccccagatcagcagcaccagcagcagcagcagcgaggccgacgacgaggaggccgacggcgagagcagcggcgagccccccggcgcccccaaggaggacggcgtgctgggcagcagaagccccagaaccgaggagagcaaggccgacagccccccccccagctaccccacccagcaggccgagcaggcccccaacacctgcgagtgccacgtgtgcaagcaggaggccagcggcctgacccccagcgccatgaccgccggcgccctgccccccggccaccagttcctgagccccgagaagcccacccaccccgccctgcacctgtacccccacatccacggccacgtgcccctgcacaccgtgccccacctgcccagacccctgatccaccccaccctgtacgccaccccccccttcacccacagcaaggccctgccccccgcccccgtgcagaaccacaccaacaagcaccaggtgttcaacgccagcctgcaggaccacatctaccccagctgcttcggcaacacccccgagtggaacagcagcaagttcatcagcctgtggggcagcgaggtgatgaacgacaagaactggaaccccggcaccttcctgcccgacaccatcagcggcagcgagatcctgggccccaccctgagcgagaccagacccgaggccctgcccccccccagcagcaacgagacccccgccgtgagcgacagcaaggagaagaagaacgccgccaagaagaagtgcctgtacaacttccaggacgccttcatggaggccaacaaggtggtgatggccaccagcagcgccaccagcagcgtgagctgcaccgccaccaccgtgcagagcagcaacagccagttcagagtgagcagcaagagaccccccagcgtgggcgacgtgttccacggcatcagcaaggaggaccacagacacagcgcccccgccgcccccagaaacagccccaccggcctggcccccctgcccgccctgagccccgccgccctgagccccgccgccctgagccccgccagcaccccccacctggccaacctggccgcccccagcttccccaagaccgccaccaccacccccggcttcgtggacaccagaaagagcttctgccccgcccccctgccccccgccaccgacggcagcatcagcgccccccccagcgtgtgcagcgaccccgactgcgagggccacagatgcgagaacggcgtgtacgacccccagcaggacgacggcgacgagagcgccgacgaggacagctgcagcgagcacagcagcagcaccagcaccagcaccaaccagaaggagggcaagtactgcgactgctgctactgcgagttcttcggccacggcggcccccccgccgcccccaccagcagaaactacgccgagatgagagagaagctgagactgagactgaccaagagaaaggaggagcagcccaagaagatggaccagatcagcgagagagagagcgtggtggaccacagaagagtggaggacctgctgcagttcatcaacagcagcgagaccaagcccgtgagcagcaccagagccgccaagagagccagacacaagcagagaaagctggaggagaaggccagactggaggccgaggccagagccagagagcacctgcacctgcaggaggagcagagaagaagagaggaggaggaggacgaggaggaggaggaggacagattcaaggaggagttccagagactgcaggagctgcagaagctgagagccgtgaagaagaagaagaaggagagacccagcaaggactgccccaagctggacatgctgaccagaaacttccaggccgccaccgagagcgtgcccaacagcggcaacatccacaacggcagcctggagcagaccgaggagcccgagaccagcagccacagccccagcagacacatgaaccacagcgagcccagacccggcctgggcgccgacggcgacgccgccgaccccgtggacaccagagacagcaagttcctgctgcccaaggaggtgaacggcaagcagcacgagcccctgagcttcttcttcgacatcatgcagcaccacaaggagggcaacggcaagcagaagctgagacagaccagcaaggccagcagcgagcccgccagaagacccaccgagccccccaaggccaccgagggccagagcaagcccagagcccagaccgagagcaaggccaaggtggtggacctgatgagcatcaccgagcagaagagagaggagagaaaggtgaacagcaacaacaacaacaagaagcagctgaaccacatcaaggacgagaagagcaaccccacccccatggagcccaccagccccggcgagcaccagcagaacagcaagctggtgctggccgagagcccccagcccaagggcaagaacaagaagaacaagaagaagaagggcgacagagtgaacaacagcatcgacgacgtgttcctgcccaaggacatcgacctggacagcgtggacatggacgagaccgagagagaggtggagtacttcaagagagacggcgtgagcccccactgccccggctggagcagaacccccggcctgaagtag

SEQ ID NO: 21058 - DNA, 2469 bp, Artificial Sequence
  Description of Artificial Sequence: Synthetic coding sequence
atgaccagaagaagaagcagacccagcggcggcgccggcagaagagagagagccagagccgccggcccccagaagccccaggcccccgagcccccccccccccccagcctggaggccggcgccggcgccggcccccccgaggcccccgccgagcccgaccacgacggccccagagaggacgacgagcccaacctggtgcccggcccccaggtgccccccgccagcagccagcccgtgcagacctgctgcctgctgtgccacagagagagaaagggctgggaggagggccccagccagaacggcctggtgctgcagggcgagaagctgccccccgacttcatgcccaagctggtgaagaacctgctgggcgagatgcccctgtgggtgtgccagagctgcagaaagagcatggaggaggacgagagacagaccggcagagagcacgccgtggccatcagcctgagccacaccagctgcaagagccagagctgcggcgacgacagccacagcagcagcagcagcagcagcagcagcagcagcagcagcagcagcagctgccccggcaacagcggcgactgggaccccagcagcttcctgagcgcccacaagctgagcggcctgtggaacagcccccacagcagcggcgccatgcccggcagcagcctgggcagcccccccaccatccccggcgaggccttccccgtgagcgagcaccaccagcacagcgacctgaccgccccccccaacagccccaccggccaccacccccagcccgccagcctgatccccagccaccccagcagcttcggcagccccccccacccccacctgctgcccaccacccccgccgcccccttccccgcccaggccagcgagtgccccgtggccgccgccaccgccccccacacccccggcccctgccagagcagccacctgcccagcaccagcatgcccctgctgaagatgcccccccccttcagcggctgcagccacccctgcagcggccactgcggcggccactgcagcggccccctgctgcccccccccagcagccagcccctgcccagcacccacagagaccccggctgcaagggccacaagttcgcccacagcggcctggcctgccagctgccccagccctgcgaggccgacgagggcctgggcgaggaggaggacagcagcagcgagagaagcagctgcaccagcagcagcacccaccagagagacggcaagttctgcgactgctgctactgcgagttcttcggccacaacgccgagaaggagaaggcccagctggccgccgaggccctgaagcaggccaacagagtgagcggcagcagagagcccagacccgccagagagagactgctggagtggcccgacagagagctggacagagtgaacagcttcctgagcagcagactgcaggagatcaagaacaccgtgaaggacagcatcagagccagcttcagcgtgtgcgagctgagcatggacagcaacggcttcagcaaggagggcgccgccgagcccgagccccagagcctgccccccagcaacctgagcggcagcagcgagcagcagcccgacatcaacctggacctgagccccctgaccctgggcagcccccagaaccacaccctgcaggcccccggcgagcccgcccccccctgggccgagatgagaggcccccaccccccctggaccgaggtgagaggccccccccccggcatcgtgcccgagaacggcctggtgagaagactgaacaccgtgcccaacctgagcagagtgatctgggtgaagacccccaagcccggctaccccagcagcgaggagcccagcagcaaggaggtgcccagctgcaagcaggagctgcccgagcccgtgagcagcggcggcaagccccagaagggcaagagacagggcagccaggccaagaagagcgaggccagccccgcccccagaccccccgccagcctggaggtgcccagcgccaagggccaggtggccggccccaagcagcccggcagagtgctggagctgcccaaggtgggcagctgcgccgaggccggcgagggcagcagaggcagcagacccggccccggctgggccggcagccccaagaccgagaaggagaagggcagcagctggagaaactggcccggcgaggccaaggccagaccccaggagcaggagagcgtgcagcccagcggccccgccagaccccagagcctgccccagggcaagggcagaagcagaagaagcagaaacaagcaggagaagcccgccagcagcctggacgacgtgttcctgcccaaggacatggacggcgtggagatggacgagaccgacagagaggtggagtacttcaagagattctgcctggacagcgccaagcagaccagacagaaggtggccgtgaactggaccaacttcagcctgaagaagaccacccccagcaccgcccagtag

SEQ ID NO: 21059 - DNA, 3798 bp, Artificial Sequence
  Description of Artificial Sequence: Synthetic coding sequence
atgaaggtgagactgctgagacagctgagcgccgccgccaaggtgaaggcccccagcggcctgcagggccccccccaggcccaccagttcatcagcctgctgctggaggagtacggcgccctgtgccaggccgccagaagcatcagcaccttcctgggcaccctggagaacgagcacctgaagaagttccaggtgacctgggagctgcacaacaagcacctgttcgagaacctggtgttcagcgagcccctgctgcagagcaacctgcccgccctggtgagccagatcagactgggcaccaccacccacgacacctgcagcgaggacacctacagcaccctgctgcagagataccagagaagcgaggaggagctgagaagagtggccgaggagtggctggagtgccagaagagaatcgacgcctacgtggacgagcagatgaccatgaagaccaagcagagaatgctgaccgaggactgggagctgttcaagcagagaagattcatcgaggagcagctgaccaacaagaaggccgtgaccggcgagaacaacttcaccgacaccatgagacacatgctgagcagcagactgagcatgcccgactgccccaactgcaactacagaagaagatgcgcctgcgacgactgcagcctgagccacatcctgacctgcggcatcatggacccccccgtgaccgacgacatccacatccaccagctgcccctgcaggtggaccccgcccccgactacctggccgagagaagcccccccagcgtgagcagcgccagcagcggcagcggcagcagcagccccatcaccatccagcagcaccccagactgatcctgaccgacagcggcagcgcccccaccttctgcagcgacgacgaggacgtggcccccctgagcgccaagttcgccgacatctaccccctgagcaactacgacgacaccgaggtggtggccaacatgaacggcatccacagcgagctgaacggcggcggcgagaacatggccctgaaggacgagagcccccagatcagcagcaccagcagcagcagcagcgaggccgacgacgaggaggccgacggcgagagcagcggcgagccccccggcgcccccaaggaggacggcgtgctgggcagcagaagccccagaaccgaggagagcaaggccgacagccccccccccagctaccccacccagcaggccgagcaggcccccaacacctgcgagtgccacgtgtgcaagcaggaggccagcggcctgacccccagcgccatgaccgccggcgccctgccccccggccaccagttcctgagccccgagaagcccacccaccccgccctgcacctgtacccccacatccacggccacgtgcccctgcacaccgtgccccacctgcccagacccctgatccaccccaccctgtacgccaccccccccttcacccacagcaaggccctgccccccgcccccgtgcagaaccacaccaacaagcaccaggtgttcaacgccagcctgcaggaccacatctaccccagctgcttcggcaacacccccgagtggaacagcagcaagttcatcagcctgtggggcagcgaggtgatgaacgacaagaactggaaccccggcaccttcctgcccgacaccatcagcggcagcgagatcctgggccccaccctgagcgagaccagacccgaggccctgcccccccccagcagcaacgagacccccgccgtgagcgacagcaaggagaagaagaacgccgccaagaagaagtgcctgtacaacttccaggacgccttcatggaggccaacaaggtggtgatggccaccagcagcgccaccagcagcgtgagctgcaccgccaccaccgtgcagagcagcaacagccagttcagagtgagcagcaagagaccccccagcgtgggcgacgtgttccacggcatcagcaaggaggaccacagacacagcgcccccgccgcccccagaaacagccccaccggcctggcccccctgcccgccctgagccccgccgccctgagccccgccgccctgagccccgccagcaccccccacctggccaacctggccgcccccagcttccccaagaccgccaccaccacccccggcttcgtggacaccagaaagagcttctgccccgcccccctgccccccgccaccgacggcagcatcagcgccccccccagcgtgtgcagcgaccccgactgcgagggccacagatgcgagaacggcgtgtacgacccccagcaggacgacggcgacgagagcgccgacgaggacagctgcagcgagcacagcagcagcaccagcaccagcaccaaccagaaggagggcaagtactgcgactgctgctactgcgagttcttcggccacggcggcccccccgccgcccccaccagcagaaactacgccgagatgagagagaagctgagactgagactgaccaagagaaaggaggagcagcccaagaagatggaccagatcagcgagagagagagcgtggtggaccacagaagagtggaggacctgctgcagttcatcaacagcagcgagaccaagcccgtgagcagcaccagagccgccaagagagccagacacaagcagagaaagctggaggagaaggccagactggaggccgaggccagagccagagagcacctgcacctgcaggaggagcagagaagaagagaggaggaggaggacgaggaggaggaggaggacagattcaaggaggagttccagagactgcaggagctgcagaagctgagagccgtgaagaagaagaagaaggagagacccagcaaggactgccccaagctggacatgctgaccagaaacttccaggccgccaccgagagcgtgcccaacagcggcaacatccacaacggcagcctggagcagaccgaggagcccgagaccagcagccacagccccagcagacacatgaaccacagcgagcccagacccggcctgggcgccgacggcgacgccgccgaccccgtggacaccagagacagcaagttcctgctgcccaaggaggtgaacggcaagcagcacgagcccctgagcttcttcttcgacatcatgcagcaccacaaggagggcaacggcaagcagaagctgagacagaccagcaaggccagcagcgagcccgccagaagacccaccgagccccccaaggccaccgagggccagagcaagcccagagcccagaccgagagcaaggccaaggtggtggacctgatgagcatcaccgagcagaagagagaggagagaaaggtgaacagcaacaacaacaacaagaagcagctgaaccacatcaaggacgagaagagcaaccccacccccatggagcccaccagccccggcgagcaccagcagaacagcaagctggtgctggccgagagcccccagcccaagggcaagaacaagaagaacaagaagaagaagggcgacagagtgaacaacagcatcgacggcgtgagcctgctgctgcccagcctgggctacaacggcgccatcctggcccactgcaacctgagactgcccggcagcagcgactgcgccgccagcgccagccaggtggtgggcatcaccgacgacgtgttcctgcccaaggacatcgacctggacagcgtggacatggacgagaccgagagagaggtggagtacttcaagagattctgcctggacagcgccagacagaccagacagagactgagcatcaactggagcaacttcagcctgaagaaggccaccttcgccgcccactag

SEQ ID NO: 21060 - DNA, 3675 bp, Artificial Sequence
  Description of Artificial Sequence: Synthetic coding sequence
atgaaggtgagactgctgagacagctgagcgccgccgccaaggtgaaggcccccagcggcctgcagggccccccccaggcccaccagttcatcagcctgctgctggaggagtacggcgccctgtgccaggccgccagaagcatcagcaccttcctgggcaccctggagaacgagcacctgaagaagttccaggtgacctgggagctgcacaacaagcacctgttcgagaacctggtgttcagcgagcccctgctgcagagcaacctgcccgccctggtgagccagatcagactgggcaccaccacccacgacacctgcagcgaggacacctacagcaccctgctgcagagataccagagaagcgaggaggagctgagaagagtggccgaggagtggctggagtgccagaagagaatcgacgcctacgtggacgagcagatgaccatgaagaccaagcagagaatgctgaccgaggactgggagctgttcaagcagagaagattcatcgaggagcagctgaccaacaagaaggccgtgaccggcgagaacaacttcaccgacaccatgagacacatgctgagcagcagactgagcatgcccgactgccccaactgcaactacagaagaagatgcgcctgcgacgactgcagcctgagccacatcctgacctgcggcatcatggacccccccgtgaccgacgacatccacatccaccagctgcccctgcaggtggaccccgcccccgactacctggccgagagaagcccccccagcgtgagcagcgccagcagcggcagcggcagcagcagccccatcaccatccagcagcaccccagactgatcctgaccgacagcggcagcgcccccaccttctgcagcgacgacgaggacgtggcccccctgagcgccaagttcgccgacatctaccccctgagcaactacgacgacaccgaggtggtggccaacatgaacggcatccacagcgagctgaacggcggcggcgagaacatggccctgaaggacgagagcccccagatcagcagcaccagcagcagcagcagcgaggccgacgacgaggaggccgacggcgagagcagcggcgagccccccggcgcccccaaggaggacggcgtgctgggcagcagaagccccagaaccgaggagagcaaggccgacagccccccccccagctaccccacccagcaggccgagcaggcccccaacacctgcgagtgccacgtgtgcaagcaggaggccagcggcctgacccccagcgccatgaccgccggcgccctgccccccggccaccagttcctgagccccgagaagcccacccaccccgccctgcacctgtacccccacatccacggccacgtgcccctgcacaccgtgccccacctgcccagacccctgatccaccccaccctgtacgccaccccccccttcacccacagcaaggccctgccccccgcccccgtgcagaaccacaccaacaagcaccaggtgttcaacgccagcctgcaggaccacatctaccccagctgcttcggcaacacccccgagtggaacagcagcaagttcatcagcctgtggggcagcgaggtgatgaacgacaagaactggaaccccggcaccttcctgcccgacaccatcagcggcagcgagatcctgggccccaccctgagcgagaccagacccgaggccctgcccccccccagcagcaacgagacccccgccgtgagcgacagcaaggagaagaagaacgccgccaagaagaagtgcctgtacaacttccaggacgccttcatggaggccaacaaggtggtgatggccaccagcagcgccaccagcagcgtgagctgcaccgccaccaccgtgcagagcagcaacagccagttcagagtgagcagcaagagaccccccagcgtgggcgacgtgttccacggcatcagcaaggaggaccacagacacagcgcccccgccgcccccagaaacagccccaccggcctggcccccctgcccgccctgagccccgccgccctgagccccgccgccctgagccccgccagcaccccccacctggccaacctggccgcccccagcttccccaagaccgccaccaccacccccggcttcgtggacaccagaaagagcttctgccccgcccccctgccccccgccaccgacggcagcatcagcgccccccccagcgtgtgcagcgaccccgactgcgagggccacagatgcgagaacggcgtgtacgacccccagcaggacgacggcgacgagagcgccgacgaggacagctgcagcgagcacagcagcagcaccagcaccagcaccaaccagaaggagggcaagtactgcgactgctgctactgcgagttcttcggccacggcggcccccccgccgcccccaccagcagaaactacgccgagatgagagagaagctgagactgagactgaccaagagaaaggaggagcagcccaagaagatggaccagatcagcgagagagagagcgtggtggaccacagaagagtggaggacctgctgcagttcatcaacagcagcgagaccaagcccgtgagcagcaccagagccgccaagagagccagacacaagcagagaaagctggaggagaaggccagactggaggccgaggccagagccagagagcacctgcacctgcaggaggagcagagaagaagagaggaggaggaggacgaggaggaggaggaggacagattcaaggaggagttccagagactgcaggagctgcagaagctgagagccgtgaagaagaagaagaaggagagacccagcaaggactgccccaagctggacatgctgaccagaaacttccaggccgccaccgagagcgtgcccaacagcggcaacatccacaacggcagcctggagcagaccgaggagcccgagaccagcagccacagccccagcagacacatgaaccacagcgagcccagacccggcctgggcgccgacggcgacgccgccgaccccgtggacaccagagacagcaagttcctgctgcccaaggaggtgaacggcaagcagcacgagcccctgagcttcttcttcgacatcatgcagcaccacaaggagggcaacggcaagcagaagctgagacagaccagcaaggccagcagcgagcccgccagaagacccaccgagccccccaaggccaccgagggccagagcaagcccagagcccagaccgagagcaaggccaaggtggtggacctgatgagcatcaccgagcagaagagagaggagagaaaggtgaacagcaacaacaacaacaagaagcagctgaaccacatcaaggacgagaagagcaaccccacccccatggagcccaccagccccggcgagcaccagcagaacagcaagctggtgctggccgagagcccccagcccaagggcaagaacaagaagaacaagaagaagaagggcgacagagtgaacaacagcatcgacgacgtgttcctgcccaaggacatcgacctggacagcgtggacatggacgagaccgagagagaggtggagtacttcaagagattctgcctggacagcgccagacagaccagacagagactgagcatcaactggagcaacttcagcctgaagaaggccaccttcgccgcccactag

SEQ ID NO: 21061 - DNA, 132 bp, Artificial Sequence
  Description of Artificial Sequence: Synthetic coding sequence
atgaaggtgagactgctgagacagctgagcgccgccgccaaggtgaaggcccccagcggcctgcagggccccccccaggcccaccagttcatcagcctgctgctggaggagtacggcgccctgtgccagtag

SEQ ID NO: 21062 - DNA, 3021 bp, Artificial Sequence
  Description of Artificial Sequence: Synthetic coding sequence
atgaccatgaagaccaagcagagaatgctgaccgaggactgggagctgttcaagcagagaagattcatcgaggagcagctgaccaacaagaaggccgtgaccggcgagaacaacttcaccgacaccatgagacacatgctgagcagcagactgagcatgcccgactgccccaactgcaactacagaagaagatgcgcctgcgacgactgcagcctgagccacatcctgacctgcggcatcatggacccccccgtgaccgacgacatccacatccaccagctgcccctgcaggtggaccccgcccccgactacctggccgagagaagcccccccagcgtgagcagcgccagcagcggcagcggcagcagcagccccatcaccatccagcagcaccccagactgatcctgaccgacagcggcagcgcccccaccttctgcagcgacgacgaggacgtggcccccctgagcgccaagttcgccgacatctaccccctgagcaactacgacgacaccgaggtggtggccaacatgaacggcatccacagcgagctgaacggcggcggcgagaacatggccctgaaggacgagagcccccagatcagcagcaccagcagcagcagcagcgaggccgacgacgaggaggccgacggcgagagcagcggcgagccccccggcgcccccaaggaggacggcgtgctgggcagcagaagccccagaaccgaggagagcaaggccgacagccccccccccagctaccccacccagcaggccgagcaggcccccaacacctgcgagtgccacgtgtgcaagcaggaggccagcggcctgacccccagcgccatgaccgccggcgccctgccccccggccaccagttcctgagccccgagaagcccacccaccccgccctgcacctgtacccccacatccacggccacgtgcccctgcacaccgtgccccacctgcccagacccctgatccaccccaccctgtacgccaccccccccttcacccacagcaaggccctgccccccgcccccgtgcagaaccacaccaacaagcaccaggtgttcaacgccagcctgcaggaccacatctaccccagctgcttcggcaacacccccgagtggaacagcagcaagttcatcagcctgtggggcagcgaggtgatgaacgacaagaactggaaccccggcaccttcctgcccgacaccatcagcggcagcgagatcctgggccccaccctgagcgagaccagacccgaggccctgcccccccccagcagcaacgagacccccgccgtgagcgacagcaaggagaagaagaacgccgccaagaagaagtgcctgtacaacttccaggacgccttcatggaggccaacaaggtggtgatggccaccagcagcgccaccagcagcgtgagctgcaccgccaccaccgtgcagagcagcaacagccagttcagagtgagcagcaagagaccccccagcgtgggcgacgtgttccacggcatcagcaaggaggaccacagacacagcgcccccgccgcccccagaaacagccccaccggcctggcccccctgcccgccctgagccccgccgccctgagccccgccgccctgagccccgccagcaccccccacctggccaacctggccgcccccagcttccccaagaccgccaccaccacccccggcttcgtggacaccagaaagagcttctgccccgcccccctgccccccgccaccgacggcagcatcagcgccccccccagcgtgtgcagcgaccccgactgcgagggccacagatgcgagaacggcgtgtacgacccccagcaggacgacggcgacgagagcgccgacgaggacagctgcagcgagcacagcagcagcaccagcaccagcaccaaccagaaggagggcaagtactgcgactgctgctactgcgagttcttcggccacggcggcccccccgccgcccccaccagcagaaactacgccgagatgagagagaagctgagactgagactgaccaagagaaaggaggagcagcccaagaagatggaccagatcagcgagagagagagcgtggtggaccacagaagagtggaggacctgctgcagttcatcaacagcagcgagaccaagcccgtgagcagcaccagagccgccaagagagccagacacaagcagagaaagctggaggagaaggccagactggaggccgaggccagagccagagagcacctgcacctgcaggaggagcagagaagaagagaggaggaggaggacgaggaggaggaggaggacagattcaaggaggagttccagagactgcaggagctgcagaagctgagagccgtgaagaagaagaagaaggagagacccagcaaggactgccccaagctggacatgctgaccagaaacttccaggccgccaccgagagcgtgcccaacagcggcaacatccacaacggcagcctggagcagaccgaggagcccgagaccagcagccacagccccagcagacacatgaaccacagcgagcccagacccggcctgggcgccgacggcgacgccgccgaccccgtggacaccagagacagcaagttcctgctgcccaaggaggtgaacggcaagcagcacgagcccctgagcttcttcttcgacatcatgcagcaccacaaggagggcaacggcaagcagaagctgagacagaccagcaaggccagcagcgagcccgccagaagacccaccgagccccccaaggccaccgagggccagagcaagcccagagcccagaccgagagcaaggccaaggtggtggacctgatgagcatcaccgagcagaagagagaggagagaaaggtgaacagcaacaacaacaacaagaagcagctgaaccacatcaaggacgagaagagcaaccccacccccatggagcccaccagccccggcgagcaccagcagaacagcaagctggtgctggccgagagcccccagcccaagggcaagaacaagtag

SEQ ID NO: 21063 - DNA, 3636 bp, Artificial Sequence; identical to SEQ ID NO: 21057
  Description of Artificial Sequence: Synthetic coding sequence

SEQ ID NO: 21064 - DNA, 1347 bp, Artificial Sequence
  Description of Artificial Sequence: Synthetic coding sequence
atgaagggcggcaccctgggcggcatccccggcgagcccgccgtggaccacagagacgtggacgagctgctggagttcatcaacagcaccgagcccaaggtgcccaacagcgccagagccgccaagagagccagacacaagctgaagaagaaggagaaggagaaggcccagctggccgccgaggccctgaagcaggccaacagagtgagcggcagcagagagcccagacccgccagagagagactgctggagtggcccgacagagagctggacagagtgaacagcttcctgagcagcagactgcaggagatcaagaacaccgtgaaggacagcatcagagccagcttcagcgtgtgcgagctgagcatggacagcaacggcttcagcaaggagggcgccgccgagcccgagccccagagcctgccccccagcaacctgagcggcagcagcgagcagcagcccgacatcaacctggacctgagccccctgaccctgggcagcccccagaaccacaccctgcaggcccccggcgagcccgcccccccctgggccgagatgagaggcccccaccccccctggaccgaggtgagaggccccccccccggcatcgtgcccgagaacggcctggtgagaagactgaacaccgtgcccaacctgagcagagtgatctgggtgaagacccccaagcccggctaccccagcagcgaggagcccagcagcaaggaggtgcccagctgcaagcaggagctgcccgagcccgtgagcagcggcggcaagccccagaagggcaagagacagggcagccaggccaagaagagcgaggccagccccgcccccagaccccccgccagcctggaggtgcccagcgccaagggccaggtggccggccccaagcagcccggcagagtgctggagctgcccaaggtgggcagctgcgccgaggccggcgagggcagcagaggcagcagacccggccccggctgggccggcagccccaagaccgagaaggagaagggcagcagctggagaaactggcccggcgaggccaaggccagaccccaggagcaggagagcgtgcagcccagcggccccgccagaccccagagcctgccccagggcaagggcagaagcagaagaagcagaaacaagcaggagaagcccgccagcagcctggacgacgtgttcctgcccaaggacatggacggcgtggagatggacgagaccgacagagaggtggagtacttcaagagattctgcctggacagcgccaagcagaccagacagaaggtggccgtgaactggaccaacttcagcctgaagaagaccacccccagcaccgcccagtag

SEQ ID NO: 21065 - DNA, 2370 bp, Artificial Sequence
  Description of Artificial Sequence: Synthetic coding sequence
atgcccaagctggtgaagaacctgctgggcgagatgcccctgtgggtgtgccagagctgcagaaagagcatggaggaggacgagagacagaccggcagagagcacgccgtggccatcagcctgagccacaccagctgcaagagccagagctgcggcgacgacagccacagcagcagcagcagcagcagcagcagcagcagcagcagcagcagcagctgccccggcaacagcggcgactgggaccccagcagcttcctgagcgcccacaagctgagcggcctgtggaacagcccccacagcagcggcgccatgcccggcagcagcctgggcagcccccccaccatccccggcgaggccttccccgtgagcgagcaccaccagcacagcgacctgaccgccccccccaacagccccaccggccaccacccccagcccgccagcctgatccccagccaccccagcagcttcggcagccccccccacccccacctgctgcccaccacccccgccgcccccttccccgcccaggccagcgagtgccccgtggccgccgccaccgccccccacacccccggcccctgccagagcagccacctgcccagcaccagcatgcccctgctgaagatgcccccccccttcagcggctgcagccacccctgcagcggccactgcggcggccactgcagcggccccctgctgcccccccccagcagccagcccctgcccagcacccacagagaccccggctgcaagggccacaagttcgcccacagcggcctggcctgccagctgccccagccctgcgaggccgacgagggcctgggcgaggaggaggacagcagcagcgagagaagcagctgcaccagcagcagcacccaccagagagacggcaagttctgcgactgctgctactgcgagttcttcggccacaacgccccccccgccgcccccaccagcagaaactacaccgagatcagagagaagctgagaagcagactgaccagaagaaaggaggagctgcccatgaagggcggcaccctgggcggcatccccggcgagcccgccgtggaccacagagacgtggacgagctgctggagttcatcaacagcaccgagcccaaggtgcccaacagcgccagagccgccaagagagccagacacaagctgaagaagaaggagaaggagaaggcccagctggccgccgaggccctgaagcaggccaacagagtgagcggcagcagagagcccagacccgccagagagagactgctggagtggcccgacagagagctggacagagtgaacagcttcctgagcagcagactgcaggagatcaagaacaccgtgaaggacagcatcagagccagcttcagcgtgtgcgagctgagcatggacagcaacggcttcagcaaggagggcgccgccgagcccgagccccagagcctgccccccagcaacctgagcggcagcagcgagcagcagcccgacatcaacctggacctgagccccctgaccctgggcagcccccagaaccacaccctgcaggcccccggcgagcccgcccccccctgggccgagatgagaggcccccaccccccctggaccgaggtgagaggccccccccccggcatcgtgcccgagaacggcctggtgagaagactgaacaccgtgcccaacctgagcagagtgatctgggtgaagacccccaagcccggctaccccagcagcgaggagcccagcagcaaggaggtgcccagctgcaagcaggagctgcccgagcccgtgagcagcggcggcaagccccagaagggcaagagacagggcagccaggccaagaagagcgaggccagccccgcccccagaccccccgccagcctggaggtgcccagcgccaagggccaggtggccggccccaagcagcccggcagagtgctggagctgcccaaggtgggcagctgcgccgaggccggcgagggcagcagaggcagcagacccggccccggctgggccggcagccccaagaccgagaaggagaagggcagcagctggagaaactggcccggcgaggccaaggccagaccccaggagcaggagagcgtgcagcccagcggccccgccagaccccagagcctgccccagggcaagggcagaagcagaagaagcagaaacaagcaggagaagcccgccagcagcctggacgacgtgttcctgcccaaggacatggacggcgtggagatggacgagaccgacagagaggtggagtacttcaagagattctgcctggacagcgccaagcagaccagacagaaggtggccgtgaactggaccaacttcagcctgaagaagaccacccccagcaccgcccagtag

SEQ ID NO: 21066 - DNA, 1992 bp, Artificial Sequence
  Description of Artificial Sequence: Synthetic coding sequence
atggcccacctgagaagccccagcggcttcggcgaccccggcaagaaggaccagaaggagagcgaggaggagctggaggaggaggaggaggaggaggaggtggaggaggaggaggaggaggtggaggaggaggaggaggaggtggaggaggaggaggaggaggtggtggaggaggagctggtgggcgaggagcaggagctggaggcccccgagaccttcagcgaggagtacctgtggaaggtgaccgacatcggcgactacgacgacgacttccccgacgtgagacccagactggccagcatcgtgagccccagcctgaccagcaccttcgtgcccagccagagcgccaccagcaccgagacccccagcgccagcccccccagcagcaccagcagccacaagagcttccccaagatcttccagaccttcagaaaggacatgagcgagatgagcatcgacagaaacatccacagaaacctgagccccggcatccccgtgagcgtgcagaccgaggagagctggctgcaggacctgagcgacaaggtgcagagcagaaagaaggccagcaaggagaaggccgagcccgagtgcctggccagcaagctgagagagaagtgggtgatcaaccccgaggagagcaagctgaacatcctgtacgagctggagttcaaggaggacttcatcaccctgttcgagcccagcctgagaaccctgcccagcatcggcccccccagcatcctggcctacaaggaggagagcagcaacctgggcatcaacttcaaggacgaggaggaggagaccagccccaagtgcgagttctgcggcagcgacctgagagccttcttcagcaacgtggacgtgagcagcgagcccaagggccacgccagctgctgcatcgccttccagaacctgatcgactacatctacgaggagcagatcaagaccaagccccccaaggccgagctgatcgccatcgacccccacgccgcccacggcagcgaggtggacagactgaaggccaaggagaaggccctgcagagaaagcaggagcagagaatggccagacacttcgccatcatcagcagagagcagacccacttcagcgaggacgacagcaagagactgaagaccatcagctaccagctgagcgtggacatccccgagaagcagatcatcgacgacatcgtgttcgacttccagctgagaaacagcaacatgagcatcatctgctgcgacagcagaatcgcctgcggcaaggtggtgagaaacgagctgctggagaagcactacaagcacggcagcaagttcctgaccagcttccccgacggcaccacccagatcttctaccccagcggcaacctggccatcatcagagtgcccaacaaggtgaacggcttcacctgcatcgtgcaggaggacatgcccaccaaccccgccatcctggccgtgctggacagcagcggcagaagcagctgctaccaccccaacggcaacgtgtgggtgtacatcaacatcctgggcggccagtacagcgaccaggccggcaacagaatcagagcctggaactggagcaacagcatcaccagcagccccttcgtgagcttcaagcccgtgttcctggccctgaacagatacatcggcgtgagaatcctggagcaggacaagatcagcatcaccttcctggccatgggccagcaggccagaatcagcgtgggcaccaaggtgaagctgcccaaccccgaggagatccccatcctgagatacgtgagcggcgacgacctgctgctgctggccagcctgatcaagatcagaagactgttccacaagctggagggctgcgtgaacttccccagcagccaggtgtgggagaagctgaagcagcccagctacctgagcagcctgagcctgaagctgatcgccctgtgccacagcagcggcatcaagcaggacatcatgaagaccatcagaaacatcatcaacgaggagatctag

SEQ ID NO: 21067 - DNA, 1866 bp, Artificial Sequence
  Description of Artificial Sequence: Synthetic coding sequence
atggcccacctgagaagccccagcggcttcggcgaccccggcaagaaggaccagaaggagagcgagcaggagctggaggcccccgagaccttcagcgaggagtacctgtggaaggtgaccgacatcggcgactacgacgacgacttccccgacgtgagacccagactggccagcatcgtgagccccagcctgaccagcaccttcgtgcccagccagagcgccaccagcaccgagacccccagcgccagcccccccagcagcaccagcagccacaagagcttccccaagatcttccagaccttcagaaaggacatgagcgagatgagcatcgacagaaacatccacagaaacctgagccccggcatccccgtgagcgtgcagaccgaggagagctggctgcaggacctgagcgacaaggtgcagagcagaaagaaggccagcaaggagaaggccgagcccgagtgcctggccagcaagctgagagagaagtgggtgatcaaccccgaggagagcaagctgaacatcctgtacgagctggagttcaaggaggacttcatcaccctgttcgagcccagcctgagaaccctgcccagcatcggcccccccagcatcctggcctacaaggaggagagcagcaacctgggcatcaacttcaaggacgaggaggaggagaccagccccaagtgcgagttctgcggcagcgacctgagagccttcttcagcaacgtggacgtgagcagcgagcccaagggccacgccagctgctgcatcgccttccagaacctgatcgactacatctacgaggagcagatcaagaccaagccccccaaggccgagctgatcgccatcgacccccacgccgcccacggcagcgaggtggacagactgaaggccaaggagaaggccctgcagagaaagcaggagcagagaatggccagacacttcgccatcatcagcagagagcagacccacttcagcgaggacgacagcaagagactgaagaccatcagctaccagctgagcgtggacatccccgagaagcagatcatcgacgacatcgtgttcgacttccagctgagaaacagcaacatgagcatcatctgctgcgacagcagaatcgcctgcggcaaggtggtgagaaacgagctgctggagaagcactacaagcacggcagcaagttcctgaccagcttccccgacggcaccacccagatcttctaccccagcggcaacctggccatcatcagagtgcccaacaaggtgaacggcttcacctgcatcgtgcaggaggacatgcccaccaaccccgccatcctggccgtgctggacagcagcggcagaagcagctgctaccaccccaacggcaacgtgtgggtgtacatcaacatcctgggcggccagtacagcgaccaggccggcaacagaatcagagcctggaactggagcaacagcatcaccagcagccccttcgtgagcttcaagcccgtgttcctggccctgaacagatacatcggcgtgagaatcctggagcaggacaagatcagcatcaccttcctggccatgggccagcaggccagaatcagcgtgggcaccaaggtgaagctgcccaaccccgaggagatccccatcctgagatacgtgagcggcgacgacctgctgctgctggccagcctgatcaagatcagaagactgttccacaagctggagggctgcgtgaacttccccagcagccaggtgtgggagaagctgaagcagcccagctacctgagcagcctgagcctgaagctgatcgccctgtgccacagcagcggcatcaagcaggacatcatgaagaccatcagaaacatcatcaacgaggagatctag

SEQ ID NO: 21068 - DNA, 2091 bp, Artificial Sequence
  Description of Artificial Sequence: Synthetic coding sequence
atgagcgccgagaacaaccagctgagcggcgccagccccccccacccccccaccaccccccagtacagcacccagaacctgcccagcgagaaggaggacaccgaggtggagctggacgaggagagcctgcaggacgagagccccttcagccccgagggcgagagcctggaggacaaggagtacctggaggaggaggaggacctggaggaggaggagtacctgggcaaggaggagtacctgaaggaggaggagtacctgggcaaggaggagcacctggaggaggaggagtacctggagaaggccggctacctggaggaggaggagtacatcgaggaggaggagtacctgggcaaggagggctacctggaggaggaggagtacctgggcaaggaggagcacctggaggaggaggagtacctgggcaaggagggctacctggagaaggaggactacatcgaggaggtggactacctgggcaagaaggcctacctggaggaggaggagtacctgggcaagaagagctacctggaggaggagaaggccctggagaaggaggagaacctggaggaggaggaggccctggagaaggaggagaacctggacggcaaggagaacctgtacaagaagtacctgaaggagcccaaggccagctacagcagccagaccatgctgctgagagacgccagaagccccgacgccggccccagccaggtgaccaccttcctgaccgtgcccctgaccttcgccacccccagccccgtgagcgagagcgccaccgagagcagcgagctgctgctgaccctgtacagaagaagccaggccagccagaccgactggtgctacgacagaaccgccgtgaagagcctgaagagcaagagcgagaccgagcaggagaccaccaccaagctggcccccgaggagcacgtgaacaccaaggtgcagcagaagaaggaggagaacgtgctggagttcgccagcaaggagaacttctgggacggcatcaccgacgagagcatcgacaagctggaggtggaggacctggacgagaacttcctgaacagcagctaccagaccgtgttcaagaccatcatcaaggagatggccgcccacaacgagctggaggaggacttcgacatccccctgaccaagctgctggagagcgagaacagatggaagctggtgatcatgctgaagaagaactacgagaagttcaaggagaccatcctgagaatcaagagaagaagagaggcccagaagctgaccgagatgaccagcttcaccttccacctgatgagcaagcccacccccgagaagcccgagaccgaggagatccagaagccccagagagtggtgcaccacagaaagaagctggagagagacaaggagtggatccagaagaagaccgtggtgcaccagggcgacggcaagctgatcctgtaccccaacaagaacgtgtaccagatcctgttccccgacggcaccggccagatccactaccccagcggcaacctggccatgctgatcctgtacgccaagatgaagaagttcacctacatcatcctggaggacagcctggagggcagaatcagagccctgatcaacaacagcggcaacgccaccttctacgacgagaacagcgacatctggctgaacctgagcagcaacctgggctactacttccccaaggacaagagacagaaggcctggaactggtggaacctgaacatccacgtgcacgccccccccgtgcagcccatcagcctgaagatcaacgagtacatccaggtgcagatcagaagccaggacaagatcatcttctgcttcacctacgagcagaagcagatctgcctgaacctgggcaccagatacaagttcgtgatccccgaggtgctgagcgagatgaagaagaagaccatcctggaggccgagcccggccccaccgcccagaagatcagagtgctgctgggcaagatgaacagactgctgaactacgccaccacccccgacctggagaacttcatcgaggccgtgagcatcagcctgatggacaacaagtacctgaagaagatgctgagcaagctgtggttctag

SEQ ID NO: 21069 - DNA, 483 bp, Artificial Sequence
  Description of Artificial Sequence: Synthetic coding sequence
atgtacaccatcaccaagggccccagcaagctggtggcccagagaagaaccggccccacccagcagcaggtggagggcagactgggcgagctgctgaagtgcagacagcccgccccccccaccagccagccccccagagcccagcccttcgcccagccccccggcccctggcccctgagcagccccggccccagactggtgttcaacagagtgaacggcagaagagcccccagcaccagccccagcttcgagggcacccaggagacctacaccgtggcccacgaggagaacgtgagattcgtgagcgaggcctggcagcaggtgcagcagcagctggacggcggccccgccggcgagggcggccccagacccgtgcagtacgtggagagaacccccaaccccagactgcagaacttcgtgcccatcgacctggacgagtggtgggcccagcagttcctggccagaatcaccagctgcagctag

SEQ ID NO: 21070 - DNA, 585 bp, Artificial Sequence
  Description of Artificial Sequence: Synthetic coding sequence
atgtacaccatcaccaagggccccagcaagctggtggcccagagaagaaccggccccacccagcagcaggtggagggcagactgggcgagctgctgaagtgcagacagcccgccccccccaccagccagccccccagagcccagcccttcgcccagccccccggcccctggcccctgagcagccccggccccagactggtgttcaacagagtgaacggcagaagagcccccagcaccagccccagcttcgagggcacccaggagacctacaccgtggcccacgaggagaacgtgagattcgtgagcgaggcctggcagcaggtgcagcagcagctggacggcggccccgccggcgagggcggccccagacccgtgcagtacgtggagagaacccccaaccccagactgcagaacttcgtgcccatcgacctggacgagtggtgggccgccgtgcccggcgagaaccaccagctgttcctggtggccgccggcagaggcagatgctacaccgccgacctgagccccggcgagaagcacggcgccctgcccacccactgcgcctggctgggcgccggccacacctag

SEQ ID NO: 21071 - DNA, 294 bp, Artificial Sequence
  Description of Artificial Sequence: Synthetic coding sequence
atgaccagcagccccgtgagcagagtggtgtacaacggcaagagaaccagcagccccagaagcccccccagcagcagcgagatcttcacccccgcccacgaggagaacgtgagattcatctacgaggcctggcagggcgtggagagagacctgagaggccaggtgcccggcggcgagagaggcctggtggaggagtacgtggagaaggtgcccaaccccagcctgaagaccttcaagcccatcgacctgagcgacctgaagagaagaagcacccaggacgccaagaagagctag

SEQ ID NO: 21072 - DNA, 294 bp, Artificial Sequence; identical to SEQ ID NO: 21071
  Description of Artificial Sequence: Synthetic coding sequence

SEQ ID NO: 21073 - DNA, 1440 bp, Artificial Sequence
  Description of Artificial Sequence: Synthetic coding sequence
atggtgagcaaggacaccggcaagtgcatcctgaccaccagcgagagcgaggtggagcccgccgcctgcctggccctggagatgaagtacgccctggaccccaacagacagatcaagaagagaaacaaggccctgcaggtgagattcaaggacatctgcgaggcccagaacgagcagagagacacccagctgagcagcggccagctgggcgagaagagagaggccaagcccgtgagctgcagagccgcctacagaaagtacatgaccgtgcccgccagaagaagcatccccaacgtgaccaagagcaccggcgtgcagaccagccccgacctgaagaagtgctaccagaccttccccctggacagaaagaagggcaacctgaagagcctgcccgccgccgaccccttcaagagccagaacaacggcttcctgaccgacgccaaggagaagaacgaggccggccccatggaggaggccagaccctgcggcgccggcagagtgcacaagaccaccgccctggtgttccacagcaaccagcacatgaacaccgtggaccagcccctgggcgtgaactgcaccgagccctgcaagagccccgagcccctgagctacggcgaggccgccctgcagaacagcaccagaccccccagcgaggagcccgactaccagctgctgggcagagccaagcaggacagaggcagacccaacagcgaggagcccgccccccccgccctgagaagagtgttcaagaccgaggtggccaccgtgtacgcccccgccctgagcgccagagcccccgagcccggcctgagcgacagcgccgccgccagccagtggagcctgtgccccgccgacgacgagagaagaagagccacccacctgaacggcctgcaggcccccagcgagaccgccctggcctgcagcccccccatgcagtgcctgagccccgagtgcagcgagcagcccagccagacccacaccccccccggcctgggcaaccagcccagccccaccgccgtggccgccggcgaggagtgccagagaatcgtgccccacaccgaggtggtggacctgaaggcccagctgcagatgatggagaacctgatcagcagcagccaggagaccatcaaggtgctgctgggcgtgatccaggagctggagaagggcgaggcccacagagagggcctgagctacagaaccggccaggacaccgccaactgcgacacctgcagaaacagcgcctgcatcatctacagcgtggagctggacttcaagcagcaggaggacaagctgcagcccgtgctgagaaagctgcaccccatcgaggagacccaggtgatccccagcccctacagccaggagacctacagcagcacccccaagcagaagagcaagaccgagagcaagaagcacggcagatggaagctgtggttcctgtag

SEQ ID NO: 21074 - DNA, 1608 bp, Artificial Sequence
  Description of Artificial Sequence: Synthetic coding sequence
atggcccagcagaacatgaaggtgagacccgtgctgctgaagagaaacagcctggagagcgtggagttcgtgaagcagccccaccacagaagaagcaagagccagcaggtgagattcaaggaggacggcaccaccaagaaccccaccggcctggccgaggtggacgtgcagacccccgaggaccccgccgtgatgggcaagacccaggccaccagacaccacctgccccccacctacagcctgagcttccccagaagccagaaggccggcggcttcagaaacatcgccatccagaccagccccagcctgagaaagcacttccccgtgttcaagagaaagagactgaccgccagcaagagcctggtggagatgcccaccgccagccagagcgccatccaggtgaacggcaacctgagcgagcaggacatcgtgagcagcgacctggcctacctgagactggcccagcacctggaggacggccccagaagagtgaaggtgagccacgccttcctgcccagagtgcccaaggtgcagagcaacggccccgtgagcatctgcctggaggccggcacctggagaagcctggagaaggccaccgccgccatccaggtgcccgacgacatctaccacagccccagctgggaggccagagagagcgccctgagccccgacagaagcgccgaggtgagcaacagcatccaccccctggacgacaccagacccggcgacggcagaagagtgacccccctggacagcgagaagagcaccagctgcctgaacgccaccagcgtggccagccacacccccggcaccgaggagctgaagcccgagctgctgctgcccaaggacaacagcgacgacaaggacctgggcagcctgagcagccagagcaaggagacctgcgtgcccagcagccccagaacccacagcagccccagccagggcagccacagccagcccgcccaccccggcagagccagcgactgccccagcagcagcaacaaccaccagaacctggtgagcctgaagaccaacagcgccagcaagagcgcccccggctgccaggagcagaccgccaacaaccccaccgagagcgacaccctggagttccccaactgccccggcagcaaccacctgcccagcagcctgagcagaagcgagaccaagctgcagagcaacagagagatcagcgacatcaaccagatccacctggccagaggcgagctgtgcgacctgcagggcagactgcagagcgtggaggagagcctgcacagcaaccaggagaagatcaaggtgctgctgaacgtgatccaggacctggagaaggccagagccctgaccgagggcagaaacttctacagaaccggccaggacctgaacaactgcagcacctgccagaacaccgcctgcatcatctacagcgtggagtacgacttcagacagcaggagggcagattccacgaggtgctgcagagcctggaggaggccgagcccgtggaggaggccagccccccccccaagagccccgccgagccccccgcccccgagaagcaggacctgagaagaaagaccaagaaggtgaagaagaagtgcttctggtggatctag

SEQ ID NO: 21075 - DNA, 1167 bp, Artificial Sequence
  Description of Artificial Sequence: Synthetic coding sequence
atgagcgacgaggccagcgccatcaccagctacgagaagttcctgacccccgaggagcccttccccctgctgggcccccccagaggcgtgggcacctgccccagcgaggagcccggctgcctggacatcagcgacttcggctgccagctgagcagctgccacagaaccgaccccctgcacagattccacaccaacagatggaacctgaccagctgcggcaccagcgtggccagcagcgagggcagcgaggagctgttcagcagcgtgagcgtgggcgaccaggacgactgctacagcctgctggacgaccaggacttcaccagcttcgacctgttccccgagggcagcgtgtgcagcgacgtgagcagcagcatcagcacctactgggactggagcgacagcgagttcgagtggcagctgcccggcagcgacatcgccagcggcagcgacgtgctgagcgacgtgatccccagcatccccagcagcccctgcctgctgcccaagaagaagaacaagcacagaaacctggacgagctgccctggagcgccatgaccaacgacgagcaggtggagtacatcgagtacctgagcagaaaggtgagcaccgagatgggcctgagagagcagctggacatcatcaagatcatcgaccccagcgcccagatcagccccaccgacagcgagttcatcatcgagctgaactgcctgaccgacgagaagctgaagcaggtgagaaactacatcaaggagcacagccccagacagagacccgccagagaggcctggaagagaagcaacttcagctgcgccagcaccagcggcgtgagcggcgccagcgccagcgccagcagcagcagcgccagcatggtgagcagcgccagcagcagcggcagcagcgtgggcaacagcgccagcaacagcagcgccaacatgagcagagcccacagcgacagcaacctgagcgccagcgccgccgagagaatcagagacagcaagaagagaagcaagcagagaaagctgcagcagaaggccttcagaaagagacagctgaaggagcagagacaggccagaaaggagagactgagcggcctgttcctgaacgaggaggtgctgagcctgaaggtgaccgaggaggaccacgaggccgacgtggacgtgctgatgtag

SEQ ID NO: 21076 - DNA, 1974 bp, Artificial Sequence
  Description of Artificial Sequence: Synthetic coding sequence
atggaccacttcttcatcaagagaaagagaaacagcgaggtgaagtacaccgaggcctgcagcagcagcagcgtggagagcggcatcgtgaacagcgacaacatcgagaagaacaccgacagcaacctgcagaccagcaccagcttcgagccccacttcaagaagaagaaggtgagcgccagaagatacaacgaggactacctgaagtacggcttcatcaagtgcgagaagcccttcgagaacgacagaccccagtgcgtgatctgcaacaacatcctggccaacgagagcctgaagcccagcaagctgaagagacacctggagacccagcacgccgagctgatcgacaagcccctggagtacttccagagaaagaagaaggacatcaagctgagcacccagttcctgagctgcagcaccgccgtgagcgagaaggccctgctgagcagctacctggtggcctacagagtggccaaggagaagatcgccaacaccgccgccgagaagatcatcctgcccgcctgcctggacatggtgagaaccatcttcgacgacaagagcgccgacaagctgaagaccatccccaacgacaacaccgtgagcctgagaatctgcaccatcgccgagcacctggagaccatgctgatcaccagactgcagagcggcatcgacttcgccatccagctggacgagagcaccgacatcggcagctgcaccaccctgctggtgtacgtgagatacgcctggcaggacgacttcctggaggacttcctgtgcttcctgaacctgaccagccacctgagcggcctggacatcttcaccgagctggagagaagaatcgtgggccagtacaagctgaactggaagaactgcaagggcatcaccagcgacggcaccgccaccatgaccggcaagcacagcagagtgatcaagaagctgctggaggtgaccaacaacggcgccgtgtggaaccactgcttcatccacagagagggcctggccagcagagagatcccccagaacctgatggaggtgctgaagaacgccgtgaaggtggtgaacttcatcaagggcagcagcctgaacagcagactgctggagaccttctgcagcgagatcggcaccaaccacacccacctgctgtaccacaccaagatcagatggctgagccagggcaagatcctgagcagagtgtacgagctgagaaacgagatccacttcttcctgatcgagaagaagagccacctggccagcatcttcgaggacgacacctgggtgaccaagctggcctacctgaccgacatcttcagcatcctgaacgagctgagcctgaagctgcagggcaagaacagcgacgtgttccagcacgtggagagaatccagggcttcagaaagaccctgctgctgtggcaggtgagactgaagagcaacagacccagctactacatgttccccagattcctgcagcacatcgaggagaacatcatcaacgagaacatcctgaaggagatcaagctggagatcctgctgcacctgaccagcctgagccagaccttcaaccacttcttccccgaggagaagttcgagaccctgagagagaacagctgggtgaaggaccccttcgccttcagacaccccgagagcatcatcgagctgaacctggtgcccgaggaggagaacgagctgctgcagctgagcagcagctacaccctgaagaacgactacgagaccctgagcctgagcgccttctggatgaaggtgaaggaggacttccccctgctgagcagaaagagcgtgctgctgctgctgcccttcaccaccaccagcctgtgcgagctgggcttcagcatcctgacccagctgaagaccaaggagagaaacggcctgaactgcgccgccgtgatgagagtggccctgagcagctgcgtgcccgactggaacgagctgatgaacagacaggcccaccccagctag

SEQ ID NO: 21077 - DNA, 468 bp, Artificial Sequence
  Description of Artificial Sequence: Synthetic coding sequence
atgggcctgagagccggcagcagatgcagagccgaccacctggcccagccccagccccagggccacctggcccccgtgctgagatgcggcgagtgctggagagccagaggcctgcccggcggctgctgcctgcacaccgagggcggctgcagcctgggcgcccaggccggctggagaaccgccggctgggaggccagaggcagaagagacctgggcctggagaccaccagcgcccacagcagaagcctgctgcacctgagcagctggagaagacccgacgtgggcgaggccgccggcgccgagctgctgcagagagcccccctgcagcagcccgaccccgcccaggccgccgtggagggcggcctgctggccagactgcccagaccccaggaccagggctgcggccagcacagaccccacagccccagactggtggacatcgccctgcccggcggcggctggacctag

SEQ ID NO: 21078 - DNA, 1173 bp, Artificial Sequence
  Description of Artificial Sequence: Synthetic coding sequence
atgggcgaggccggcgccggcgccggcgccagcggcggccccgaggccagccccgaggccgaggtggtgaagctgctgcccttcctggcccccggcgccagagccgacctgcaggccgccgccgtgagacacgtgctggccctgaccggctgcggccccggcagagccctgctggccggccaggccgccctgctgcaggccctgatggagctggcccccgccagcgcccccgccagagacgccgccagagccctggtgaacctggccgccgaccccggcctgcacgagaccctgctggccgccgaccccggcctgcccgccagactgatgggcagagccctggacccccagtggccctgggccgaggaggccgccgccgccctggccaacctgagcagagagcccgccccctgcgccgccctgatggccgccctggccgccgccgagcccgccgacagcggcctggagagactggtgagagccctgtgcacccccggctacaacgccagagcccccctgcactacctggcccccctgctgagcaacctgagccagagacccgccgccagagccttcctgctggaccccgacagatgcgtggtgcagagactgctgcccctgacccagtaccccgacagcagcgtgagaagaggcggcgtggtgggcaccctgagaaactgctgcttcgagcacagacaccacgagtggctgctgggccccgaggtggacatcctgcccttcctgctgctgcccctggccggccccgaggacttcagcgaggaggagatggagagactgcccgtggacctgcagtacctgccccccgacaagcagagagagcccgacgccgacatcagaaagatgctggtggaggccatcatgctgctgaccgccaccgcccccggcagacagcaggtgagagaccagggcgcctacctgatcctgagagagctgcacagctgggagcccgagcccgacgtgagaaccgcctgcgagaagctgatccaggtgctgatcggcgacgagcccgagagaggcatggagaacctgctggaggtgcaggtgcccgaggacgtggagcagcagctgcagcagctggactgcagagagcaggagcagctggagagagagctggcccccgagccctgggtggagagagccacccccacctag

SEQ ID NO: 21079 - DNA, 1173 bp, Artificial Sequence
  Description of Artificial Sequence: Synthetic coding sequence
atgggcgaggccggcgccggcgccggcgccagcggcggccccgaggccagccccgaggccgaggtggtgaagctgctgcccttcctggcccccggcgccagagccgacctgcaggccgccgccgtgagacacgtgctggccctgaccggctgcggccccggcagagccctgctggccggccaggccgccctgctgcaggccctgatggagctggcccccgccagcgcccccgccagagacgccgccagagccctggtgaacctggccgccgaccccggcctgcacgagaccctgctggccgccgaccccggcctgcccgccagactgatgggcagagccctggacccccagtggccctgggccgaggaggccgccgccgccctggccaacctgagcagagagcccgccccctgcgccgccctgatggccgccctggccgccgccgagcccgccgacagcggcctggagagactggtgagagccctgtgcacccccggctacaacgccagagcccccctgcactacctggcccccctgctgagcaacctgagccagagacccgccgccagagccttcctgctggaccccgacagatgcgtggtgcagagactgctgcccctgacccagtaccccgacagcagcgtgagaagaggcggcgtggtgggcaccctgagaaactgctgcttcgagcacagacaccacgagtggctgctgggccccgaggtggacatcctgcccttcctgctgctgcccctggccggccccgaggacttcagcgaggaggagatgcagagactgcccgtggacctgcagtacctgccccccgacaagcagagagagcccgacgccgacatcagaaagatgctggtggaggccatcatgctgctgaccgccaccgcccccggcagacagcaggtgagagaccagggcgcctacctgatcctgagagagctgcacagctgggagcccgagcccgacgtgagaaccgcctgcgagaagctgatccaggtgctgatcggcgacgagcccgagagaggcatggagaacctgctggaggtgcaggtgcccgaggacgtggagcagcagctgcagcagctggactgcagagagcaggagcagctggagagagagctggcccccgagccctgggtggagagagccacccccacctag

SEQ ID NO: 21080 - DNA, 456 bp, Artificial Sequence
  Description of Artificial Sequence: Synthetic coding sequence
atgtggagcggcctgctgccccccggcctgaacgagagcgacgccgagagcaacagcgaggacgaggccaccctggagaacagcggcctgaacctgcaggaggacaaggaggacgagagcatcagaaagaccgagatcatcgacttcagcaccgacgagcccaagaccgagaccgagagcaacgtgaacgcctacgaggagtgccccagcggcatccccatcgacatgtggaacaagttccaggagctgcacaagaagcacagcgagcagaagagcaccaccagcagattcagaggcaagagaagaaagagaagcagaaaggacaagctgaagaacgagaaggagctgcacagcgagcccagcagcaacgagacccagtggaaggagctgacccagtacttcggcgtgaacgacagattcgacccccccgtgaagagaaagaaggtggagaagtag

SEQ ID NO: 21081 - DNA, 702 bp, Artificial Sequence
  Description of Artificial Sequence: Synthetic coding sequence
atgtggagcggcctgctgccccccggcctgaacgagagcgacgccgagagcaacagcgaggacgaggccaccctggagaacagcggcctgaacctgcaggaggacaaggaggacgagagcatcagaaagaccgagatcatcgacttcagcaccgacgagcccaagaccgagaccgagagcaacgtgaacgcctacgaggagtgccccagcggcatccccatcgacatgtggaacaagttccaggagctgcacaagaagcacagcgagcagaagagcaccaccagcagattcagaggcaagagaagaaagagaagcagaaaggacaagctgaagaacgagaaggagctgcacagcgagcccagcagcaacgagacccagtggaaggagctgacccagtacttcggcgtgaacgacagattcgacccccccgtgaagagaaagaaggtggagaagagcggcctggagaagagaatcgaccaggccgtggaggagtggaacatcgagaaggccgaggagctgagcaaccagctggccaccagagagctgggcgtgaagatcgccaaggccgtggcctgccacaacttcgtgaaggccaagaaggaggtggagaacagccaggccgccagaaagaagaagaagctggcctggggcttcgaggccaagaagagatgggagaccaagagcaacatgggctacatgtag

SEQ ID NO: 21082 - DNA, 702 bp, Artificial Sequence; identical to SEQ ID NO: 21081
  Description of Artificial Sequence: Synthetic coding sequence

SEQ ID NO: 21083 - DNA, 417 bp, Artificial Sequence
  Description of Artificial Sequence: Synthetic coding sequence
atgctgagccccaccttcgtgctgtgggacgtgggctaccccctgtacacctacggcagcatcttcatcgtgatcgtgatcatctggcaggtgaagagaagccaccacgagctgaacctggaggtggagagaagctgctgctggagacaccagaaggtgagacagagagccagagacgccgccagcaccgccagaagactgagccaggaggaggaccagaagccccaggagctgttcagcgtgatgaagagagccggcttcccccagagagaggtgtgcggcgagagctacgtgcagatccccgtggccaagttcgccatgctgtggctgtggagattcagcagctgctggagaatgagaatgaccagaagcccccagctgtgcagaggcgtgcaccacagaagccccctggcctag

SEQ ID NO: 21084 - DNA, 693 bp, Artificial Sequence
  Description of Artificial Sequence: Synthetic coding sequence
atgggcaaggtgagaggcctgagagccagagtgcaccaggccgccgtgagacccaagggcgaggccgcccccggccccgccccccccgcccccgaggccacccccccccccgccagcgccgccggcaaggactgggccttcatcaacaccaacatcttcgccagaaccaagatcgaccccagcgccctggtgcagaagctggagctggacgtgagaagcgtgaccagcgtgagaagaggcgaggccggcagcagcgccagaagcgtgcccagcatcagaagaggcgccgaggccaagaccgtgctgcccaagaaggagaagatgaagctgagaagagagcagtggctgcagaagatcgaggccatcaagctggccgagcagaagcacagagaggagagaagaagaagagccaccgtggtggtgggcgacctgcaccccctgagagacgccctgcccgagctgctgggcctggaggccggcagcagaagacaggccagaagcagagagagcaacaagcccagacccagcgagctgagcagaatgagcgccgcccagagacagcagctgctggaggaggagagaaccagattccaggagctgctggccagccccgcctacagagccagccccctggtggccatcggccagaccctggccagacagatgcagctggaggacggcggccagctgtag

SEQ ID NO: 21085 - DNA, 648 bp, Artificial Sequence
  Description of Artificial Sequence: Synthetic coding sequence
atgggcaaggtgagaggcctgagagccagagtgcaccaggccgccgtgagacccaagggcgaggccgcccccggccccgccccccccgcccccgaggccacccccccccccgccagcgccgccggcaaggactgggccttcatcaacaccaacatcttcgccagaaccaagatcgaccccagcgccctggtgcagaagctggagctggacgtgagaagcgtgaccagcgtgagaagaggcgccgaggccaagaccgtgctgcccaagaaggagaagatgaagctgagaagagagcagtggctgcagaagatcgaggccatcaagctggccgagcagaagcacagagaggagagaagaagaagagccaccgtggtggtgggcgacctgcaccccctgagagacgccctgcccgagctgctgggcctggaggccggcagcagaagacaggccagaagcagagagagcaacaagcccagacccagcgagctgagcagaatgagcgccgcccagagacagcagctgctggaggaggagagaaccagattccaggagctgctggccagccccgcctacagagccagccccctggtggccatcggccagaccctggccagacagatgcagctggaggacggcggccagctgtag

SEQ ID NO: 21086 - DNA, 4539 bp, Artificial Sequence
  Description of Artificial Sequence: Synthetic coding sequence
atggccaccgccgtggagaccgaggcctgccagcccaccgacgccagctgggagagcggcggcggcggcgacgacgagatgaagcaggccctgcccgagctggagagcagccagcagaacggcggcggcggcggcctgaacatcgccgagcccagcggcggcgccggcagagaggagaacgccggcgccgaggccgcccagagcctgagccacgagcagccccaggacagcagcgaggccggcgccgccgccctgcccagaggccccgaggagcccgagagacccgtgagaagaagcttccagatccccagaaagagcagagagaagaaggccctgttccagcccctgacccccggcagcagagagttcgaggacgtggtgaacatcctgcacagcagctacctggagcccaccagcgtgaccaacttcaactacagaagagcctgcctggtgcacaacgagctgctggagaaggagttcaccgagaagagaagagagctgaagttcgacggcagactggacaaggagctgagcgagagctacgccttcctgatggtggacagataccaggtgcagaccatctgcgagaagggcctgcacgtgggccagagcaagatcaccatcctgggcagccccagcatgggcgtgtacctgagcagatacgccgacctgctgcaggccaaccccctggacaccggcgccatgggcgacgtggtgatcttcaagatcatgaagggcaagatcaagagcatctacgaccccatgggcgtgaagagcctggagagcatgctgaacaagagcgccctggaccccacccccaagcacgagtgccacgtgagcaagaacgccaacagaatcaccagcctgctggcctacagagcctacgagctgacccagtactacttctacgagtacggcttcgacgagctgagaagaagacccagacacgtgtgcccctacgccgtggtgagcttcacctacaaggacgacatccagacccccaagttcgtgcccagcagcagaagcaacagcttcaacaccgacagaaacatcgacaagtacaactacaccctgtggaagggccagctgctgaacaagggcaagctgctgtgctacatcagcctgagaagcgccaccagagccttcctgcccatcaagctgcccgagaagctggacgtggagaccgtgatgagcatcgaccacctgaagcagaagatcccccccgccctgttctacaaggagacctacctgggccccaacgaggtgctgaagaacggcatgtactgcagcctgtacgaggtggtggagaagaccagaatcggcagcaacatggagagcctgctgcagaagctggacagagagaagctggtgctggtgaagcccctgggcgacagaggctacctgttcctgctgagcccctaccagatggtgcccccctacgagtaccagaccgccaagagcagagtgctgcacgccctgttcctgttccaggagcccagaagcatcgtgaccagccagaagggcagcaccaacgccgccccccaggagagacacgagagcatgcccgacgtgctgaagatcgcccagttcctgcagttcagcctgatccagtgcagaaaggagttcaagaacatcagcgccatcaacttccacagcgtggtggagaagtacgtgagcgagttcttcaagagaggcttcggcagcggcaagagagagttcatcatgttcccctacgacagcagactggacgacaagaagttcctgtacagcgcccccagaaacaagagccacatcgacacctgcctgcacgcctacatcttcagacccgaggtgtaccagctgcccatctgcaagctgaaggagctgttcgaggagaacagaaagctgcagcagttcagccccctgagcgactacgagggccaggaggaggagatgaacggcaccaagatgaagttcggcaagagaaacaacagcagaggcgaggccatcatcagcggcaagcagagaagcagccacagcctggactacgacaaggacagagtgaaggagctgatcaacctgatccagtgcagaaagaagagcgtgggcggcgacagcgacaccgaggacatgagaagcaagaccgtgctgaagagaaagctggaggacctgcccgagaacatgagaaagctggccaagaccagcaacctgagcgagaactgccacctgtacgaggagagcccccagcccatcggcagcctgggccacgacgccgacctgagaagacagcagcaggacacctgcaacagcggcatcgccgacatccacagactgttcaactggctgagcgagaccctggccaacgccagacacagcgacgccagcctgaccgacaccgtgaacaaggccctgggcctgagcaccgacgacgcctacgaggagctgagacagaagcacgagtacgagctgaacagcacccccgacaagaaggactacgagcagcccacctgcgccaaggtggagaacgcccagttcaagggcacccagagcctgctgctggaggtggacgccaccagcaagtacagcgtggccatcagcaccagcgaggtgggcaccgaccacaagctgcacctgaaggaggaccccaacctgatcagcgtgaacaacttcgaggactgcagcctgtgccccagcgtgcccatcgagcacggcttcagaagacagcagagcaagagcaacaacgtggaggagaccgagatccactggaagctgatccccatcaccggcggcaacgccagaagccccgaggaccagctgggcaagcacggcgagaagcagacccccggcatgaagagccccgaggagcagctggtgtgcgtgcccccccaggaggccttccccaacgaccccagagtgatcaacagacagagaagcagcgactaccagttccccagcagccccttcaccgacaccctgaagggcaccaccgaggacgacgtgctgaccggccaggtggaggagcagtgcgtgcccgccgccgaggccgagccccccgccgtgagcgagaccaccgagagaaccgtgctgggcgagtacaacctgttcagcagaaagatcgaggagatcctgaagcagaagaacgtgagctacgtgagcaccgtgagcacccccatcttcagcacccaggagaagatgaagagactgagcgagttcatctacagcaagaccagcaaggccggcgtgcaggagttcgtggacggcctgcacgagaagctgaacaccatcatcatcaaggccagcgccaagggcggcaacctgccccccgtgagccccaacgacagcggcgccaagatcgccagcaaccccctggagagacacgtgatccccgtgagcagcagcgacttcaacaacaagcacctgctggagcccctgtgcagcgaccccctgaaggacaccaacagcgacgagcagcacagcaccagcgccctgaccgaggtggagatgaaccagccccagcacgccaccgagctgatggtgaccagcgaccacatcgtgcccggcgacatggccagagagcccgtggaggagaccaccaagagccccagcgacgtgaacatcagcgcccagcccgccctgagcaacttcatcagccagctggagcccgaggtgttcaacagcctggtgaagatcatgaaggacgtgcagaagaacaccgtgaagttctacatccacgaggaggaggagagcgtgctgtgcaaggagatcaaggagtacctgatcaagctgggcaacaccgagtgccaccccgagcagttcctggagagaagaagcaagctggacaagctgctgatcatcatccagaacgaggacatcgccggcttcatccacaagatccccggcctggtgaccctgaagaagctgccctgcgtgagcttcgccggcgtggacagcctggacgacgtgaagaaccacacctacaacgagctgttcgtgagcggcggcttcatcgtgagcgacgagagcatcctgaaccccgaggtggtgaccgtggagaacctgaagaacttcctgaccttcctggaggagctgagcacccccgagggcaagtggcagtggaaggtgcactgcaagttccagaagaagctgaaggagctgggcagactgaacgccaaggccctgagcctgctgaccctgctgaacgtgtaccagaagaagcacctggtggagatcctgagctaccacaactgcgacagccagaccagaaacgcccccgagctggactgcctgatcagactgcaggcccagaacatccagcagagacacatcgtgttcctgaccgagaagaacatcaagatgctgagcagctacaccgacaacggcatcgtggtggccaccgccgaggacttcatgcagaacttcaagaacctggtgggctaccacaacagcatcaccgaggagaacctgccccagctgggcgccaacgagaacctggagagccagagcgacgccgtgctgaccctgacccccctggagctgggcgtgggcatcagccagcactag

SEQ ID NO: 21087 - DNA, 4830 bp, Artificial Sequence
  Description of Artificial Sequence: Synthetic coding sequence
atggccaccgccgtggagaccgaggcctgccagcccaccgacgccagctgggagagcggcggcggcggcgacgacgagatgaagcaggccctgcccgagctggagagcagccagcagaacggcggcggcggcggcctgaacatcgccgagcccagcggcggcgccggcagagaggagaacgccggcgccgaggccgcccagagcctgagccacgagcagccccaggacagcagcgaggccggcgccgccgccctgcccagaggccccgaggagcccgagagacccgtgagaagaagcttccagatccccagaaagagcagagagaagaaggccctgttccagcccctgacccccggcagcagagagttcgaggacgtggtgaacatcctgcacagcagctacctggagcccaccagcgtgaccaacttcaactacagaagagcctgcctggtgcacaacgagctgctggagaaggagttcaccgagaagagaagagagctgaagttcgacggcagactggacaaggagctgagcgagagctacgccttcctgatggtggacagataccaggtgcagaccatctgcgagaagggcctgcacgtgggccagagcaagatcaccatcctgggcagccccagcatgggcgtgtacctgagcagatacgccgacctgctgcaggccaaccccctggacaccggcgccatgggcgacgtggtgatcttcaagatcatgaagggcaagatcaagagcatctacgaccccatgggcgtgaagagcctggagagcatgctgaacaagagcgccctggaccccacccccaagcacgagtgccacgtgagcaagaacgccaacagaatcaccagcctgctggcctacagagcctacgagctgacccagtactacttctacgagtacggcttcgacgagctgagaagaagacccagacacgtgtgcccctacgccgtggtgagcttcacctacaaggacgacatccagacccccaagttcgtgcccagcagcagaagcaacagcttcaacaccgacagaaacatcgacaagtacaactacaccctgtggaagggccagctgctgaacaagggcaagctgctgtgctacatcagcctgagaagcgccaccagagccttcctgcccatcaagctgcccgagaagctggacgtggagaccgtgatgagcatcgaccacctgaagcagaagatcccccccgccctgttctacaaggagacctacctgggccccaacgaggtgctgaagaacggcatgtactgcagcctgtacgaggtggtggagaagaccagaatcggcagcaacatggagagcctgctgcagaagctggacagagagaagctggtgctggtgaagcccctgggcgacagaggctacctgttcctgctgagcccctaccagatggtgcccccctacgagtaccagaccgccaagagcagagtgctgcacgccctgttcctgttccaggagcccagaagcatcgtgaccagccagaagggcagcaccaacgccgccccccaggagagacacgagagcatgcccgacgtgctgaagatcgcccagttcctgcagttcagcctgatccagtgcagaaaggagttcaagaacatcagcgccatcaacttccacagcgtggtggagaagtacgtgagcgagttcttcaagagaggcttcggcagcggcaagagagagttcatcatgttcccctacgacagcagactggacgacaagaagttcctgtacagcgcccccagaaacaagagccacatcgacacctgcctgcacgcctacatcttcagacccgaggtgtaccagctgcccatctgcaagctgaaggagctgttcgaggagaacagaaagctgcagcagttcagccccctgagcgactacgagggccaggaggaggagatgaacggcaccaagatgaagttcggcaagagaaacaacagcagaggcgaggccatcatcagcggcaagcagagaagcagccacagcctggactacgacaaggacagagtgaaggagctgatcaacctgatccagtgcagaaagaagagcgtgggcggcgacagcgacaccgaggacatgagaagcaagaccgtgctgaagagaaagctggaggacctgcccgagaacatgagaaagctggccaagaccagcaacctgagcgagaactgccacctgtacgaggagagcccccagcccatcggcagcctgggccacgacgccgacctgagaagacagcagcaggacacctgcaacagcggcatcgccgacatccacagactgttcaactggctgagcgagaccctggccaacgccagacacagcgacgccagcctgaccgacaccgtgaacaaggccctgggcctgagcaccgacgacgcctacgaggagctgagacagaagcacgagtacgagctgaacagcacccccgacaagaaggactacgagcagcccacctgcgccaaggtggagaacgcccagttcaagggcacccagagcctgctgctggaggtggacgccaccagcaagtacagcgtggccatcagcaccagcgaggtgggcaccgaccacaagctgcacctgaaggaggaccccaacctgatcagcgtgaacaacttcgaggactgcagcctgtgccccagcgtgcccatcgagcacggcttcagaagacagcagagcaagagcaacaacgtggaggagaccgagatccactggaagctgatccccatcaccgacaccctgaagggcaccaccgaggacgacgtgctgaccggccaggtggaggagcagtgcgtgcccgccgccgaggccgagccccccgccgtgagcgagaccaccgagagaaccgtgctgggcgagtacaacctgttcagcagaaagatcgaggagatcctgaagcagaagaacgtgagctacgtgagcaccgtgagcacccccatcttcagcacccaggagaagatgaagagactgagcgagttcatctacagcaagaccagcaaggccggcgtgcaggagttcgtggacggcctgcacgagaagctgaacaccatcatcatcaaggccagcgccaagggcggcaacctgccccccgtgagccccaacgacagcggcgccaagatcgccagcaaccccctggagagacacgtgatccccgtgagcagcagcgacttcaacaacaagcacctgctggagcccctgtgcagcgaccccctgaaggacaccaacagcgacgagcagcacagcaccagcgccctgaccgaggtggagatgaaccagccccagcacgccaccgagctgatggtgaccagcgaccacatcgtgcccggcgacatggccagagagcccgtggaggagaccaccaagagccccagcgacgtgaacatcagcgcccagcccgccctgagcaacttcatcagccagctggagcccgaggtgttcaacagcctggtgaagatcatgaaggacgtgcagaagaacaccgtgaagttctacatccacgaggaggaggagagcgtgctgtgcaaggagatcaaggagtacctgatcaagctgggcaacaccgagtgccaccccgagcagttcctggagagaagaagcaagctggacaagctgctgatcatcatccagaacgaggacatcgccggcttcatccacaagatccccggcctggtgaccctgaagaagctgccctgcgtgagcttcgccggcgtggacagcctggacgacgtgaagaaccacacctacaacgagctgttcgtgagcggcggcttcatcgtgagcgacgagagcatcctgaaccccgaggtggtgaccgtggagaacctgaagaacttcctgaccttcctggaggagctgagcacccccgagggcaagtggcagtggaaggtgcactgcaagttccagaagaagctgaaggagctgggcagactgaacgccaaggccctgagcctgctgaccctgctgaacgtgtaccagaagaagcacctggtggagatcctgagctaccacaactgcgacagccagaccagaaacgcccccgagctggactgcctgatcagactgcaggcccagaacatccagcagagacacatcgtgttcctgaccgagaagaacatcaagatgctgagcagctacaccgacaacggcatcgtggtggccaccgccgaggacttcatgcagaacttcaagaacctggtgggctaccacaacagcatcaccgaggagaacctgccccagctgggcgccaacgagaacctggagagccagagcgccctgctggagaacgacgagaaggacgaggaggacatgagcctggacagcggcgacgagatcagccacatcgaggtgtgcagcaacttccacagcgagatctgggagaaggagaccaagggcagcagaggcaccgaccagaagaagaacacccagatcgagctgcagagcagccccgacgtgcagaacagcctgctggaggacaagacctacctggacagcgaggagagaaccagcatcgacatcgtgtgcagcgagggcgagaacagcaacagcaccgagcaggacagctacagcaacttccaggtgtaccacagccagctgaacatgagccaccagttcagccacttcaacgtgctgacccaccagaccttcctgggcaccccctacgccctgagcagcagccagagccaggagaacgagaactacttcctgagcgcctacaccgagagcctggacagagacaagagccccccccccctgagctggggcaagagcgacagcagcagaccctacagccaggagaagtag

SEQ ID NO: 21088 - DNA, 3702 bp, Artificial Sequence
  Description of Artificial Sequence: Synthetic coding sequence
atgagcatcgaccacctgaagcagaagatcccccccgccctgttctacaaggagacctacctgggccccaacgaggtgctgaagaacggcatgtactgcagcctgtacgaggtggtggagaagaccagaatcggcagcaacatggagagcctgctgcagaagctggacagagagaagctggtgctggtgaagcccctgggcgacagaggctacctgttcctgctgagcccctaccagatggtgcccccctacgagtaccagaccgccaagagcagagtgctgcacgccctgttcctgttccaggagcccagaagcatcgtgaccagccagaagggcagcaccaacgccgccccccaggagagacacgagagcatgcccgacgtgctgaagatcgcccagttcctgcagttcagcctgatccagtgcagaaaggagttcaagaacatcagcgccatcaacttccacagcgtggtggagaagtacgtgagcgagttcttcaagagaggcttcggcagcggcaagagagagttcatcatgttcccctacgacagcagactggacgacaagaagttcctgtacagcgcccccagaaacaagagccacatcgacacctgcctgcacgcctacatcttcagacccgaggtgtaccagctgcccatctgcaagctgaaggagctgttcgaggagaacagaaagctgcagcagttcagccccctgagcgactacgagggccaggaggaggagatgaacggcaccaagatgaagttcggcaagagaaacaacagcagaggcgaggccatcatcagcggcaagcagagaagcagccacagcctggactacgacaaggacagagtgaaggagctgatcaacctgatccagtgcagaaagaagagcgtgggcggcgacagcgacaccgaggacatgagaagcaagaccgtgctgaagagaaagctggaggacctgcccgagaacatgagaaagctggccaagaccagcaacctgagcgagaactgccacctgtacgaggagagcccccagcccatcggcagcctgggccacgacgccgacctgagaagacagcagcaggacacctgcaacagcggcatcgccgacatccacagactgttcaactggctgagcgagaccctggccaacgccagacacagcgacgccagcctgaccgacaccgtgaacaaggccctgggcctgagcaccgacgacgcctacgaggagctgagacagaagcacgagtacgagctgaacagcacccccgacaagaaggactacgagcagcccacctgcgccaaggtggagaacgcccagttcaagggcacccagagcctgctgctggaggtggacgccaccagcaagtacagcgtggccatcagcaccagcgaggtgggcaccgaccacaagctgcacctgaaggaggaccccaacctgatcagcgtgaacaacttcgaggactgcagcctgtgccccagcgtgcccatcgagcacggcttcagaagacagcagagcaagagcaacaacgtggaggagaccgagatccactggaagctgatccccatcaccggcggcaacgccagaagccccgaggaccagctgggcaagcacggcgagaagcagacccccgacaccctgaagggcaccaccgaggacgacgtgctgaccggccaggtggaggagcagtgcgtgcccgccgccgaggccgagccccccgccgtgagcgagaccaccgagagaaccgtgctgggcgagtacaacctgttcagcagaaagatcgaggagatcctgaagcagaagaacgtgagctacgtgagcaccgtgagcacccccatcttcagcacccaggagaagatgaagagactgagcgagttcatctacagcaagaccagcaaggccggcgtgcaggagttcgtggacggcctgcacgagaagctgaacaccatcatcatcaaggccagcgccaagggcggcaacctgccccccgtgagccccaacgacagcggcgccaagatcgccagcaaccccctggagagacacgtgatccccgtgagcagcagcgacttcaacaacaagcacctgctggagcccctgtgcagcgaccccctgaaggacaccaacagcgacgagcagcacagcaccagcgccctgaccgaggtggagatgaaccagccccagcacgccaccgagctgatggtgaccagcgaccacatcgtgcccggcgacatggccagagagcccgtggaggagaccaccaagagccccagcgacgtgaacatcagcgcccagcccgccctgagcaacttcatcagccagctggagcccgaggtgttcaacagcctggtgaagatcatgaaggacgtgcagaagaacaccgtgaagttctacatccacgaggaggaggagagcgtgctgtgcaaggagatcaaggagtacctgatcaagctgggcaacaccgagtgccaccccgagcagttcctggagagaagaagcaagctggacaagctgctgatcatcatccagaacgaggacatcgccggcttcatccacaagatccccggcctggtgaccctgaagaagctgccctgcgtgagcttcgccggcgtggacagcctggacgacgtgaagaaccacacctacaacgagctgttcgtgagcggcggcttcatcgtgagcgacgagagcatcctgaaccccgaggtggtgaccgtggagaacctgaagaacttcctgaccttcctggaggagctgagcacccccgagggcaagtggcagtggaaggtgcactgcaagttccagaagaagctgaaggagctgggcagactgaacgccaaggccctgagcctgctgaccctgctgaacgtgtaccagaagaagcacctggtggagatcctgagctaccacaactgcgacagccagaccagaaacgcccccgagctggactgcctgatcagactgcaggcccagaacatccagcagagacacatcgtgttcctgaccgagaagaacatcaagatgctgagcagctacaccgacaacggcatcgtggtggccaccgccgaggacttcatgcagaacttcaagaacctggtgggctaccacaacagcatcaccgaggagaacctgccccagctgggcgccaacgagaacctggagagccagagcgccctgctggagaacgacgagaaggacgaggaggacatgagcctggacagcggcgacgagatcagccacatcgaggtgtgcagcaacttccacagcgagatctgggagaaggagaccaagggcagcagaggcaccgaccagaagaagaacacccagatcgagctgcagagcagccccgacgtgcagaacagcctgctggaggacaagacctacctggacagcgaggagagaaccagcatcgacatcgtgtgcagcgagggcgagaacagcaacagcaccgagcaggacagctacagcaacttccaggtgtaccacagccagctgaacatgagccaccagttcagccacttcaacgtgctgacccaccagaccttcctgggcaccccctacgccctgagcagcagccagagccaggagaacgagaactacttcctgagcgcctacaccgagagcctggacagagacaagagccccccccccctgagctggggcaagagcgacagcagcagaccctacagccaggagaagtag

SEQ ID NO: 21089 - DNA, 7293 bp, Artificial Sequence
  Description of Artificial Sequence: Synthetic coding sequence
atggccccccccgcccacaagagcatcctggagagaagcgagaacgtgctgatgagcccctggaagggcaagctgatcgtgcaggacagaatgctgtgcgacatcgccctgtggagcacctacggcgccatgatccccacccagctgccccaggagctggacttcaagtacgtgatgaaggtgagcagcctgaagaagagactgcccgaggccgccttcagaaagcagaactacctggaggagaaggtgtgcttccaggacctgtgcttcaacctgtacgaggtggagctgagcaacagacagggcgagaacatcgacaagctgaccgagtgcatcaagaacaagcagctggccatcatcaagtgcctggaggacagaggcttcttcatcctgctgaccagcagcgccctgctgagcgagcccgacttcggcggcaagcagatgggcctgcacggcctgcacctgttcagaagccccctgagcaccggcgtgaaggacctgaaggtggaggacgacatcagcatgaaggtgatccccatcctgagcaccctgaactgcgccctgctggagaccaagaagagcctgcccgaggagagaatccaccccaacaccctggtgaagagacacttccaggagctgtacaaggccgacagaagccccagcctgagcgtggccccccaggacagaatgaaggaccccaccttcctgggcaagctgcccagcggcttcgacctgatcccccccgccgagaagtgccccagcgagagcctgacccagctgaacagctacttcagcgaccccagcgcctacatcctggaggtgagcaccgccctggacctgctggccgagcacccccagagcccctgcgtgagcgacggcatctgcgacgccggcttcagcctggtgatgacccccgaccccgagttcctggtgagcgaggccgaggtgagaaaggagaccgagaccaagaaggacagcgaggagatgctgaaggccaagaagagagtgttccccctgagccccgccagcaacctgagagtgcagcccaagagaaaggccagcatgccccacatggtgcagagcaagaaggtgaacctgtgcagacccttccccaagagaaccgccagcagagccgacaacagcagcgacagccccaccaccctgaagctggtgaagggccagttcccccagaagagaaagagaggcgccgaggtgctgaccgcccagttcgtgcagaagaccaagctggacagaaagaaccaggaggcccccatcagcaaggacgtgcccgtgcccaccaacgccaagagagccagaaagcaggagaagagccccgtgaagaccgtgcccagagccaagccccccgtgaagaagagcccccagaagcagagagtgaacatcgtgaagggcaacgagaaccccagaaacagaaagcagctgcagcccgtgaagggcgagaccgccagcaagctgcagagcgagatcagcagaggctgccaggaggacggcatcagcatcaacagcgtgcagcccgagaacaccaccgccgcccacaacgacctgcccgagaacagcatcgtgaactacgacagccaggccctgaacatgctggccgacctggccctgagcagcgccaccagcagcacccccgtgagcgaggccagaaacctgcactgcagcagcgagctgccccagaacgacgtgctgctgagcaaggagaacagcctgagaggcaccagcgaccacgagtaccacagaggcgtgaagacccagaagggcgagctgctgcccaaccccagcagcgacagaaagagcaacagcggcagcgacctgaccgtgagccaggacgaggagagcctggtgccctgcagccaggcccccgccaaggcccagagcgccctgaccgaggagatgctggagagcagcgacgccagccagagcagcagcgtgagcgtggagcacagctacgccctgctgctgaccgagcacagcaagaagcacctgcaggagagagagatcctgagccccctgttccccagaaacggcaccaagagccccgaggccgccacccccgtgggcaaggtgatgcccttcagacaccagcccggcctgctgctgcagcagaagccccccgacgaccccgtggtgaagcccaaggacagaccccccagcgccagagtgaagaagagcagctgcagcagaatcgtgctgagctgcgacgacagcgtgaagatcaccttcaagtgcgagaccgagtacgccttcagcctggacagcaagtacaccaacaaccccctggagaagaccgtggtgagagccctgcacggcccctggaacaccgacctgcccgacaacgtggaggaggtgaagctgctgctgcacatgtgggtggccctgttctacagcaaccagaacaagatcatcagaagcagcagaaaggtggtggagcacagcaaccccgccaagtacgtgagcatcaacagcaccctggagagctgcgagctgagagagatcgaggagagcctgggcctggagaagtgcagcgccgacagcctgctggagaccaacgagatcagcagagcccacgccgccgaggtgagcttcagagaccccaactgcctgctgcccttcatcaagacccccctgacccagggcctggagctgtgcgtgcagaacgagcagaagaagaccttcgccagagagtgcgaccccgacacccaggaggaccagaacttcatctgcagctacaacaacgaggtgaccggcgaggaggccaagcaggagagcctggagaccagcaacctggtgctgagcggcatcggcagcacccagaccaacggccccagcgtgcccagcgaggaggagatcgtgcagcccctggacagcaccagagtggccagctacagcggcaccgtgacccaggccaccttcaccagaacctacgacggccccggcagccagcccgtgatctgccagagcagcgtgtacggcaccctggagaacaaggtggacatcctggacgccgccgtgcagaccaagaccggcaccctgcaggacctgatccagcacggcagccccatcaacaacgagtgccaccccagcctggagagaaaggacgacaacatgggctgcgccgtgatcaaccccgagcccatcaccctgaccttcgagaagaacgcccacgtgcccatccagaccgagggcgtgaacaccgccgacgagagaaccaccttcaagaaggagctgatcaagcaggtgagccccgccgccagcctgagacaccccgtgagcaccagcgagaacgccagaacccagggcctgagagacatccccagcctggtggtggccggccagaagggcaccaagtacctgtgcgccagcagcgtgggcggcgagaccctggacaaggccgtgtgcagcctgcagaaggagacccccctgcccgtgagcctgcccagcgacaagaccatggtgatggaggccctgagcctggccaagagcagcagccacctgagccccagcgaggaggtgagatgcacccaggacttcctgagccagacccagagcctgctgggcctgagcagcgagggcctgctggagctgacccaggtggaggtggacagcagcagcgccagcaccaccctgggcagacagtgcagcctgaactgcatcagcagcggctgccacaccagcggcgacagcctggagctgagaaagaaccacaagaacggccccaacaccgagaacatgaacctggaggccttcgacagcgtgttcatcaagcagaccagcctgagcgtgagcagagaggtgagcctggagctgagcgaggaggacagcgacatcgacctggccctgaccatcagcccccccaccagccccagagaggagatgcccgccggcgagatcgagcagttcgaggaggcccccttcagcaacctggagctgcaggacgtggccgaggagatcggcgagcccgaggaggtggccctgaccgagagcagagaggtgagcagcgccgacaacgtgagcgtgtaccccagcgtgagcgaggagcccgtggagaacaaggagagaaagggcgacaacctgcagcccgtgaccctgatcctgagcaaggagaactgcaccctggagatcgccgaggagatcaacgtgaccagcgacttccccttcgacagcgtgatcgaggaggtgagccccgccagcagccccgagccccccgtgcccgtgaaggagaccagaccctaccaggccgtgaccccctgcatcctgaagctgcacggcacccagtgcgagaagagcaaccagatcagccagtgcgagagcgaggacctgggcatcaccgagaaggagaacgtgttcgtgggccccacccaccccgtgggccaggacaacttcacccaggtgcagcagatgcaggtgagcgccgagatgcccctgatcctgaccgaccaccccggcagaaccggcagacccaccctgcccggcaaggtgaccgaggagatcgtgagcagcgagcacgacgagggcctgagcttcagcggcaaggtgcagtgctacggcagagagctgaaccagcccgccagcgccgccaagtgcaccggcgacttcagccccagccccgagaagctggtgaagagcggcaaccccctgcagcccgtgagcatcgagaacagaaacctggacctgaagcacctggtgctggagagcagcgagccccccttcggccccagaaacgtgatcgagaacaagagcctgagcgacaccctggtgagcaccaccgcccccagcggcatcgtgaacgtgagcgtgaagcagcagaccagccccaagagcagccagaaccacctgttccccggcgacctgaagaccgacgagggcatctacctgcaggtgaagagcctgaccgccgccagcgtggacggcgcctacagcacccagggctgcatgtgcagcgtggtgcccaccctgtgcagcagcagcgacaacgccaccctgacccactacgtgagacccatcaacgccgagcccgtgttccaggcccaggagatccccgccggcagaatggccagcctgctgaagaacggcgagcccgaggccgagctgcacaaggagaccaccggccccggcaccgccggcccccagagcaacaccaccagcagcctgaagggcgagagaaaggccatccacaccctgcaggacgtgagcacctgcgagaccaaggagctgctgaacgtgggcgtgagcagcctgtgcgccggcccctaccagaacaccgccgacaccaaggagaacctgagcaaggagcccctggccagcttcgtgagcgagagcttcgacaccagcgtgtgcggcatcgccaccgagcacgtggagatcgagaacagcggcgagggcctgagagccgaggccggcagcgagaccctgggcagagacggcgaggtgggcgtgaacagcgacatgcactacgagctgagcggcgacagcgacctggacctgctgggcgactgcagaaaccccagactggacctggaggacagctacaccctgagaggcagctacaccagaaagaaggacgtgcccaccgacggctacgagagcagcctgaacttccacaacaacaaccaggaggactggggctgcagcagctgggtgcccggcatggagaccagcctgccccccggccactggaccgccgccgtgaagaaggaggagaagtgcgtgcccccctacgtgcagatcagagacctgcacggcatcctgagaacctacgccaacttcagcatcaccaaggagctgaaggacaccatgagaaccagccacggcctgagaagacaccccagcttcagcgccaactgcggcctgcccagcagctggaccagcacctggcaggtggccgacgacctgacccagaacaccctggacctggagtacctgagattcgcccacaagctgaagcagaccatcaagaacggcgacagccagcacagcgccagcagcgccaacgtgttccccaaggagagccccacccagatcagcatcggcgccttccccagcaccaagatcagcgaggcccccttcctgcaccccgcccccagaagcagaagccccctgctggtgaccgtggtggagagcgaccccagaccccagggccagcccagaagaggctacaccgccagcagcctggacagcagcagcagctggagagagagatgcagccacaacagagacctgagaaacagccagagaaaccacaccgtgagcttccacctgaacaagctgaagtacaacagcaccgtgaaggagagcagaaacgacatcagcctgatcctgaacgagtacgccgagttcaacaaggtgatgaagaacagcaaccagttcatcttccaggacaaggagctgaacgacgtgagcggcgaggccaccgcccaggagatgtacctgcccttccccggcagaagcgccagctacgaggacatcatcatcgacgtgtgcaccaacctgcacgtgaagctgagaagcgtggtgaaggaggcctgcaagagcaccttcctgttctacctggtggagaccgaggacaagagcttcttcgtgagaaccaagaacctgctgagaaagggcggccacaccgagatcgagccccagcacttctgccaggccttccacagagagaacgacaccctgatcatcatcatcagaaacgaggacatcagcagccacctgcaccagatccccagcctgctgaagctgaagcacttccccagcgtgatcttcgccggcgtggacagccccggcgacgtgctggaccacacctaccaggagctgttcagagccggcggcttcgtgatcagcgacgacaagatcctggaggccgtgaccctggtgcagctgaaggagatcatcaagatcctggagaagctgaacggcaacggcagatggaagtggctgctgcactacagagagaacaagaagctgaaggaggacgagagagtggacagcaccgcccacaagaagaacatcatgctgaagagcttccagagcgccaacatcatcgagctgctgcactaccaccagtgcgacagcagaagcagcaccaaggccgagatcctgaagtgcctgctgaacctgcagatccagcacatcgacgccagattcgccgtgctgctgaccgacaagcccaccatccccagagaggtgttcgagaacagcggcatcctggtgaccgacgtgaacaacttcatcgagaacatcgagaagatcgccgcccccttcagaagcagctactggtag

SEQ ID NO: 21090 - DNA, 4878 bp, Artificial Sequence
  Description of Artificial Sequence: Synthetic coding sequence
atggccccccccgcccacaagagcatcctggagagaagcgagaacgtgctgatgagcccctggaagggcaagctgatcgtgcaggacagaatgctgtgcgacatcgccctgtggagcacctacggcgccatgatccccacccagctgccccaggagctggacttcaagtacgtgatgaaggtgagcagcctgaagaagagactgcccgaggccgccttcagaaagcagaactacctggaggagaaggtgtgcttccaggacctgtgcttcaacctgtacgaggtggagctgagcaacagacagggcgagaacatcgacaagctgaccgagtgcatcaagaacaagcagctggccatcatcaagtgcctggaggacagaggcttcttcatcctgctgaccagcagcgccctgctgagcgagcccgacttcggcggcaagcagatgggcctgcacggcctgcacctgttcagaagccccctgagcaccggcgtgaaggacctgaaggtggaggacgacatcagcatgaaggtgatccccatcctgagcaccctgaactgcgccctgctggagaccaagaagagcctgcccgaggagagaatccaccccaacaccctggtgaagagacacttccaggagctgtacaaggccgacagaagccccagcctgagcgtggccccccaggacagaatgaaggaccccaccttcctgggcaagctgcccagcggcttcgacctgatcccccccgccgagaagtgccccagcgagagcctgacccagctgaacagctacttcagcgaccccagcgcctacatcctggaggtgagcaccgccctggacctgctggccgagcacccccagagcccctgcgtgagcgacggcatctgcgacgccggcttcagcctggtgatgacccccgaccccgagttcctggtgagcgaggccgaggtgagaaaggagaccgagaccaagaaggacagcgaggagatgctgaaggccgtgtgcagcctgcagaaggagacccccctgcccgtgagcctgcccagcgacaagaccatggtgatggaggccctgagcctggccaagagcagcagccacctgagccccagcgaggaggtgagatgcacccaggacttcctgagccagacccagagcctgctgggcctgagcagcgagggcctgctggagctgacccaggtggaggtggacagcagcagcgccagcaccaccctgggcagacagtgcagcctgaactgcatcagcagcggctgccacaccagcggcgacagcctggagctgagaaagaaccacaagaacggccccaacaccgagaacatgaacctggaggccttcgacagcgtgttcatcaagcagaccagcctgagcgtgagcagagaggtgagcctggagctgagcgaggaggacagcgacatcgacctggccctgaccatcagcccccccaccagccccagagaggagatgcccgccggcgagatcgagcagttcgaggaggcccccttcagcaacctggagctgcaggacgtggccgaggagatcggcgagcccgaggaggtggccctgaccgagagcagagaggtgagcagcgccgacaacgtgagcgtgtaccccagcgtgagcgaggagcccgtggagaacaaggagagaaagggcgacaacctgcagcccgtgaccctgatcctgagcaaggagaactgcaccctggagatcgccgaggagatcaacgtgaccagcgacttccccttcgacagcgtgatcgaggaggtgagccccgccagcagccccgagccccccgtgcccgtgaaggagaccagaccctaccaggccgtgaccccctgcatcctgaagctgcacggcacccagtgcgagaagagcaaccagatcagccagtgcgagagcgaggacctgggcatcaccgagaaggagaacgtgttcgtgggccccacccaccccgtgggccaggacaacttcacccaggtgcagcagatgcaggtgagcgccgagatgcccctgatcctgaccgaccaccccggcagaaccggcagacccaccctgcccggcaaggtgaccgaggagatcgtgagcagcgagcacgacgagggcctgagcttcagcggcaaggtgcagtgctacggcagagagctgaaccagcccgccagcgccgccaagtgcaccggcgacttcagccccagccccgagaagctggtgaagagcggcaaccccctgcagcccgtgagcatcgagaacagaaacctggacctgaagcacctggtgctggagagcagcgagccccccttcggccccagaaacgtgatcgagaacaagagcctgagcgacaccctggtgagcaccaccgcccccagcggcatcgtgaacgtgagcgtgaagcagcagaccagccccaagagcagccagaaccacctgttccccggcgacctgaagaccgacgagggcatctacctgcaggtgaagagcctgaccgccgccagcgtggacggcgcctacagcacccagggctgcatgtgcagcgtggtgcccaccctgtgcagcagcagcgacaacgccaccctgacccactacgtgagacccatcaacgccgagcccgtgttccaggcccaggagatccccgccggcagaatggccagcctgctgaagaacggcgagcccgaggccgagctgcacaaggagaccaccggccccggcaccgccggcccccagagcaacaccaccagcagcctgaagggcgagagaaaggccatccacaccctgcaggacgtgagcacctgcgagaccaaggagctgctgaacgtgggcgtgagcagcctgtgcgccggcccctaccagaacaccgccgacaccaaggagaacctgagcaaggagcccctggccagcttcgtgagcgagagcttcgacaccagcgtgtgcggcatcgccaccgagcacgtggagatcgagaacagcggcgagggcctgagagccgaggccggcagcgagaccctgggcagagacggcgaggtgggcgtgaacagcgacatgcactacgagctgagcggcgacagcgacctggacctgctgggcgactgcagaaaccccagactggacctggaggacagctacaccctgagaggcagctacaccagaaagaaggacgtgcccaccgacggctacgagagcagcctgaacttccacaacaacaaccaggaggactggggctgcagcagctgggtgcccggcatggagaccagcctgccccccggccactggaccgccgccgtgaagaaggaggagaagtgcgtgcccccctacgtgcagatcagagacctgcacggcatcctgagaacctacgccaacttcagcatcaccaaggagctgaaggacaccatgagaaccagccacggcctgagaagacaccccagcttcagcgccaactgcggcctgcccagcagctggaccagcacctggcaggtggccgacgacctgacccagaacaccctggacctggagtacctgagattcgcccacaagctgaagcagaccatcaagaacggcgacagccagcacagcgccagcagcgccaacgtgttccccaaggagagccccacccagatcagcatcggcgccttccccagcaccaagatcagcgaggcccccttcctgcaccccgcccccagaagcagaagccccctgctggtgaccgtggtggagagcgaccccagaccccagggccagcccagaagaggctacaccgccagcagcctggacagcagcagcagctggagagagagatgcagccacaacagagacctgagaaacagccagagaaaccacaccgtgagcttccacctgaacaagctgaagtacaacagcaccgtgaaggagagcagaaacgacatcagcctgatcctgaacgagtacgccgagttcaacaaggtgatgaagaacagcaaccagttcatcttccaggacaaggagctgaacgacgtgagcggcgaggccaccgcccaggagatgtacctgcccttccccggcagaagcgccagctacgaggacatcatcatcgacgtgtgcaccaacctgcacgtgaagctgagaagcgtggtgaaggaggcctgcaagagcaccttcctgttctacctggtggagaccgaggacaagagcttcttcgtgagaaccaagaacctgctgagaaagggcggccacaccgagatcgagccccagcacttctgccaggccttccacagagagaacgacaccctgatcatcatcatcagaaacgaggacatcagcagccacctgcaccagatccccagcctgctgaagctgaagcacttccccagcgtgatcttcgccggcgtggacagccccggcgacgtgctggaccacacctaccaggagctgttcagagccggcggcttcgtgatcagcgacgacaagatcctggaggccgtgaccctggtgcagctgaaggagatcatcaagatcctggagaagctgaacggcaacggcagatggaagtggctgctgcactacagagagaacaagaagctgaaggaggacgagagagtggacagcaccgcccacaagaagaacatcatgctgaagagcttccagagcgccaacatcatcgagctgctgcactaccaccagtgcgacagcagaagcagcaccaaggccgagatcctgaagtgcctgctgaacctgcagatccagcacatcgacgccagattcgccgtgctgctgaccgacaagcccaccatccccagagaggtgttcgagaacagcggcatcctggtgaccgacgtgaacaacttcatcgagaacatcgagaagatcgccgcccccttcagaagcagctactggtag

SEQ ID NO: 21091 - DNA, 27 bp, Artificial Sequence
  Description of Artificial Sequence: Synthetic coding sequence
atggccccccccgcccacaagagctag

SEQ ID NO: 21092 - DNA, 639 bp, Artificial Sequence
  Description of Artificial Sequence: Synthetic coding sequence
atgggcaccagacagaccaagggcagcctggccgagagagccagccccggcgccgcccccggccccagaagagagagacccgacttctgggccagcctgctgctgagagccggcgacaaggccggcagagccggcgccggcatgcccccctaccacagaagagtgggcatggtgcaggagctgctgagaatggtgagacagggcagaagagaggaggccggcaccctgctgcagcacctgagacaggacctgggcatggagagcaccagcctggacgacgtgctgtacagatacgccagcttcagaaacctggtggaccccatcacccacgacctgatcatcagcctggccagatacatccactgccccaagcccccccagggctgccccggcagaaagccccccagacagcacagcggccccgtgggcaaccccaccgacctgcccagacccggcgccggcgaccagctgcccaccgccctgtggggcgccggcagacagagaggcgccggcctgcacagaccccacggcagacacggccccgccgccgccgccagcacccagcaccccgcccccccccaccacaccggcacccagtggcagcccgtggaccccggcagagccgccagaccccactag

SEQ ID NO: 21093 - DNA, 1035 bp, Artificial Sequence
  Description of Artificial Sequence: Synthetic coding sequence
atgggcaccagacagaccaagggcagcctggccgagagagccagccccggcgccgcccccggccccagaagagagagacccgacttctgggccagcctgctgctgagagccggcgacaaggccggcagagccggcgccggcatgcccccctaccacagaagagtgggcatggtgcaggagctgctgagaatggtgagacagggcagaagagaggaggccggcaccctgctgcagcacctgagacaggacctgggcatggagagcaccagcctggacgacgtgctgtacagatacgccagcttcagaaacctggtggaccccatcacccacgacctgatcatcagcctggccagatacatccactgccccaagcccgagggcgacgccctgggcgccatggagaagctgtgcagacagctgacctaccacctgagcccccacagccagtggagaagacacagaggcctggtgaagagaaagccccaggcctgcctgaaggccgtgctggccggcagcccccccgacaacaccgtggacctgagcggcatccccctgaccagcagagacctggagagagtgaccagctacctgcagagatgcggcgagcaggtggacagcgtggagctgggcttcaccggcctgaccgacgacatggtgctgcagctgctgcccgccctgagcaccctgcccagactgaccaccctggccctgaacggcaacagactgaccagagccgtgctgagagacctgaccgacatcctgaaggaccccagcaagttccccaacgtgacctggatcgacctgggcaacaacgtggacatcttcagcctgccccagcccttcctgctgagcctgagaaagagaagccccaagcagggccacctgcccaccatcctggagctgggcgagggccccggcagcggcgaggaggtgagagagggcaccgtgggccaggaggaccccggcggcggccccgtggcccccgccgaggaccaccacgagggcaaggagaccgtggccgccgcccagacctag

SEQ ID NO: 21094 - DNA, 948 bp, Artificial Sequence
  Description of Artificial Sequence: Synthetic coding sequence
atgggcgccagactgggcagaagagccggccccgaggccggcagcgaggccggcgccgccgccggctgcggccccgccccctacgagagaagagtgagatggctgagagagatccagagcaccctgagagagagaagacccgagagagccagacagctgctgagactgctgagacaggacctgggcctggagagaaccctgctgcccgacatcctgtacagagacgtggccttcctgaaccccgtggaccccatcagccacgacctgctggtgaacctggccagagacctgcagtgccccaagaaggactacgagctgtggaagagcagcgacaagatctgcagacagctgatctaccacctgaccccccacagcaagcagcagcagggcagcagcctgagacagagaaagacccagagctgcctgaagagcagcctgcagaagaccctgctggccggcgagaccgtggacctgagcggcatccccctgagcacccaggacgtgcagcacatcaccagatacctgagcagccacggcgccgtgctggccgtgctggacctgagcttcaccggcctgagcgacgagctgctgcacctgctgctgcccagcctgtgggccctgcccagactgacccagctgctgctgaacggcaacagactgaccagagccaccgccagaaagctgaccgacgccatcaaggacaccaccaagttccccgccctggcctgggtggacctgggcaacaacgtggacgtggccagcctgccccagcccctgctggtgggcctgagaagaagactgagccagagaaccagcctgcccaccatctacgagggcctggacctggagcccgagggcagcgccgccggcgccaccacccccgccagcacctgggacagcaccgccgccggcctgggccccgagccccaggcctgctgcgccagatag

SEQ ID NO: 21095 - DNA, 864 bp, Artificial Sequence
  Description of Artificial Sequence: Synthetic coding sequence
atggacatgcacagcgccagactggacagcttcctgagccagctgagatgggagctgctgtgcggcagagacaccggcagccccagcatgcccggccccctgcagcccaccagccagaccggccccgacgtgcagcccagccaccagctgagagccagcggcgccctggaggaggacagcgtgtgctgcgtggaggaggaggaggaggaggaggaggaggccgtggtgaccgaggacagagacgccgccctgggcggccccagagagcacgccctggactgggacagcggcttcagcgaggtgagcggcagcacctggagagaggaggagctgcccgtgagccagagacccgcccccagcgcccagcccctgagaagacagtgcctgagcgtgagcggcctgcccatgcccagcagagcccccgtggccagcgtgccccccgtgcaccaccccagacccaagagcacccccgacgcctgcctggagcactggcagggcctggaggccgaggactggaccgccgccctgctgaacagaggcagaagcagacagcccctggtgctgggcgacaactgcttcgccgacctggtgcacaactggatggagctgcccgagaccggcagcgagggcggcgacggcggcggccacagagccagagccagacccccccagttcctgctgggcctgagcgagcagctgagaagaagactggccagagccagaagaaccgccatggccggcaagagactgagctgcccccccagacccgagcccgagctgcccgccgacgtgagcagattcgccgccctgatgagctgcagaagcagacagcccatcatctgcaacgacgtgagctacctgtag

SEQ ID NO: 21096 - DNA, 894 bp, Artificial Sequence
  Description of Artificial Sequence: Synthetic coding sequence
atgaccatggagagcagagagatggactgctacctgagaagactgaagcaggagctgatgagcatgaaggaggtgggcgacggcctgcaggaccagatgaactgcatgatgggcgccctgcaggagctgaagctgctgcaggtgcagaccgccctggagcagctggagatcagcggcggcggccccgtgcccggcagccccgagggccccagaacccagtgcgagcacccctgctgggagggcggcagaggccccgccagacccaccgtgtgcagccccagcagccagcccagcctgggcagcagcaccaagttccccagccacagaagcgtgtgcggcagagacctggcccccctgcccagaacccagccccaccagagctgcgcccagcagggccccgagagagtggagcccgacgactggaccagcaccctgatgagcagaggcagaaacagacagcccctggtgctgggcgacaacgtgttcgccgacctggtgggcaactggctggacctgcccgagctggagaagggcggcgagaagggcgagaccggcggcgccagagagcccaagggcgagaagggccagccccaggagctgggcagaagattcgccctgaccgccaacatcttcaagaagttcctgagaagcgtgagacccgacagagacagactgctgaaggagaagcccggctgggtgacccccatggtgcccgagagcagaaccggcagaagccagaaggtgaagaagagaagcctgagcaagggcagcggccacttccccttccccggcaccggcgagcacagaagaggcgagaacccccccaccagctgccccaaggccctggagcacagccccagcggcttcgacatcaacaccgccgtgtgggtgtag

SEQ ID NO: 21097 - DNA, 849 bp, Artificial Sequence
  Description of Artificial Sequence: Synthetic coding sequence
atgagacagctgatgagcatgaaggaggtgggcgacggcctgcaggaccagatgaactgcatgatgggcgccctgcaggagctgaagctgctgcaggtgcagaccgccctggagcagctggagatcagcggcggcggccccgtgcccggcagccccgagggccccagaacccagtgcgagcacccctgctgggagggcggcagaggccccgccagacccaccgtgtgcagccccagcagccagcccagcctgggcagcagcaccaagttccccagccacagaagcgtgtgcggcagagacctggcccccctgcccagaacccagccccaccagagctgcgcccagcagggccccgagagagtggagcccgacgactggaccagcaccctgatgagcagaggcagaaacagacagcccctggtgctgggcgacaacgtgttcgccgacctggtgggcaactggctggacctgcccgagctggagaagggcggcgagaagggcgagaccggcggcgccagagagcccaagggcgagaagggccagccccaggagctgggcagaagattcgccctgaccgccaacatcttcaagaagttcctgagaagcgtgagacccgacagagacagactgctgaaggagaagcccggctgggtgacccccatggtgcccgagagcagaaccggcagaagccagaaggtgaagaagagaagcctgagcaagggcagcggccacttccccttccccggcaccggcgagcacagaagaggcgagaacccccccaccagctgccccaaggccctggagcacagccccagcggcttcgacatcaacaccgccgtgtgggtgtag

SEQ ID NO: 21098 - DNA, 3231 bp, Artificial Sequence
  Description of Artificial Sequence: Synthetic coding sequence
atgaagcccgacagagacaccctggacgagtacttcgagtacgacgccgaggagttcctggtgagcctggccctgctgatcaccgagggcagaacccccgagtgcagcgtgaagggcagaaccgagagcttccactgcccccccgcccagagctgctaccccgtgaccaccaagcacgagtgcagcgacaagctggcccagtgcagacaggccagaagaaccagaagcgaggtgaccctgctgtggaagaacaacctgcccatcatggtggagatgatgctgctgcccgactgctgctacagcgacgacggccccaccaccgagggcatcgacctgaacgaccccgccatcaagcaggacgccctgctgctggagagatggatcctggagcccgtgcccagacagaacggcgacagattcatcgaggagaagaccctgctgctggccgtgagaagcttcgtgttcttcagccagctgagcgcctggctgagcgtgagccacggcgccatccccagaaacatcctgtacagaatcagcgccgccgacgtggacctgcagtggaacttcagccagacccccatcgagcacgtgttccccgtgcccaacgtgagccacaacgtggccctgaaggtgagcgtgcagagcctgcccagacagagcaactaccccgtgctgacctgcagcatccacaccaacatcggcctgtacgagaagagaatccagcagcacaagctgaagacccaccagcaccacaaccccaacgaggccgagcagtgcggcaccaacagcagccagagactgtgcagcaagcagacctggaccatggcccccgagagcgtgctgcacgccaagagcggccccagccccgagtacaccgccgccgtgaagaacatcaagctgtaccccggcaccggcagcaagagcgaccacggcaccagccaggccaacatcctgggcttcagcggcatcggcgacatcaagagccaggagaccagcgtgagaaccctgaagagcttcagcatggtggacagcagcatcagcaacagacagagcttctggcagagcgccggcgagaccaaccccctgatcggcagcctgatccaggagagacaggagatcatcgccagaatcgcccagcacctgatccactgcgaccccagcaccagccacgtgagcggcagacccttcaacacccaggagagcagcagcctgcacagcaagctgttcagagtgagccaggagaacgagaacgtgggcaagggcaaggaggccttcagcatgaccttcggcagccccgagttcagcagccccgaggacaccaacgagggcaagatcagactgaagcccgagacccccagaagcgagacctgcatcagcaacgacttctacagccacatgcccgtgggcgagaccaaccccctgatcggcagcctgctgcaggagagacaggacgtgatcgccagaatcgcccagcacctggagcacatcgaccccaccgccagccacatccccagacagagcttcaacatgcacgacagcagcagcgtggccagcaaggtgttcagaagcagctacgaggacaagaacctgctgaagaagaacaaggacgagagcagcgtgagcatcagccacaccaagtgcagcctgctgggcgacatcagcgacggcaagaacctggtgcccaacaagtgcttcaccagcttcaagaacaacagcaaggagaagtgcagcctgaagcaccagaccagaaaccagtgccagaacaaccccagcgagatcatccagagcacctaccaggagacccagaacaagagcagcagcctgagcaccagcagcatcctgagccagcacaaggagaacaacctggacctgaccagcagattcaaggagcaggagatgagcaacggcatcgacaagcagtacagcaactgcaccaccatcgacaagcagatctgcaccaacaagtacaaggagaagatcatcaacgagaactacaaccccaagttcttcggcaacctgcagagcgacgacagcaagaagaacgacagcaagatcaaggtgaccgtgctggagatgagcgagtacctgaacaagtacgagagcatgagcagcaacaaggacagcaagagacccaagacctgcgagcagaacacccagctgaacagcatcgagaactacctgaacaaggacaacgagggcttcaagtgcaagaagagcgaccagctgaagaacgagcaggacaagcaggaggaccccaccaacgagaagagccagaactacagccagagaagaagcatcaaggactgcctgagcacctgcgagcagcccaagaacaccgaggtgctgagaaccaccctgaagcacagcaacgtgtggagaaagcacaacttccacagcctggacggcaccagcaccagagccttccacccccagaccggcctgcccctgctgagcagccccgtgccccagagaaagacccagagcggctgcttcgacctggacagcagcctgctgcacctgaagagcttcagcagcagaagccccagaccctgcctgaacatcgaggacgaccccgacatccacgagaagcccttcctgagcagcagcgccccccccatcaccagcctgagcctgctgggcaacttcgaggagagcgtgctgaactacagattcgaccccctgggcatcgtggacggcttcaccgccgaggtgggcgccagcggcgccttctgccccacccacctgaccctgcccgtggaggtgagcttctacagcgtgagcgacgacaacgcccccagcccctacatgggcgtgatcaccctggagagcctgggcaagagaggctacagagtgccccccagcggcaccatccaggtgaccctgttcaaccccaacaagaccgtggtgaagatgttcgtggtgatctacgacctgagagacatgcccgccaaccaccagaccttcctgagacagagaaccttcagcgtgcccgtgaagcaggaggtgaagagaagcgtgaacaaggagaacatcagacacaccgaggagagactgctgagatacctgatccacctgagattccagagcagcaagagcggcaagatctacctgcacagagacgtgagactgctgttcagcagaaagagcatggaggtggacagcggcgccgcctacgagctgaagagctacaccgagagccccaccaacccccagttcagccccagatgctag

SEQ ID NO: 21099 - DNA, 3231 bp, Artificial Sequence
  Description of Artificial Sequence: Synthetic coding sequence
atcagacccagaagcgacaccctggacgagtacttcgagtacgacgccgaggagttcctggtgagcctggccctgctgatcaccgagggcagaacccccgagtgcagcgtgaagggcagaaccgagagcttccactgcccccccgcccagagctgctaccccgtgaccaccaagcacgagtgcagcgacaagctggcccagtgcagacaggccagaagaaccagaagcgaggtgaccctgctgtggaagaacaacctgcccatcatggtggagatgatgctgctgcccgactgctgctacagcgacgacggccccaccaccgagggcatcgacctgaacgaccccgccatcaagcaggacgccctgctgctggagagatggatcctggagcccgtgcccagacagaacggcgacagattcatcgaggagaagaccctgctgctggccgtgagaagcttcgtgttcttcagccagctgagcgcctggctgagcgtgagccacggcgccatccccagaaacatcctgtacagaatcagcgccgccgacgtggacctgcagtggaacttcagccagacccccatcgagcacgtgttccccgtgcccaacgtgagccacaacgtggccctgaaggtgagcgtgcagagcctgcccagacagagcaactaccccgtgctgacctgcagcatccacaccaacatcggcctgtacgagaagagaatccagcagcacaagctgaagacccaccagcaccacaaccccaacgaggccgagcagtgcggcaccaacagcagccagagactgtgcagcaagcagacctggaccatggcccccgagagcgtgctgcacgccaagagcggccccagccccgagtacaccgccgccgtgaagaacatcaagctgtaccccggcaccggcagcaagagcgaccacggcaccagccaggccaacatcctgggcttcagcggcatcggcgacatcaagagccaggagaccagcgtgagaaccctgaagagcttcagcatggtggacagcagcatcagcaacagacagagcttctggcagagcgccggcgagaccaaccccctgatcggcagcctgatccaggagagacaggagatcatcgccagaatcgcccagcacctgatccactgcgaccccagcaccagccacgtgagcggcagacccttcaacacccaggagagcagcagcctgcacagcaagctgttcagagtgagccaggagaacgagaacgtgggcaagggcaaggaggccttcagcatgaccttcggcagccccgagttcagcagccccgaggacaccaacgagggcaagatcagactgaagcccgagacccccagaagcgagacctgcatcagcaacgacttctacagccacatgcccgtgggcgagaccaaccccctgatcggcagcctgctgcaggagagacaggacgtgatcgccagaatcgcccagcacctggagcacatcgaccccaccgccagccacatccccagacagagcttcaacatgcacgacagcagcagcgtggccagcaaggtgttcagaagcagctacgaggacaagaacctgctgaagaagaacaaggacgagagcagcgtgagcatcagccacaccaagtgcagcctgctgggcgacatcagcgacggcaagaacctggtgcccaacaagtgcttcaccagcttcaagaacaacagcaaggagaagtgcagcctgaagcaccagaccagaaaccagtgccagaacaaccccagcgagatcatccagagcacctaccaggagacccagaacaagagcagcagcctgagcaccagcagcatcctgagccagcacaaggagaacaacctggacctgaccagcagattcaaggagcaggagatgagcaacggcatcgacaagcagtacagcaactgcaccaccatcgacaagcagatctgcaccaacaagtacaaggagaagatcatcaacgagaactacaaccccaagttcttcggcaacctgcagagcgacgacagcaagaagaacgacagcaagatcaaggtgaccgtgctggagatgagcgagtacctgaacaagtacgagagcatgagcagcaacaaggacagcaagagacccaagacctgcgagcagaacacccagctgaacagcatcgagaactacctgaacaaggacaacgagggcttcaagtgcaagaagagcgaccagctgaagaacgagcaggacaagcaggaggaccccaccaacgagaagagccagaactacagccagagaagaagcatcaaggactgcctgagcacctgcgagcagcccaagaacaccgaggtgctgagaaccaccctgaagcacagcaacgtgtggagaaagcacaacttccacagcctggacggcaccagcaccagagccttccacccccagaccggcctgcccctgctgagcagccccgtgccccagagaaagacccagagcggctgcttcgacctggacagcagcctgctgcacctgaagagcttcagcagcagaagccccagaccctgcctgaacatcgaggacgaccccgacatccacgagaagcccttcctgagcagcagcgccccccccatcaccagcctgagcctgctgggcaacttcgaggagagcgtgctgaactacagattcgaccccctgggcatcgtggacggcttcaccgccgaggtgggcgccagcggcgccttctgccccacccacctgaccctgcccgtggaggtgagcttctacagcgtgagcgacgacaacgcccccagcccctacatgggcgtgatcaccctggagagcctgggcaagagaggctacagagtgccccccagcggcaccatccaggtgaccctgttcaaccccaacaagaccgtggtgaagatgttcgtggtgatctacgacctgagagacatgcccgccaaccaccagaccttcctgagacagagaaccttcagcgtgcccgtgaagcaggaggtgaagagaagcgtgaacaaggagaacatcagacacaccgaggagagactgctgagatacctgatccacctgagattccagagcagcaagagcggcaagatctacctgcacagagacgtgagactgctgttcagcagaaagagcatggaggtggacagcggcgccgcctacgagctgaagagctacaccgagagccccaccaacccccagttcagccccagatgctag

SEQ ID NO: 21100 - DNA, 2877 bp, Artificial Sequence
  Description of Artificial Sequence: Synthetic coding sequence
agacccgacgccgacaccctggacgagtacttcgagtacgacgccgaggagttcctggtgagcctggccctgctgatcaccgagggcagaacccccgagtgcagcgtgaagggcagaaccgagagcttccactgcccccccgcccagagctgctaccccgtgaccaccaagcacgagtgcagcgacaagctggcccagtgcagacaggccagaagaaccagaagcgaggtgaccctgctgtggaagaacaacctgcccatcatggtggagatgatgctgctgcccgactgctgctacagcgacgacggccccaccaccgagggcatcgacctgaacgaccccgccatcaagcaggacgccctgctgctggagagatggatcctggagcccgtgcccagacagaacggcgacagattcatcgaggagaagaccctgctgctggccgtgagaagcttcgtgttcttcagccagctgagcgcctggctgagcgtgagccacggcgccatccccagaaacatcctgtacagaatcagcgccgccgacgtggacctgcagtggaacttcagccagacccccatcgagcacgtgttccccgtgcccaacgtgagccacaacgtggccctgaaggtgagcgtgcagagcctgcccagacagagcaactaccccgtgctgacctgcagcatccacaccaacatcggcctgtacgagaagagaatccagcagcacaagctgaagacccaccagcaccacaaccccaacgaggccgagcagtgcggcaccaacagcagccagagactgtgcagcaagcagacctggaccatggcccccgagagcgtgctgcacgccaagagcggccccagccccgagtacaccgccgccgtgaagaacatcaagctgtaccccggcaccggcagcaagagcgaccacggcaccagccaggccaacatcctgggcttcagcggcatcggcgacatcaagagccaggagaccagcgtgagaaccctgaagagcttcagcatggtggacagcagcatcagcaacagacagagcttctggcagagcgccggcgagaccaaccccctgatcggcagcctgatccaggagagacaggagatcatcgccagaatcgcccagcacctgatccactgcgaccccagcaccagccacgtgagcggcagacccttcaacacccaggagagcagcagcctgcacagcaagctgttcagagtgagccaggagaacgagaacgtgggcaagggcaaggaggccttcagcatgaccttcggcagccccgagttcagcagccccgaggacaccaacgagggcaagatcagactgaagcccgagacccccagaagcgagacctgcatcagcaacgacttctacagccacatgcccgtgggcgagaccaaccccctgatcggcagcctgctgcaggagagacaggacgtgatcgccagaatcgcccagcacctggagcacatcgaccccaccgccagccacatccccagacagagcttcaacatgcacgacagcagcagcgtggccagcaaggtgttcagaagcagctacgaggacaagaacctgctgaagaagaacaaggacgagagcagcgtgagcatcagccacaccaagtgcagcctgctgggcgacatcagcgacggcaagaacctggtgcccaacaagtgcttcaccagcttcaagaacaacagcaaggagaagtgcagcctgaagcaccagaccagaaaccagtgccagaacaaccccagcgagatcatccagagcacctaccaggagacccagaacaagagcagcagcctgagcaccagcagcatcctgagccagcacaaggagaacaacctggacctgaccagcagattcaaggagcaggagatgagcaacggcatcgacaagcagtacagcaactgcaccaccatcgacaagcagatctgcaccaacaagtacaaggagaagatcatcaacgagaactacaaccccaagttcttcggcaacctgcagagcgacgacagcaagaagaacgacagcaagatcaaggtgaccgtgctggagatgagcgagtacctgaacaagtacgagagcatgagcagcaacaaggacagcaagagacccaagacctgcgagcagaacacccagctgaacagcatcgagaactacctgaacaaggacaacgagggcttcaagtgcaagaagagcgaccagctgaagaacgagcaggacaagcaggaggaccccaccaacgagaagagccagaactacagccagagaagaagcatcaaggactgcctgagcacctgcgagcagcccaagaacaccgaggtgctgagaaccaccctgaagcacagcaacgtgtggagaaagcacaacttccacagcctggacggcaccagcaccagagccttccacccccagaccggcctgcccctgctgagcagccccgtgccccagagaaagacccagagcggctgcttcgacctggacagcagcctgctgcacctgaagagcttcagcagcagaagccccagaccctgcctgaacatcgaggacgaccccgacatccacgagaagcccttcctgagcagcagcgccccccccatcaccagcctgagcctgctgggcaacttcgaggagagcgtgctgaactacagattcgaccccctgggcatcgtggacggcttcaccgccgaggtgggcgccagcggcgccttctgccccacccacctgaccctgcccgtggaggtgagcttctacagcgtgagcgacgacaacgcccccagcccctacatgggcgtgatcaccctggagagcctgggcaagagaggctacagagtgccccccagcggcaccatccaggtgtag

SEQ ID NO: 21101 - DNA, 3252 bp, Artificial Sequence
  Description of Artificial Sequence: Synthetic coding sequence
atggtgttcagcggcaacaagggcctgcacagagaggacaccctggacgagtacttcgagtacgacgccgaggagttcctggtgagcctggccctgctgatcaccgagggcagaacccccgagtgcagcgtgaagggcagaaccgagagcttccactgcccccccgcccagagctgctaccccgtgaccaccaagcacgagtgcagcgacaagctggcccagtgcagacaggccagaagaaccagaagcgaggtgaccctgctgtggaagaacaacctgcccatcatggtggagatgatgctgctgcccgactgctgctacagcgacgacggccccaccaccgagggcatcgacctgaacgaccccgccatcaagcaggacgccctgctgctggagagatggatcctggagcccgtgcccagacagaacggcgacagattcatcgaggagaagaccctgctgctggccgtgagaagcttcgtgttcttcagccagctgagcgcctggctgagcgtgagccacggcgccatccccagaaacatcctgtacagaatcagcgccgccgacgtggacctgcagtggaacttcagccagacccccatcgagcacgtgttccccgtgcccaacgtgagccacaacgtggccctgaaggtgagcgtgcagagcctgcccagacagagcaactaccccgtgctgacctgcagcatccacaccaacatcggcctgtacgagaagagaatccagcagcacaagctgaagacccaccagcaccacaaccccaacgaggccgagcagtgcggcaccaacagcagccagagactgtgcagcaagcagacctggaccatggcccccgagagcgtgctgcacgccaagagcggccccagccccgagtacaccgccgccgtgaagaacatcaagctgtaccccggcaccggcagcaagagcgaccacggcaccagccaggccaacatcctgggcttcagcggcatcggcgacatcaagagccaggagaccagcgtgagaaccctgaagagcttcagcatggtggacagcagcatcagcaacagacagagcttctggcagagcgccggcgagaccaaccccctgatcggcagcctgatccaggagagacaggagatcatcgccagaatcgcccagcacctgatccactgcgaccccagcaccagccacgtgagcggcagacccttcaacacccaggagagcagcagcctgcacagcaagctgttcagagtgagccaggagaacgagaacgtgggcaagggcaaggaggccttcagcatgaccttcggcagccccgagttcagcagccccgaggacaccaacgagggcaagatcagactgaagcccgagacccccagaagcgagacctgcatcagcaacgacttctacagccacatgcccgtgggcgagaccaaccccctgatcggcagcctgctgcaggagagacaggacgtgatcgccagaatcgcccagcacctggagcacatcgaccccaccgccagccacatccccagacagagcttcaacatgcacgacagcagcagcgtggccagcaaggtgttcagaagcagctacgaggacaagaacctgctgaagaagaacaaggacgagagcagcgtgagcatcagccacaccaagtgcagcctgctgggcgacatcagcgacggcaagaacctggtgcccaacaagtgcttcaccagcttcaagaacaacagcaaggagaagtgcagcctgaagcaccagaccagaaaccagtgccagaacaaccccagcgagatcatccagagcacctaccaggagacccagaacaagagcagcagcctgagcaccagcagcatcctgagccagcacaaggagaacaacctggacctgaccagcagattcaaggagcaggagatgagcaacggcatcgacaagcagtacagcaactgcaccaccatcgacaagcagatctgcaccaacaagtacaaggagaagatcatcaacgagaactacaaccccaagttcttcggcaacctgcagagcgacgacagcaagaagaacgacagcaagatcaaggtgaccgtgctggagatgagcgagtacctgaacaagtacgagagcatgagcagcaacaaggacagcaagagacccaagacctgcgagcagaacacccagctgaacagcatcgagaactacctgaacaaggacaacgagggcttcaagtgcaagaagagcgaccagctgaagaacgagcaggacaagcaggaggaccccaccaacgagaagagccagaactacagccagagaagaagcatcaaggactgcctgagcacctgcgagcagcccaagaacaccgaggtgctgagaaccaccctgaagcacagcaacgtgtggagaaagcacaacttccacagcctggacggcaccagcaccagagccttccacccccagaccggcctgcccctgctgagcagccccgtgccccagagaaagacccagagcggctgcttcgacctggacagcagcctgctgcacctgaagagcttcagcagcagaagccccagaccctgcctgaacatcgaggacgaccccgacatccacgagaagcccttcctgagcagcagcgccccccccatcaccagcctgagcctgctgggcaacttcgaggagagcgtgctgaactacagattcgaccccctgggcatcgtggacggcttcaccgccgaggtgggcgccagcggcgccttctgccccacccacctgaccctgcccgtggaggtgagcttctacagcgtgagcgacgacaacgcccccagcccctacatgggcgtgatcaccctggagagcctgggcaagagaggctacagagtgccccccagcggcaccatccaggtgaccctgttcaaccccaacaagaccgtggtgaagatgttcgtggtgatctacgacctgagagacatgcccgccaaccaccagaccttcctgagacagagaaccttcagcgtgcccgtgaagcaggaggtgaagagaagcgtgaacaaggagaacatcagacacaccgaggagagactgctgagatacctgatccacctgagattccagagcagcaagagcggcaagatctacctgcacagagacgtgagactgctgttcagcagaaagagcatggaggtggacagcggcgccgcctacgagctgaagagctacaccgagagccccaccaacccccagttcagccccagatgctag

SEQ ID NO: 21102 - DNA, 1890 bp, Artificial Sequence
  Description of Artificial Sequence: Synthetic coding sequence
atggaggtgaagggccccagcggcagaagcttctgctgcgagagcgagggccagttcaagagctgcctgaagagacacacccccagcctgctgctgcccagcagctggaagggcaacagcggcagctgcctgatggccaaggccctgcacagaatgagccccacccccaacagctgccccctgcccctgcccctgtgcagaatgagcggcgtgctgtgcagcagaaacctgttcaccttcaagttcagcctgttccagctggacagcggcgccagcggcgagcccggccacagcctgggcctgaccctgggcttcagccactgcggcaactgccagaccgccgtggtgagcgcccagcccgagggcatggccagcaacggcgcctaccccgccctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaccctgcccagcacccccctggtgaccgagcaggacggctgcggccccagcggcgccggcgccagcaacgtgttcgtgcagatgagaaccgaggtgggccccgtgaaggccgcccaggcccagaccctggtgctgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagggcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagggcgcccccagcgacgcccccggcaccgacagatgctag

SEQ ID NO: 21103 - DNA, 2637 bp, Artificial Sequence
  Description of Artificial Sequence: Synthetic coding sequence
atggaggtgaagggccccagcggcagaagcttctgctgcgagagcgagggccagttcaagagctgcctgaagagacacacccccagcctgctgctgcccagcagctggaagggcaacagcggcagctgcctgatggccaaggccctgcacagaatgagccccacccccaacagctgccccctgcccctgcccctgtgcagaatgagcggcgtgctgtgcagcagaaacctgttcaccttcaagttcagcctgttccagctggacagcggcgccagcggcgagcccggccacagcctgggcctgaccctgggcttcagccactgcggcaactgccagaccgccgtggtgagcgcccagcccgagggcatggccagcaacggcgcctaccccgccctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaccctgcccagcacccccctggtgaccgagcaggacggctgcggccccagcggcgccggcgccagcaacgtgttcgtgcagatgagaaccgaggtgggccccgtgaaggccgcccaggcccagaccctggtgctgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagggcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgtgccccagcagggcgtgggcatggagacctgccccccccagaccaccgccagagacagccagggcagaggcagagcccacaccggcatggccagaagcaaggacagcgtggtgctgctgggctgccaggacagccccggcctgagagccgccagacccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagttccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21104 - DNA, 2418 bp, Artificial Sequence
  Description of Artificial Sequence: Synthetic coding sequence
atgttccaggagcccgtgtacttccagatcttcttccagctggacagcggcgccagcggcgagcccggccacagcctgggcctgaccctgggcttcagccactgcggcaactgccagaccgccgtggtgagcgcccagcccgagggcatggccagcaacggcgcctaccccgccctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaccctgcccagcacccccctggtgaccgagcaggacggctgcggccccagcggcgccggcgccagcaacgtgttcgtgcagatgagaaccgaggtgggccccgtgaaggccgcccaggcccagaccctggtgctgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagggcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgtgccccagcagggcgtgggcatggagacctgccccccccagaccaccgccagagacagccagggcagaggcagagcccacaccggcatggccagaagcaaggacagcgtggtgctgctgggctgccaggacagccccggcctgagagccgccagacccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagttccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21105 - DNA, 789 bp, Artificial Sequence
  Description of Artificial Sequence: Synthetic coding sequence
atggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgtgccccagcagggcgtgggcatggagacctgccccccccagaccaccgccagagacagccagggcagaggcagagcccacaccgccagcggcctgctgagccccgagaagtggggcccccagggcacccaccagttccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21106 - DNA, 1971 bp, Artificial Sequence
  Description of Artificial Sequence: Synthetic coding sequence
tgactgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagggcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgtgccccagcagggcgtgggcatggagacctgccccccccagaccaccgccagagacagccagggcagaggcagagcccacaccggcatggccagaagcaaggacagcgtggtgctgctgggctgccaggacagccccggcctgagagccgccagacccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagttccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21107 - DNA, 1866 bp, Artificial Sequence
  Description of Artificial Sequence: Synthetic coding sequence
atggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagagcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcaaggtgaagcagccccaggaggaggactggaccccccccgaccccggcctgctgagctacatcgacaagctgtgcagccagaaggacttcgtgaccaaggtggaggccgtgatccacccccagttcctggaggagctgctgagccccgacccccagatggacttcctggccctgagccaggacctggagcaggaggagggcctgaccctggcccagctggtggagaagagactgccccccctgaaggagaagcagcacgccagagccgcccccagcagaggcaccgccagactggacagcagcagcagcaagttcgccgccggccagggcgccgagagagacgtgcccgacccccagcagggcgtgggcatggagacctgccccccccagatgaccgccagagacagccagggcagaggcagagcccacaccggcatggccagaagcgaggacagcgtggtgctgctgggctgccaggacagccccggcctgagagccgcctggcccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagagccccagcgccgagagaagaggcctgaacctggcccccagccccgccaacaaggccaagaagagacccctgttcggcagcctgagccccgccgagaagaccccctaccccggccccggcctgagagtgagcggcgagcagagcctgacctggggcctgggcggccccagccagagccagaagagaaagggcgaccccctggtgagcagaaaggagaagaagcagcactgcagccagtag

SEQ ID NO: 21108 - DNA, 1689 bp, Artificial Sequence
  Description of Artificial Sequence: Synthetic coding sequence
atgagcggcgtgctgtgcagcagaaacctgttcaccttcaagttcagcctgttccagctggacagcggcgccagcggcgagcccggccacagcctgggcctgaccctgggcttcagctactgcggcaactgccagaccgccgtggtgagcgcccagcccgagggcatggccagcaacggcgcctaccccgtgctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaccttccccagcacccccctggtgaccgagcaggacggctgcggccccagcggcgccggcgccagcaacgtgttcgtgcagatgagaaccgaggtgggccccgtgaaggccgcccaggcccagaccctggtgctgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagagcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcaaggtgaagcagccccaggaggaggactggaccccccccgaccccggcctgctgagctacatcgacaagctgtgcagccagaaggacttcgtgaccaaggtggaggccgtgatccacccccagttcctggaggagctgctgagccccgacccccagatggacttcctggccctgagccaggacctggagcaggaggagggcctgaccctggcccagggcgcccccagcgacgcccccggcaccgacagatgctag

SEQ ID NO: 21109 - DNA, 2637 bp, Artificial Sequence
  Description of Artificial Sequence: Synthetic coding sequence
atggaggtgaagggccccagcggcagaagcttctgctgcgagagcgagggccagttcaagagctgcctgaagagacacacccccagcctgctgctgcccagcagctggaagggcaacagcggcagctgcctgatggccgaggccctgcacagaaccagccccacccccaacagctgccccctgcccctgcccctgtgcagaatgagcggcgtgctgtgcagcagaaacctgttcaccttcaagttcagcctgttccagctggacagcggcgccagcggcgagcccggccacagcctgggcctgaccctgggcttcagctactgcggcaactgccagaccgccgtggtgagcgcccagcccgagggcatggccagcaacggcgcctaccccgtgctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaccttccccagcacccccctggtgaccgagcaggacggctgcggccccagcggcgccggcgccagcaacgtgttcgtgcagatgagaaccgaggtgggccccgtgaaggccgcccaggcccagaccctggtgctgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagagcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcaaggtgaagcagccccaggaggaggactggaccccccccgaccccggcctgctgagctacatcgacaagctgtgcagccagaaggacttcgtgaccaaggtggaggccgtgatccacccccagttcctggaggagctgctgagccccgacccccagatggacttcctggccctgagccaggacctggagcaggaggagggcctgaccctggcccagctggtggagaagagactgccccccctgaaggagaagcagcacgccagagccgcccccagcagaggcaccgccagactggacagcagcagcagcaagttcgccgccggccagggcgccgagagagacgtgcccgacccccagcagggcgtgggcatggagacctgccccccccagatgaccgccagagacagccagggcagaggcagagcccacaccggcatggccagaagcgaggacagcgtggtgctgctgggctgccaggacagccccggcctgagagccgcctggcccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagagccccagcgccgagagaagaggcctgaacctggcccccagccccgccaacaaggccaagaagagacccctgttcggcagcctgagccccgccgagaagaccccctaccccggccccggcctgagagtgagcggcgagcagagcctgacctggggcctgggcggccccagccagagccagaagagaaagggcgaccccctggtgagcagaaaggagaagaagcagcactgcagccagtag

SEQ ID NO: 21110 - DNA, 1890 bp, Artificial Sequence
  Description of Artificial Sequence: Synthetic coding sequence
atggaggtgaagggccccagcggcagaagcttctgctgcgagagcgagggccagttcaagagctgcctgaagagacacacccccagcctgctgctgcccagcagctggaagggcaacagcggcagctgcctgatggccgaggccctgcacagaaccagccccacccccaacagctgccccctgcccctgcccctgtgcagaatgagcggcgtgctgtgcagcagaaacctgttcaccttcaagttcagcctgttccagctggacagcggcgccagcggcgagcccggccacagcctgggcctgaccctgggcttcagctactgcggcaactgccagaccgccgtggtgagcgcccagcccgagggcatggccagcaacggcgcctaccccgtgctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaccttccccagcacccccctggtgaccgagcaggacggctgcggccccagcggcgccggcgccagcaacgtgttcgtgcagatgagaaccgaggtgggccccgtgaaggccgcccaggcccagaccctggtgctgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagagcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcaaggtgaagcagccccaggaggaggactggaccccccccgaccccggcctgctgagctacatcgacaagctgtgcagccagaaggacttcgtgaccaaggtggaggccgtgatccacccccagttcctggaggagctgctgagccccgacccccagatggacttcctggccctgagccaggacctggagcaggaggagggcctgaccctggcccagggcgcccccagcgacgcccccggcaccgacagatgctag

SEQ ID NO: 21111 - DNA, 2634 bp, Artificial Sequence
  Description of Artificial Sequence: Synthetic coding sequence
atggaggtgaagggccccagcggcagaagcttctgctgcgagagcgagggccagttcaagagctgcctgaagagacacacccccagcctgctgctgcccagcagctggaagggcaacagcggcagctgcctgatggccgaggccctgcacagaatgagccccacccccaacagctgccccctgcccctgcccctgtgcagaatgagcggcgtgctgtgcagcagaaacctgttcaccttcaagttcagcttccagctggacagcggcgccagcggcgagcccggccacagcctgggcctgaccctgggcttcagccactgcggcaactgccagaccgccgtggtgagcgcccagcccgagggcatggccagcaacggcgcctaccccgccctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaacttccccagcacccccctggtgaccgagcaggacggctgcggccccagcggcgccggcgccagcaacgtgttcgtgcagatgagaaccgaggtgggccccgtgaaggccgcccaggcccagaccctggtgctgacccagacccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagggcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgacccccagcagggcgtgggcatggagacctgccccccccagaccaccgccagagacagccagggcagaggcagagcccacaccggcatggccagaagcaaggacagcgtggtgctgctgggctgccaggacagccccggcctgagagccgccagacccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagagccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21112 - DNA, 789 bp, Artificial Sequence
  Description of Artificial Sequence: Synthetic coding sequence
atggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgacccccagcagggcgtgggcatggagacctgccccccccagaccaccgccagagacagccagggcagaggcagagcccacaccgccagcggcctgctgagccccgagaagtggggcccccagggcacccaccagagccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21113 - DNA, 2421 bp, Artificial Sequence
  Description of Artificial Sequence: Synthetic coding sequence
atgttccaggagcccgtgtacttccagatcttcctgttccagctggacagcggcgccagcggcgagcccggccacagcctgggcctgaccctgggcttcagccactgcggcaactgccagaccgccgtggtgagcgcccagcccgagggcatggccagcaacggcgcctaccccgccctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaacttccccagcacccccctggtgaccgagcaggacggctgcggccccagcggcgccggcgccagcaacgtgttcgtgcagatgagaaccgaggtgggccccgtgaaggccgcccaggcccagaccctggtgctgacccagacccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagggcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgacccccagcagggcgtgggcatggagacctgccccccccagaccaccgccagagacagccagggcagaggcagagcccacaccggcatggccagaagcaaggacagcgtggtgctgctgggctgccaggacagccccggcctgagagccgccagacccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagagccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21114 - DNA, 1674 bp, Artificial Sequence
  Description of Artificial Sequence: Synthetic coding sequence
atgttccaggagcccgtgtacttccagatcttcctgttccagctggacagcggcgccagcggcgagcccggccacagcctgggcctgaccctgggcttcagccactgcggcaactgccagaccgccgtggtgagcgcccagcccgagggcatggccagcaacggcgcctaccccgccctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaacttccccagcacccccctggtgaccgagcaggacggctgcggccccagcggcgccggcgccagcaacgtgttcgtgcagatgagaaccgaggtgggccccgtgaaggccgcccaggcccagaccctggtgctgacccagacccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagggcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccccaccgcctgcctgcccccccccagaccccagagacccgtgaccaaggccagaagacccccccccagaccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagggcgcccccagcgacgcccccggcaccgacagatgctag

SEQ ID NO: 21115 - DNA, 759 bp, Artificial Sequence
  Description of Artificial Sequence: Synthetic coding sequence
tgaaccggcgagcccgagaagcagagagaggagggcgaggtgaagcagccccaggaggaggactggaccccccccgaccccggcctgctgagctacaccgacaagctgtgcagccagaaggacttcgtgaccaaggtggaggccgtgatccacccccagttcctggaggagctgctgagccccgacccccagatggacttcctggccctgagccaggagctggagcaggaggagggcctgaccctggcccagctggtggagaagagactgctgcccctgaaggagaagcagcacgccagagccgcccccagcagaggcaccgccagactggacagcagcagcagcaagttcgccgccggccagggcgccgagagagacgtgcccgacccccagcagggcgtgggcatggagacctgccccccccagaccaccgccagagacagccagggcagaggcagagcccacaccgccagcggcctgctgagccccgagaagtggggcccccagggcacccaccagagccccagcgccgagagaagaggcctgaacctggcccccagccccgccaacaaggccaagaagagacccctgttcggcagcctgagccccgccgagaagaccccccaccccggccccggcctgagagtgagcggcgagcagagcctgacctggggcctgggcggccccagccagagccagaagagaaagggcgaccccctggtgagcagaaaggagaagaagcagagatgcagccagtag

SEQ ID NO: 21116 - DNA, 2637 bp, Artificial Sequence
  Description of Artificial Sequence: Synthetic coding sequence
atggaggtgaagggccccagcggcagaagcttctgctgcgagagcgagggccagttcaagagctgcctgaagagacacacccccagcctgctgctgcccagcagctggaagggcaacagcggcagctgcctgatggccgaggccctgcacagaaccagccccacccccaacagctgccccctgcccctgcccctgtgcagaatgagcggcgtgctgtgcagcagaaacctgttcaccttcaagttcagcctgttccagctggacagcggcgccagcggcgagcccggccacagcctgggcctgaccctgggcttcagctactgcggcaactgccagaccgccgtggtgagcgcccagcccgagggcatggccagcaacggcgcctaccccgtgctgggccccggcgtgaccgccaaccccggcaccagcctgagcgtgttcaccgccctgcccttcaccacccccgcccccggccccgcccacggccccctgctggtgaccgccggcgccccccccggcggccccctggtgctgagcaccttccccagcacccccctggtgaccgagcaggacggctgcagccccagcggcgccggcgccagcaacgtgttcgtgcagatgagaaccgaggtgggccccgtgaaggccgcccaggcccagaccctggtgctgacccaggcccccctggtgtggcaggcccccggcgccctgtgcggcggcgtggtgtgccccccccccctgctgctggccgccgcccccgtggtgcccgtgatggccgcccaggtggtgggcggcacccaggcctgcgagggcggctggagccagggcctgcccctgccccccccccccccccccgccgcccagctgccccccatcgtgagccagggcaacgccggcccctggccccagggcgcccacggcgagagcagcctggccagcagccaggccaaggccccccccgacgacagctgcaaccccagaagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgagaagttcctggagttcgaggccgaggaggagatgcagatccagaagagccagtggatgaagggcccccagtgcctgcccccccccgccacccccagactggagcccagaggcccccccgcccccgaggtggtgaagcagcccgtgtacctgcccagcaaggccggccccaaggcccagaccgcctgcctgcccccccccagaccccagagacccgtgaccaaggccagaagaccccccccccagccccacagaagagccgagaccaaggccagactgcccccccccagaccccagagacccgccgagaccaaggtgcccgaggagatcccccccgaggtggtgcaggagtacgtggacatcatggaggagctgctgggccccagcctgggcgccaccggcgagcccgagaagcagagagaggagggcaaggtgaagcagccccaggaggaggactggaccccccccgaccccggcctgctgagctacatcgacaagctgtgcagccagaaggacttcgtgaccaaggtggaggccgtgatccacccccagttcctggaggagctgctgagccccgacccccagatggacttcctggccctgagccaggacctggagcaggaggagggcctgaccctggcccagctggtggagaagagactgccccccctgaaggagaagcagcacagcagagccgcccccagcagaggcaccgccagactggacagcagcagcagcaagttcgccgccggccagggcgccgagagagacgtgcccgacccccaggagggcgtgggcatggagacctgccccccccagaccaccgccagagacagccagggcagaggcagagcccacaccggcatggccagaagcgaggacagcgtggtgctgctgggctgccaggacagccccggcctgagagccgccagacccaccagccccccccaggaccacagacccacctgccccggcgtgggcaccaaggacgccctggacctgcccggcggcagccccgtgagagagagccacggcctggcccagggcagcagcgaggaggaggagctgcccagcctggccttcctgctgggcagccagcacaagctgctgccctggtggctgccccagagccccgtgcccgccagcggcctgctgagccccgagaagtggggcccccagggcacccaccagagccccagcgccgagagaagaggcctgaacctggcccccagccccgccaacaaggccaagaagcagcccctgttcggcagcctgagccccgccgagaagaccccccacagaggccccggcctgagagtgagcggcgagcagagcctgacctggggcctgggcggccccagccagagccagaagagaaagggcgaccccctggtgagcagaaaggagaagaagcagcactgcagccagtag

SEQ ID NO: 21117 - DNA, 2271 bp, Artificial Sequence
  Description of Artificial Sequence: Synthetic coding sequence
atggccagcaacggcgcctaccccgtgctgggccccggcgtgaccgtgaaccccggcaccagcctgagcgtgttcaccgccctgcccttcgccacccccgcccccggccccgcccacagaccccccctggtgaccgccgtggtgccccccgccggccccctggtgctgagcgccttccccagcacccccctggtggccggccaggacggcagaggccccagcggcgccggcgccagcaacgtgttcgtgcagatgagaaccgaggtgggccccgtgaagcccccccaggcccagaccctgatcctgacccaggcccccctggtgtggcaggcccccggcaccctgtgcggcggcgtgatgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccagaccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggcaggccatgagagagtggcagcacaccagcaacttcgacagaatgatcttctacgagatggccgagaagttcctggagttcgaggccgaggaggagatgcagatccagaagagccagtggatgaagggcccccagagcctgcccccccccgccccccccagactggagcccagaggcccccccgcccccgaggtggtgaagcagcccgtgtacctgcccagcaaggacggccccaaggcccccaccgcctgcctgcccccccccagaccccagagacccgccgagaccaaggcccacctgcccccccccagaccccagagacccgccgagaccaacgcccacctgcccccccccagaccccagagacccgccgagaccaaggtgcccgaggagatcccccccgaggtggtgcaggagtacgtggacatcatggaggagctgctgggcagccaccccggcgacaccggcgagcccgagggccagagagagaagggcaaggtggagcagccccaggaggaggacggcatcaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagctggtggagaagagactgctgagcctgaaggagaagggctgcggcagagccgcccccagacacggcaccgccagactggacagcagccccagcgagttcgccgccggccaggaggccgccagagaggtgcccgacccccagcagagagtgagcgtggagaccagccccccccagaccgccgcccaggacccccagggccagggcagagtgagaaccggcatggccagaagcgaggaccccgccgtgctgctgggctgccaggacagccccagactgaaggccgtgagacccaccagccccccccaggaccacagacccacctgccccggcctgggcaccaaggacgccctgggcctgcccggcgagagccccgtgaaggagagccacggcctggccaagggcagcagcgaggagaccgagctgcccggcatggtgtacgtggtgggcagccaccacagactgagaccctggagactgagccagagccccgtgcccagcagcggcctgctgagccccggcggcagaggcccccagggcgccctgcagagccccagcgcccagaagagaggcctgagccccagccccagccccgccagcaagagcaagaagagacccctgttcggcagccccagccccgccgagaagaccccccaccccggccccggcctgagagtgagcggcgagcagagcctggcctggggcctgggcggccccagccagagccagaagagaaagggcgaccccctggccagcagaagaaagaagaagagacactgcagccagtag

SEQ ID NO: 21118 - DNA, 1479 bp, Artificial Sequence
  Description of Artificial Sequence: Synthetic coding sequence
atggccagcaacggcgcctaccccgtgctgggccccggcgtgaccgtgaaccccggcaccagcctgagcgtgttcaccgccctgcccttcgccacccccgcccccggccccgcccacagaccccccctggtgaccgccgtggtgccccccgccggccccctggtgctgagcgccttccccagcacccccctggtggccggccaggacggcagaggccccagcggcgccggcgccagcaacgtgttcgtgcagatgagaaccgaggtgggccccgtgaagcccccccaggcccagaccctgatcctgacccaggcccccctggtgtggcaggcccccggcaccctgtgcggcggcgtgatgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccagaccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggcaggccatgagagagtggcagcacaccagcaacttcgacagaatgatcttctacgagatggccgagaagttcctggagttcgaggccgaggaggagatgcagatccagaagagccagtggatgaagggcccccagagcctgcccccccccgccccccccagactggagcccagaggcccccccgcccccgaggtggtgaagcagcccgtgtacctgcccagcaaggacggccccaaggcccccaccgcctgcctgcccccccccagaccccagagacccgccgagaccaaggcccacctgcccccccccagaccccagagacccgccgagaccaaggtgcccgaggagatcccccccgaggtggtgcaggagtacgtggacatcatggaggagctgctgggcagccaccccggcgacaccggcgagcccgagggccagagagagaagggcaaggtggagcagccccaggaggaggacggcatcaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagggcgcccccagcgacgccctgggcaccgacagatgctag

SEQ ID NO: 21119 - DNA, 2226 bp, Artificial Sequence
  Description of Artificial Sequence: Synthetic coding sequence
atggccagcaacggcgcctaccccgtgctgggccccggcgtgaccgtgaaccccggcaccagcctgagcgtgttcaccgccctgcccttcgccacccccgcccccggccccgcccacagaccccccctggtgaccgccgtggtgccccccgccggccccctggtgctgagcgccttccccagcacccccctggtggccggccaggacggcagaggccccagcggcgccggcgccagcaacgtgttcgtgcagatgagaaccgaggtgggccccgtgaagcccccccaggcccagaccctgatcctgacccaggcccccctggtgtggcaggcccccggcaccctgtgcggcggcgtgatgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccagaccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggcaggccatgagagagtggcagcacaccagcaacttcgacagaatgatcttctacgagatggccgagaagttcctggagttcgaggccgaggaggagatgcagatccagaagagccagtggatgaagggcccccagagcctgcccccccccgccccccccagactggagcccagaggcccccccgcccccgaggtggtgaagcagcccgtgtacctgcccagcaaggacggccccaaggcccccaccgcctgcctgcccccccccagaccccagagacccgccgagaccaaggcccacctgcccccccccagaccccagagacccgccgagaccaaggtgcccgaggagatcccccccgaggtggtgcaggagtacgtggacatcatggaggagctgctgggcagccaccccggcgacaccggcgagcccgagggccagagagagaagggcaaggtggagcagccccaggaggaggacggcatcaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagctggtggagaagagactgctgagcctgaaggagaagggctgcggcagagccgcccccagacacggcaccgccagactggacagcagccccagcgagttcgccgccggccaggaggccgccagagaggtgcccgacccccagcagagagtgagcgtggagaccagccccccccagaccgccgcccaggacccccagggccagggcagagtgagaaccggcatggccagaagcgaggaccccgccgtgctgctgggctgccaggacagccccagactgaaggccgtgagacccaccagccccccccaggaccacagacccacctgccccggcctgggcaccaaggacgccctgggcctgcccggcgagagccccgtgaaggagagccacggcctggccaagggcagcagcgaggagaccgagctgcccggcatggtgtacgtggtgggcagccaccacagactgagaccctggagactgagccagagccccgtgcccagcagcggcctgctgagccccggcggcagaggcccccagggcgccctgcagagccccagcgcccagaagagaggcctgagccccagccccagccccgccagcaagagcaagaagagacccctgttcggcagccccagccccgccgagaagaccccccaccccggccccggcctgagagtgagcggcgagcagagcctggcctggggcctgggcggccccagccagagccagaagagaaagggcgaccccctggccagcagaagaaagaagaagagacactgcagccagtag

SEQ ID NO: 21120 - DNA, 1773 bp, Artificial Sequence
  Description of Artificial Sequence: Synthetic coding sequence
atggccagcaacggcgcctaccccgtgctgggccccggcgtgaccgtgaaccccggcaccagcctgagcgtgttcaccgccctgcccttcgccacccccgcccccggccccgcccacagaccccccctggtgaccgccgtggtgccccccgccggccccctggtgctgagcgccttccccagcacccccctggtggccggccaggacggcagaggccccagcggcgccggcgccagcaacgtgttcgtgcagatgagaaccgaggtgggccccgtgaagcccccccaggcccagaccctgatcctgacccaggcccccctggtgtggcaggcccccggcaccctgtgcggcggcgtgatgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccagaccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagaaggtggtgcaggagtacgtggacatcatggaggagctgctgggcagccaccccggcgacaccggcgagcccgagggccagagagagaagggcaaggtggagcagccccaggaggaggacggcatcaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagctggtggagaagagactgctgagcctgaaggagaagggctgcggcagagccgcccccagacacggcaccgccagactggacagcagccccagcgagttcgccgccggccaggaggccgccagagaggtgcccgacccccagcagagagtgagcgtggagaccagccccccccagaccgccgcccaggacccccagggccagggcagagtgagaaccggcatggccagaagcgaggaccccgccgtgctgctgggctgccaggacagccccagactgaaggccgtgagacccaccagccccccccaggaccacagacccacctgccccggcctgggcaccaaggacgccctgggcctgcccggcgagagccccgtgaaggagagccacggcctggccaagggcagcagcgaggagaccgagctgcccggcatggtgtacgtggtgggcagccaccacagactgagaccctggagactgagccagagccccgtgcccagcagcggcctgctgagccccggcggcagaggcccccagggcgccctgcagagccccagcgcccagaagagaggcctgagccccagccccagccccgccagcaagagcaagaagagacccctgttcggcagccccagccccgccgagaagaccccccaccccggccccggcctgagagtgagcggcgagcagagcctggcctggggcctgggcggccccagccagagccagaagagaaagggcgaccccctggccagcagaagaaagaagaagagacactgcagccagtag

SEQ ID NO: 21121 - DNA, 1479 bp, Artificial Sequence
  Description of Artificial Sequence: Synthetic coding sequence
atggccagcaacggcgcctaccccgtgctgggccccggcgtgaccgtgaaccccggcaccagcctgagcgtgttcaccgccctgcccttcgccacccccagccccggccccacccacagaccccccctggtgaccgccgtggtgccccccgccggccccctggtgctgagcgccttccccagcacccccctggtggccggccaggacggcagaggccccagcggcgccggcgccagcaacgtgttcgtgcagatgagaaccgaggtgggccccgtgaagcccccccaggcccagaccctgatcctgacccaggcccccctggtgtggcaggcccccggcaccctgtgcggcggcgtgatgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccggcccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgccaagttcctggagttcgaggccgaggaggagatgcagatccagaagagccagtggatgaagggcccccagagcctgcccccccccgccccccccagactggagcccagaggcccccccgcccccgaggtggtgaagcagcccgtgtacctgcccagcaaggacggccccaaggcccccaccgcctgcctgcccccccccagaccccagagacccgccgagaccaaggcccacctgcccccccccagaccccccagacccgccgagaccaaggtgcccgaggagatcccccccgaggtggtgcaggagtacgtggacatcatggaggagctgctgggcagccaccccggcgacaccggcgagcccgagggccagagagagaagggcaaggtggagcagccccaggaggaggacggcatgaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagggcgcccccagcgacgccctgggcaccgacagatgctag

SEQ ID NO: 21122 - DNA, 2226 bp, Artificial Sequence
  Description of Artificial Sequence: Synthetic coding sequence
atggccagcaacggcgcctaccccgtgctgggccccggcgtgaccgtgaaccccggcaccagcctgagcgtgttcaccgccctgcccttcgccacccccagccccggccccacccacagaccccccctggtgaccgccgtggtgccccccgccggccccctggtgctgagcgccttccccagcacccccctggtggccggccaggacggcagaggccccagcggcgccggcgccagcaacgtgttcgtgcagatgagaaccgaggtgggccccgtgaagcccccccaggcccagaccctgatcctgacccaggcccccctggtgtggcaggcccccggcaccctgtgcggcggcgtgatgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccggcccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgccaagttcctggagttcgaggccgaggaggagatgcagatccagaagagccagtggatgaagggcccccagagcctgcccccccccgccccccccagactggagcccagaggcccccccgcccccgaggtggtgaagcagcccgtgtacctgcccagcaaggacggccccaaggcccccaccgcctgcctgcccccccccagaccccagagacccgccgagaccaaggcccacctgcccccccccagaccccccagacccgccgagaccaaggtgcccgaggagatcccccccgaggtggtgcaggagtacgtggacatcatggaggagctgctgggcagccaccccggcgacaccggcgagcccgagggccagagagagaagggcaaggtggagcagccccaggaggaggacggcatgaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagctggtggagaagagactgctgagcctgaaggagaagggctgcggcagagccgcccccagacacggcaccgccagactggacagcagccccagcgagttcgccgccggccaggaggccgccagagaggtgcccgacccccagcagagagtgagcgtggagaccagccccccccagaccgccgcccaggacccccagggccagggcagagtgagaaccggcatggccagaagcgaggaccccgccgtgctgctgggctgccaggacagccccagactgaaggccgtgagacccaccagccccccccaggaccacagacccacctgccccggcctgggcaccaaggacgccctgggcctgcccggcgagagccccgtgaaggagagccacggcctggccaagggcagcagcgaggagaccgagctgcccggcatggtgtacgtggtgggcagccaccacagactgagaccctggagactgagccagagccccgtgcccagcagcggcctgctgagccccggcggcagaggcccccagggcgccctgcagagccccagcgcccagaagagaggcctgagccccagccccagccccgccagcaagagcaagaagagacccctgttcggcagccccagccccgccgagaagaccccccaccccggccccggcctgagagtgagcggcgagcagagcctggcctggggcctgggcggccccagccagagccagaagagaaagggcgaccccctggccagcagaagaaagaagaagagacactgcagccagtag

SEQ ID NO: 21123 - DNA, 1869 bp, Artificial Sequence
  Description of Artificial Sequence: Synthetic coding sequence
atgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccggcccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagagccccgacaccgaggccctgagctgcttcctgatccccgtgctgagaagcctggccagaagaaagcccaccatgaccctggaggagggcctgtggagagccatgagagagtggcagcacaccagcaacttcgacagaatgatcttctacgagatggccgccaagttcctggagttcgaggccgaggaggagatgcagatccagaagagccagtggatgaagggcccccagagcctgcccccccccgccccccccagactggagcccagaggcccccccgcccccgaggtggtgaagcagcccgtgtacctgcccagcaaggacggccccaaggcccccaccgcctgcctgcccccccccagaccccagagacccgccgagaccaaggcccacctgcccccccccagaccccccagacccgccgagaccaaggtgcccgaggagatcccccccgaggtggtgcaggagtacgtggacatcatggaggagctgctgggcagccaccccggcgacaccggcgagcccgagggccagagagagaagggcaaggtggagcagccccaggaggaggacggcatgaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagctggtggagaagagactgctgagcctgaaggagaagggctgcggcagagccgcccccagacacggcaccgccagactggacagcagccccagcgagttcgccgccggccaggaggccgccagagaggtgcccgacccccagcagagagtgagcgtggagaccagccccccccagaccgccgcccaggacccccagggccagggcagagtgagaaccggcatggccagaagcgaggaccccgccgtgctgctgggctgccaggacagccccagactgaaggccgtgagacccaccagccccccccaggaccacagacccacctgccccggcctgggcaccaaggacgccctgggcctgcccggcgagagccccgtgaaggagagccacggcctggccaagggcagcagcgaggagaccgagctgcccggcatggtgtacgtggtgggcagccaccacagactgagaccctggagactgagccagagccccgtgcccagcagcggcctgctgagccccggcggcagaggcccccagggcgccctgcagagccccagcgcccagaagagaggcctgagccccagccccagccccgccagcaagagcaagaagagacccctgttcggcagccccagccccgccgagaagaccccccaccccggccccggcctgagagtgagcggcgagcagagcctggcctggggcctgggcggccccagccagagccagaagagaaagggcgaccccctggccagcagaagaaagaagaagagacactgcagccagtag

SEQ ID NO: 21124 - DNA, 1773 bp, Artificial Sequence
  Description of Artificial Sequence: Synthetic coding sequence
atggccagcaacggcgcctaccccgtgctgggccccggcgtgaccgtgaaccccggcaccagcctgagcgtgttcaccgccctgcccttcgccacccccagccccggccccacccacagaccccccctggtgaccgccgtggtgccccccgccggccccctggtgctgagcgccttccccagcacccccctggtggccggccaggacggcagaggccccagcggcgccggcgccagcaacgtgttcgtgcagatgagaaccgaggtgggccccgtgaagcccccccaggcccagaccctgatcctgacccaggcccccctggtgtggcaggcccccggcaccctgtgcggcggcgtgatgtgccccccccccctgctgctggccgccgcccccggcgtgcccgtgaccagcgcccaggtggtgggcggcacccaggcctgcgagggcggctggagccacggcctgcccctgcccccccccccccccgccgcccaggtggcccccatcgtgagccccggcaacgccggcccctggccccagggcgcccacggcgagggcagcctggcccccagccaggccaaggccagacccgacgacagctgcaagcccaagagcgtgtacgagaacttcagactgtggcagcactacaagcccctggccagaagacacctgccccagaaggtggtgcaggagtacgtggacatcatggaggagctgctgggcagccaccccggcgacaccggcgagcccgagggccagagagagaagggcaaggtggagcagccccaggaggaggacggcatgaccagcgaccccggcctgctgagctacatcgacaagctgtgcagccaggaggacttcgtgaccaaggtggaggccgtgatccaccccagattcctggaggagctgctgagccccgacccccagatggacttcctggccctgagccaggagctggagcaggaggagggcctgaccctggcccagctggtggagaagagactgctgagcctgaaggagaagggctgcggcagagccgcccccagacacggcaccgccagactggacagcagccccagcgagttcgccgccggccaggaggccgccagagaggtgcccgacccccagcagagagtgagcgtggagaccagccccccccagaccgccgcccaggacccccagggccagggcagagtgagaaccggcatggccagaagcgaggaccccgccgtgctgctgggctgccaggacagccccagactgaaggccgtgagacccaccagccccccccaggaccacagacccacctgccccggcctgggcaccaaggacgccctgggcctgcccggcgagagccccgtgaaggagagccacggcctggccaagggcagcagcgaggagaccgagctgcccggcatggtgtacgtggtgggcagccaccacagactgagaccctggagactgagccagagccccgtgcccagcagcggcctgctgagccccggcggcagaggcccccagggcgccctgcagagccccagcgcccagaagagaggcctgagccccagccccagccccgccagcaagagcaagaagagacccctgttcggcagccccagccccgccgagaagaccccccaccccggccccggcctgagagtgagcggcgagcagagcctggcctggggcctgggcggccccagccagagccagaagagaaagggcgaccccctggccagcagaagaaagaagaagagacactgcagccagtag

SEQ ID NO: 21125 - DNA, 1689 bp, Artificial Sequence; identical to SEQ ID NO: 18981
  Description of Artificial Sequence: Synthetic coding sequence

SEQ ID NO: 21126 - DNA, 960 bp, Artificial Sequence
  Description of Artificial Sequence: Synthetic coding sequence
atgaagaacgtggacagcgacgacctggtgaccggcaccctgcccaagctgaagagcagcaaggagtggctggagcccaagcccctgtgcttcatggaggtgctggccaaggaggacaccgaggccgccatccagagcatcctgtacaaggagaacagcgtgatcaaggagctggacaagtacctgcagcaccacgccttcctgaacgccagaagaaaggagatgctgtacaagagatgggtggactgcgtggccgaccccctgcagaagaagatcatcgagaaggtgtgcagccacaagaagatcaagaagagaagacagggcgagctggacggcttcctgaagcacgtgaacaagaagggcaacgccttcatcgagcactacgaccccaaggagtacgaccccttctacatgagcaagaaggaccccaacttcctgaaggtgaccatcccccccttccacgaccccctgaagaaggcccagtacgacaaggacaacgagaagagaaccctgctgcagtgcgagaccggcaagatctacagcatcaaggagttcaaggaggtggagaaggtgcagctgcacagcagattcccccagatcagcaacagcagacacttcatcacccccaacgagtggctgaagctgcccaccagatacatcgagagcgagttctgcagaagaagaagactgaaggtgaaggtgaacttcaacgactgcagcttcgacctgaagcccctggccagagccccctacctgctggagagccaggaggaggagaagaccgtgatctacaagaacaagggcagcagcttcctggagagagagcccctgtgctaccaggagggcaacaaccccagcgccaaggaggccatcagcgagggctacttcagcagcctgagcctgagcagaaacggcagaaagaccagaatgggcctgccccccagagtgtggggctgctag

SEQ ID NO: 21127 - DNA, 318 bp, Artificial Sequence
  Description of Artificial Sequence: Synthetic coding sequence
atggccaagatgttcgacctgagaaccaagatcatgatcggcatcggcagcagcctgctggtggccgccatggtgctgctgagcgtggtgttctgcctgtacttcaaggtggccaaggccctgaaggccgccaaggaccccgacgccgtggccgtgaagaaccacaaccccgacaaggtgtgctgggccaccaacagccaggccaaggccaccaccatggagagctgccccagcctgcagtgctgcgagggctgcagaatgcacgccagcagcgacagcctgcccccctgctgctgcgacatcaacgagggcctgtag

SEQ ID NO: 21128 - DNA, 291 bp, Artificial Sequence
  Description of Artificial Sequence: Synthetic coding sequence
tgaaccgtgtgctgccacaccatgctgggcggcctgggcaagctggccgccgagggcctggcccacagaaccgagaaggccaccgagggcgccatccacgccgtggaggaggtggtgaaggaggtggtgggccacgccaaggagaccggcgagaaggccatcgccgaggccatcaagaaggcccaggagagcggcgacaagaagatgaaggagatcaccgagaccgtgaccaacaccgtgaccaacgccatcacccacgccgccgagagcctggacaagctgggccagtag

SEQ ID NO: 21129 - DNA, 270 bp, Artificial Sequence; identical to SEQ ID NO: 17856
  Description of Artificial Sequence: Synthetic coding sequence

SEQ ID NO: 21130 - DNA, 291 bp, Artificial Sequence; identical to SEQ ID NO: 21128
  Description of Artificial Sequence: Synthetic coding sequence

SEQ ID NO: 21131 - DNA, 291 bp, Artificial Sequence; identical to SEQ ID NO: 21128
  Description of Artificial Sequence: Synthetic coding sequence

SEQ ID NO: 21132 - DNA, 270 bp, Artificial Sequence; identical to SEQ ID NO: 17856
  Description of Artificial Sequence: Synthetic coding sequence

SEQ ID NO: 21133 - DNA, 270 bp, Artificial Sequence; identical to SEQ ID NO: 17856
  Description of Artificial Sequence: Synthetic coding sequence

SEQ ID NO: 21134 - DNA, 291 bp, Artificial Sequence; identical to SEQ ID NO: 21128
  Description of Artificial Sequence: Synthetic coding sequence

SEQ ID NO: 21135 - DNA, 204 bp, Artificial Sequence
  Description of Artificial Sequence: Synthetic coding sequence
atgagaaagccccaggccggcaccggcgaggccgccagagaccccagcctgagacccgccagaaccgtgctggtgggcgaccaggacgagtacaccgccgccgagaacaagagccccagaggcaccctgtgccccaccggcgagcagagaatccacgccagagaggacgcctgcatcttcagcagactgttcagcgagaagtag

SEQ ID NO: 21136 - DNA, 204 bp, Artificial Sequence; identical to SEQ ID NO: 21135
  Description of Artificial Sequence: Synthetic coding sequence

SEQ ID NO: 21137 - DNA, 378 bp, Artificial Sequence
  Description of Artificial Sequence: Synthetic coding sequence
atgggcatcttccagctgctgagagacagaagaatcagcagcagaggccccggcctgcacacccccaaggccgagcccagaagaagaaagggcctgaccaccggcctgatgacccaggccgagagacagaagcaggcccaccagagacaggccaccatgagagagaccgccctgtggtgcaccggccacatcagacccagaacccacatgcacaccggcacccacacccagaccgacagagagagagagagaaacacccagagactgagagacagagagagaagagagaacggcagacacacccacatccacacccagacccacagacagagcctgatcgccaaggccctgaaggacacccaccccggcaacccctag

SEQ ID NO: 21138 - DNA, 279 bp, Artificial Sequence
  Description of Artificial Sequence: Synthetic coding sequence
atgaccaagccccaggccgagagcggcgaggccgccagacaccccatcttcagacccgccagaagagtgttcggcatcaagatgaccaccctgcagcccagaatcaaggccccccaggagctgaccgtgctgcaggagagaagcagacccaccagcaagaagatggccgtgtgcttccacggcagcagcctgagaagcgaggccacccccagatacagcctggaggaggaggccagaaacggcagatggcagcaggccctgagctggtggcccctgtag

SEQ ID NO: 21139 - DNA, 2508 bp, Artificial Sequence
  Description of Artificial Sequence: Synthetic coding sequence
atgagcggcggcagccaggtgcacatcttctggggcgcccccatcgcccccctgaagatcaccgtgagcgaggacaccgccagcctgatgagcgtggccgacccctggaagaagatccagctgctgtacagccagcacagcctgtacctgaaggacgagaagcagcacaagaacctggagaactacaaggtgcccgagagcatcggcagccccgacctgagcggccacttcctggccaactgcatgaacagacacgtgcacgtgaaggacgacttcgtgagaagcgtgagcgagacccagaacatcgagagccagaagatccacagcagcagactgagcgacatcaccagcagcaacatgcagatctgcggcttcaagagcaccgtgccccacttcaccgaggaggagaagtaccagaagctgctgagcgagaacaagatcagagacgagcagcccaagcaccagcccgacatctgcggcaagaacttcaacaccaacctgttccagctgggccacaagtgcgccgccgtgctggacctggtgtgcagcaccgagaagatcaacatcggccccgaggtggtgcagagagagtgcgtgcccaccgagtaccacgagatccagaaccagtgcctgggcctgttcagcagcaacgccgtggacaagagcagaagcgaggccgccgtgagaaaggtgagcgacctgaagatcagcaccgacaccgagttcctgagcatcatcaccagcagccaggtggccttcctggcccagaagaaggacaagagaagaagccccgtgaacaagggcaacgtgaacatggagaccgagcccaaggccagctacggcgagatcagaatccccgaggagaacagcatccagctggacggcttcaccgaggcctacgagagcggccagaaccaggcctacagcctggagctgttcagccccgtgtgccccaagaccgagaacagcagaatccacatcaacagcgacaagggcctggaggagcacaccggcagccaggagctgttcagcagcgaggacgagctgccccccaacgagatcagaatcgagctgtgcagcagcggcatcctgtgcagccagctgaacaccttccacaagagcgccatcaagagaagctgcaccagcgaggacaaggtgggccagagcgaggccctgagcagagtgctgcaggtggccaagaagatgaagctgatcagcaacggcggcgacagcgccgtggagatggacagaagaaacgtgagcgagttcaagagcatcaagaagaccagcctgatcaagaactgcgacagcaagagccagaagtacaactgcctggtgatggtgctgagcccctgccacgtgaaggagatcaacatcaagttcggccccaacagcggcagcaaggtgcccctggccaccgtgaccgtgatcgaccagagcgagaccaagaagaaggtgttcctgtggagaaccgccgccttctgggccttcaccgtgttcctgggcgacatcatcctgctgaccgacgtggtgatccacgaggaccagtggatcggcgagaccgtgctgcagagcaccttcagcagccagctgctgaacctgggcagctacagcagcatccagcccgaggagtacagcagcgtggtgagcgaggtggtgctgcaggacctgctggcctacgtgagcagcaagcacagctacctgagagacctgccccccagacagccccagagagtgaacagcatcgacttcgtggagctggagcacctgcagcccgacgtgctggtgcacgccgtgctgagagtggtggacttcaccatcctgaccgaggccgtgtacagctacagaggccagaagcagaagaaggtgatgctgaccgtggagcaggcccaggaccagcactacgccctggtgctgtggggccccggcgccgcctggtacccccagctgcagagaaagaagggcgtggtgctgatcaaggcccagatcagcgagctggccttccccatcaccgccagccagaagatcgccctgaacgcccacagcagcctgaagagcatcttcagcagcctgcccaacatcgtgtacaccggctgcgccaagtgcggcctggagctggagaccgacgagaacagaatctacaagcagtgcttcagctgcctgcccttcaccatgaagaagatctactacagacccgccctgatgaccgccatcgacggcagacacgacgtgtgcatcagagtggagagcaagctgatcgagaagatcctgctgaacatcagcgccgactgcctgaacagagtgatcgtgcccagcagcgagatcacctacggcatggtggtggccgacctgttccacagcctgctggccgtgagcgccgagccctgcgtgctgaagatccagagcctgttcgtgctggacgagaacagctaccccctgcagcaggacttcagcctgctggacttctaccccgacatcgtgaagcacggcgccaacgccagactgtag

SEQ ID NO: 21140 - DNA, 2715 bp, Artificial Sequence
  Description of Artificial Sequence: Synthetic coding sequence
atgagcggcggcagccaggtgcacatcttctggggcgcccccatcgcccccctgaagatcaccgtgagcgaggacaccgccagcctgatgagcgtggccgacccctggaagaagatccagctgctgtacagccagcacagcctgtacctgaaggacgagaagcagcacaagaacctggagaactacaaggtgcccgagagcatcggcagccccgacctgagcggccacttcctggccaactgcatgaacagacacgtgcacgtgaaggacgacttcgtgagaagcgtgagcgagacccagaacatcgagagccagaagatccacagcagcagactgagcgacatcaccagcagcaacatgcagatctgcggcttcaagagcaccgtgccccacttcaccgaggaggagaagtaccagaagctgctgagcgagaacaagatcagagacgagcagcccaagcaccagcccgacatctgcggcaagaacttcaacaccaacctgttccagctgggccacaagtgcgccgccgtgctggacctggtgtgcagcaccgagaagatcaacatcggccccgaggtggtgcagagagagtgcgtgcccaccgagtaccacgagatccagaaccagtgcctgggcctgttcagcagcaacgccgtggacaagagcagaagcgaggccgccgtgagaaaggtgagcgacctgaagatcagcaccgacaccgagttcctgagcatcatcaccagcagccaggtggccttcctggcccagaagaaggacaagagaagaagccccgtgaacaagggcaacgtgaacatggagaccgagcccaaggccagctacggcgagatcagaatccccgaggagaacagcatccagctggacggcttcaccgaggcctacgagagcggccagaaccaggcctacagcctggagctgttcagccccgtgtgccccaagaccgagaacagcagaatccacatcaacagcgacaagggcctggaggagcacaccggcagccaggagctgttcagcagcgaggacgagctgccccccaacgagatcagaatcgagctgtgcagcagcggcatcctgtgcagccagctgaacaccttccacaagagcgccatcaagagaagctgcaccagcgaggacaaggtgggccagagcgaggccctgagcagagtgctgcaggtggccaagaagatgaagctgatcagcaacggcggcgacagcgccgtggagatggacagaagaaacgtgagcgagttcaagagcatcaagaagaccagcctgatcaagaactgcgacagcaagagccagaagtacaactgcctggtgatggtgctgagcccctgccacgtgaaggagatcaacatcaagttcggccccaacagcggcagcaaggtgcccctggccaccgtgaccgtgatcgaccagagcgagaccaagaagaaggtgttcctgtggagaaccgccgccttctgggccttcaccgtgttcctgggcgacatcatcctgctgaccgacgtggtgatccacgaggaccagtggatcggcgagaccgtgctgcagagcaccttcagcagccagctgctgaacctgggcagctacagcagcatccagcccgaggagtacagcagcgtggtgagcgaggtggtgctgcaggacctgctggcctacgtgagcagcaagcacagctacctgagagacctgccccccagacagccccagagagtgaacagcatcgacttcgtggagctggagcacctgcagcccgacgtgctggtgcacgccgtgctgagagtggtggacttcaccatcctgaccgaggccgtgtacagctacagaggccagaagcagaagaaggtgatgctgaccgtggagcaggcccaggaccagcactacgccctggtgctgtggggccccggcgccgcctggtacccccagctgcagagaaagaagggctacatctgggagttcaagtacctgttcgtgcagtgcaactacaccctggagaacctggagctgcacaccaccccctggagcagctgcgagtgcctgttcgacgacgacatcagagccatcaccttcaaggccaagttccagaagagcgcccccagcttcgtgaagatcagcgacctggccacccacctggaggacaagtgcagcggcgtggtgctgatcaaggcccagatcagcgagctggccttccccatcaccgccagccagaagatcgccctgaacgcccacagcagcctgaagagcatcttcagcagcctgcccaacatcgtgtacaccggctgcgccaagtgcggcctggagctggagaccgacgagaacagaatctacaagcagtgcttcagctgcctgcccttcaccatgaagaagatctactacagacccgccctgatgaccgccatcgacggcagacacgacgtgtgcatcagagtggagagcaagctgatcgagaagatcctgctgaacatcagcgccgactgcctgaacagagtgatcgtgcccagcagcgagatcacctacggcatggtggtggccgacctgttccacagcctgctggccgtgagcgccgagccctgcgtgctgaagatccagagcctgttcgtgctggacgagaacagctaccccctgcagcaggacttcagcctgctggacttctaccccgacatcgtgaagcacggcgccaacgccagactgtag

SEQ ID NO: 21141 - DNA, 1680 bp, Artificial Sequence
  Description of Artificial Sequence: Synthetic coding sequence
tgagacgagctgccccccaacgagatcagaatcgagctgtgcagcagcggcatcctgtgcagccagctgaacaccttccacaagagcgccatcaagagaagctgcaccagcgaggacaaggtgggccagagcgaggccctgagcagagtgctgcaggtggccaagaagatgaagctgatcagcaacggcggcgacagcgccgtggagatggacagaagaaacgtgagcgagttcaagagcatcaagaagaccagcctgatcaagaactgcgacagcaagagccagaagtacaactgcctggtgatggtgctgagcccctgccacgtgaaggagatcaacatcaagttcggccccaacagcggcagcaaggtgcccctggccaccgtgaccgtgatcgaccagagcgagaccaagaagaaggtgttcctgtggagaaccgccgccttctgggccttcaccgtgttcctgggcgacatcatcctgctgaccgacgtggtgatccacgaggaccagtggatcggcgagaccgtgctgcagagcaccttcagcagccagctgctgaacctgggcagctacagcagcatccagcccgaggagtacagcagcgtggtgagcgaggtggtgctgcaggacctgctggcctacgtgagcagcaagcacagctacctgagagacctgccccccagacagccccagagagtgaacagcatcgacttcgtggagctggagcacctgcagcccgacgtgctggtgcacgccgtgctgagagtggtggacttcaccatcctgaccgaggccgtgtacagctacagaggccagaagcagaagaaggtgatgctgaccgtggagcaggcccaggaccagcactacgccctggtgctgtggggccccggcgccgcctggtacccccagctgcagagaaagaagggctacatctgggagttcaagtacctgttcgtgcagtgcaactacaccctggagaacctggagctgcacaccaccccctggagcagctgcgagtgcctgttcgacgacgacatcagagccatcaccttcaaggccaagttccagaagagcgcccccagcttcgtgaagatcagcgacctggccacccacctggaggacaagtgcagcggcgtggtgctgatcaaggcccagatcagcgagctggccttccccatcaccgccagccagaagatcgccctgaacgcccacagcagcctgaagagcatcttcagcagcctgcccaacatcgtgtacaccggctgcgccaagtgcggcctggagctggagaccgacgagaacagaatctacaagcagtgcttcagctgcctgcccttcaccatgaagaagatctactacagacccgccctgatgaccgccatcgacggcagacacgacgtgtgcatcagagtggagagcaagctgatcgagaagatcctgctgaacatcagcgccgactgcctgaacagagtgatcgtgcccagcagcgagatcacctacggcatggtggtggccgacctgttccacagcctgctggccgtgagcgccgagccctgcgtgctgaagatccagagcctgttcgtgctggacgagaacagctaccccctgcagcaggacttcagcctgctggacttctaccccgacatcgtgaagcacggcgccaacgccagactgtag

SEQ ID NO: 21142 - DNA, 2508 bp, Artificial Sequence; identical to SEQ ID NO: 21139
  Description of Artificial Sequence: Synthetic coding sequence

SEQ ID NO: 21143 - DNA, 732 bp, Artificial Sequence
  Description of Artificial Sequence: Synthetic coding sequence
atgctgaccgtggagcaggcccaggaccagcactacgccctggtgctgtggggccccggcgccgcctggtacccccagctgcagagaaagaagggctacatctgggagttcaagtacctgttcgtgcagagaaactacaccctggagaacctggagctgcacaccaccccctggagcagctgcgagtgcctgttcgacgacgacatcagagccatcaccttcaaggccaagttccagaagagcgcccccagcttcgtgaagatcagcgacctggccacccacctggaggacaagtgcagcggcgtggtgctgatcaaggcccagatcagcgagctggccttccccctgaccgccgcccagaagatcgccctgaacgcccacagcagcctgaagagcatcttcagcagcctgcccaacatcatctacaccggctgcgccaagtgcggcctggagctggagaccgacgagaacagaatctacaagcagtgcttcagctgcctgcccttcaccatgaagaagatctactacagacccgccctgatgaccgccgtggacggcagacacaacgtgtacatcagagtggagagcaagctgatcgagaagatcctgctgaacatcagcgcccactgcctgaacagagtgatcggcaacatcagcagaagccccatgggctggctgtggcagacctgcagcaccccctgctggcagagcgcccagaacctggtgtactag

SEQ ID NO: 21144 - DNA, 639 bp, Artificial Sequence
  Description of Artificial Sequence: Synthetic coding sequence
atgctgaccgtggagcaggcccaggaccagcactacgccctggtgctgtggggccccggcgccgcctggtacccccagctgcagagaaagaagggcgtggtgctgatcaaggcccagatcagcgagctggccttccccctgaccgccgcccagaagatcgccctgaacgcccacagcagcctgaagagcatcttcagcagcctgcccaacatcatctacaccggctgcgccaagtgcggcctggagctggagaccgacgagaacagaatctacaagcagtgcttcagctgcctgcccttcaccatgaagaagatctactacagacccgccctgatgaccgccgtggacggcagacacaacgtgtacatcagagtggagagcaagctgatcgagaagatcctgctgaacatcagcgcccactgcctgaacagagtgatcgtgcccagcagcgagatcacctacggcatggtggtggccgacctgttccacagcctgctggccgtgagcgccgagccctgcgtgctgaagatccagagcctgttcgtgctggacgagaacagctaccccctgcagcaggacttcagcctgctggacttctaccccgacatggtgaagcacggcgccaacgccagactgtag

SEQ ID NO: 21145 - DNA, 2505 bp, Artificial Sequence
  Description of Artificial Sequence: Synthetic coding sequence
atggaggaccccgccgcccccggcaccggcggcccccccgccaacggcaacggcaacggcggcggcaagggcaagcaggccgcccccaagggcagagaggccttcagaagccagagaagagagagcgagggcagcgtggactgccccaccctggagttcgagtacggcgacgccgacggccacgccgccgagctgagcgagctgtacagctacaccgagaacctggagttcaccaacaacagaagatgcttcgaggaggacttcaagacccaggtgcagggcaaggagtggctggagctggaggaggacgcccagaaggcctacatcatgggcctgctggacagactggaggtggtgagcagagagagaagactgaaggtggccagagccgtgctgtacctggcccagggcaccttcggcgagtgcgacagcgaggtggacgtgctgcactggagcagatacaactgcttcctgctgtaccagatgggcaccttcagcaccttcctggagctgctgcacatggagatcgacaacagccaggcctgcagcagcgccctgagaaagcccgccgtgagcatcgccgacagcaccgagctgagagtgctgctgagcgtgatgtacctgatggtggagaacatcagactggagagagagaccgacccctgcggctggagaaccgccagagagaccttcagaaccgagctgagcttcagcatgcacaacgaggagcccttcgccctgctgctgttcagcatggtgaccaagttctgcagcggcctggccccccacttccccatcaagaaggtgctgctgctgctgtggaaggtggtgatgttcaccctgggcggcttcgagcacctgcagaccctgaaggtgcagaagagagccgagctgggcctgccccccctggccgaggacagcatccaggtggtgaagagcatgagagccgccagcccccccagctacaccctggacctgggcgagagccagctggcccccccccccagcaagctgagaggcagaagaggcagcagaagacagctgctgaccaagcaggacagcctggacatctacaacgagagagacctgttcaagaccgaggagcccgccaccgaggaggaggaggagagcgccggcgacggcgagagaaccctggacggcgagctggacctgctggagcaggaccccctggtgccccccccccccagccaggcccccctgagcgccgagagagtggccttccccaagggcctgccctgggcccccaaggtgagacagaaggacatcgagcacttcctggagatgagcagaaacaagttcatcggcttcaccctgggccaggacaccgacaccctggtgggcctgcccagacccatccacgagagcgtgaagaccctgaagcagcacaagtacatcagcatcgccgacgtgcagatcaagaacgaggaggagctggagaagtgccccatgagcctgggcgaggaggtggtgcccgagaccccctgcgagatcctgtaccagggcatgctgtacagcctgccccagtacatgatcgccctgctgaagatcctgctggccgccgcccccaccagcaaggccaagaccgacagcatcaacatcctggccgacgtgctgcccgaggagatgcccatcaccgtgctgcagagcatgaagctgggcatcgacgtgaacagacacaaggagatcatcgtgaagagcatcagcaccctgctgctgctgctgctgaagcacttcaagctgaaccacatctaccagttcgagtacgtgagccagcacctggtgttcgccaactgcatccccctgatcctgaagttcttcaaccagaacatcctgagctacatcaccgccaagaacagcatcagcgtgctggactacccctgctgcaccatccaggacctgcccgagctgaccaccgagagcctggaggccggcgacaacagccagttctgctggagaaacctgttcagctgcatcaacctgctgagactgctgaacaagctgaccaagtggaagcacagcagaaccatgatgctggtggtgttcaagagcgcccccatcctgaagagagccctgaaggtgaagcaggccatgctgcagctgtacgtgctgaagctgctgaagctgcagaccaagtacctgggcagacagtggagaaagagcaacatgaagaccatgagcgccatctaccagaaggtgagacacagaatgaacgacgactgggcctacggcaacgacatcgacgccagaccctgggacttccaggccgaggagtgcaccctgagagccaacatcgaggccttcaacagcagaagatacgacagaccccaggacagcgagttcagccccgtggacaactgcctgcagagcgtgctgggccagagactggacctgcccgaggacttccactacagctacgagctgtggctggagagagaggtgttcagccagcccatctgctgggaggagctgctgcagaaccactag

SEQ ID NO: 21146 - DNA, 2277 bp, Artificial Sequence
  Description of Artificial Sequence: Synthetic coding sequence
atggaggaccccgccgcccccggcaccggcggcccccccgccaacggcaacggcaacggcggcggcaagggcaagcaggccgcccccaagggcagagaggccttcagaagccagagaagagagagcgagggcagcgtggactgccccaccctggagttcgagtacggcgacgccgacggccacgccgccgagctgagcgagctgtacagctacaccgagaacctggagttcaccaacaacagaagatgcttcgaggaggacttcaagacccaggtgcagggcaaggagtggctggagctggaggaggacgcccagaaggcctacatcatgggcctgctggacagactggaggtggtgagcagagagagaagactgaaggtggccagagccgtgctgtacctggcccagggcaccttcggcgagtgcgacagcgaggtggacgtgctgcactggagcagatacaactgcttcctgctgtaccagatgggcaccttcagcaccttcctggagctgctgcacatggagatcgacaacagccaggcctgcagcagcgccctgagaaagcccgccgtgagcatcgccgacagcaccgagctgagagtgctgctgagcgtgatgtacctgatggtggagaacatcagactggagagagagaccgacccctgcggctggagaaccgccagagagaccttcagaaccgagctgagcttcagcatgcacaacgaggagcccttcgccctgctgctgttcagcatggtgaccaagttctgcagcggcctggccccccacttccccatcaagaaggtgctgctgctgctgtggaaggtggtgatgttcaccctgggcggcttcgagcacctgcagaccctgaaggtgcagaagagagccgagctgggcctgccccccctggccgaggacagcatccaggtggtgaagagcatgagagccgccagcccccccagctacaccctggacctgggcgagagccagctggcccccccccccagcaagctgagaggcagaagaggcagcagaagacagctgctgaccaagcaggacagcctggacatctacaacgagagagacctgttcaagaccgaggagcccgccaccgaggaggaggaggagagcgccggcgacggcgagagaaccctggacggcgagctggacctgctggagcaggaccccctggtgccccccccccccagccaggcccccctgagcgccgagagagtggccttccccaagggcctgccctgggcccccaaggtgagacagaaggacatcgagcacttcctggagatgagcagaaacaagttcatcggcttcaccctgggccaggacaccgacaccctggtgggcctgcccagacccatccacgagagcgtgaagaccctgaagcagcacaagtacatcagcatcgccgacgtgcagatcaagaacgaggaggagctggagaagtgccccatgagcctgggcgaggaggtggtgcccgagaccccctgcgagatcctgtaccagggcatgctgtacagcctgccccagtacatgatcgccctgctgaagatcctgctggccgccgcccccaccagcaaggccaagaccgacagcatcaacatcctggccgacgtgctgcccgaggagatgcccatcaccgtgctgcagagcatgaagctgggcatcgacgtgaacagacacaaggagatcatcgtgaagagcatcagcaccctgctgctgctgctgctgaagcacttcaagctgaaccacatctaccagttcgagtacgtgagccagcacctggtgttcgccaactgcatccccctgatcctgaagttcttcaaccagaacatcctgagctacatcaccgccaagaacagcatcagcgtgctggactacccctgctgcaccatccaggacctgcccgagctgaccaccgagagcctggaggccggcgacaacagccagttctgctggagaaacctgttcagctgcatcaacctgctgagactgctgaacaagctgaccaagtggaagcacagcagaaccatgatgctggtggtgttcaagagcgcccccatcctgaagagagccctgaaggtgaagcaggccatgctgcagctgtacgtgctgaagctgctgaagctgcagaccaagtacctgggcagacagtggagaaagagcaacatgaagaccatgagcgccatctaccagaaggtgagacacagaatgaacgacgactgggcctacggcaacggcgagagcagccagagcagctag

SEQ ID NO: 21147 - DNA, 636 bp, Artificial Sequence
  Description of Artificial Sequence: Synthetic coding sequence
atgttcagccagggcctgtgcagcgacagcatgttccccgagatgtggagacccgtggacatgggctggccccagaccagaatgcccagagtgagaagcctgcacgcctacccccccttcttccccctgcagcagctgctgaccaagcaggacagcctggacatctacaacgagagagacctgttcaagaccgaggagcccgccaccgaggaggaggaggagagcgccggcgacggcgagagaaccctggacggcgagctggacctgccctgggcccccaaggtgagacagaaggacatcgagcacttcctggagatgagcagaaacaagttcatcggcttcaccctgggccaggacaccgacaccctggtgggcctgcccagacccatccacgagagcgtgaagaccctgaagcagcacaagtacatcagcatcgccgacgtgcagatcaagaacgaggaggagctggagaagtgccccatgagcctggtgagccagggcagccccacccaggaggagagcagaagaaagcccgtgttcagcgtggtgaccgagcacgtgtgcatgcacagcttcagcatcctgggctgcaactgcgtgcccggcggcagaggcggcaccagagacgccatgtag

SEQ ID NO: 21148 - DNA, 1272 bp, Artificial Sequence
  Description of Artificial Sequence: Synthetic coding sequence
atgctgccctggaagaagcacaagttcgagctgctggccgaggccccccccagacaggccagcaagcccaagggctacgccgtgagcctgcactacagcgccctgagcagcctggccagagcctgccccgagggcgccctgagcagagtgggcagcatgttcagaagcaagagaaagaagctgcacatcaccagcgaggaccccacctacaccgtgctgtacctgggcaacgccaccaccatccaggccagaggcgacggctgcaccgacctggccgtgggcaagatctggagcaagagcgaggccggcagacagggcaccaagatgaagctgaccgtgagcgcccagggcatcagaatggtgcacgccgaggagagagccctgagaagacccggccacctgtacctgctgcacagagtgacctactgcgtggccgacgccagactgcccaaggtgttcgcctgggtgtacagacacgagctgaagcacaaggccgtgatgctgagatgccacgccgtgctggtgagcaagcccgagaaggcccaggccatggccctgctgctgtaccagaccagcgccaacgccctggccgagttcaagagactgaagagaagagacgacgccagacaccagcagcaggagctggtgggcgcccacaccatccccctggtgcccctgagaaagctgctgctgcacggcccctgctgctacaagccccccgtggagagaagcagaagcgcccccaagctgggcagcatcaccgaggacctgctgggcgagcagctggagcaggagctgcaggaggaggaggaggaggagcagcccgagggctgccccgaggaggaggagaacagagccgccgagggcgaccccgccgaggaggaggccgaggcccagagagccctggtggtggccatgcacttcgagtgcggcgacctgctggacaccctggagaacggcagaggcgaggccctgggcggcggcggcggcagcctgggccccggcgccggccccccccccctgctgctgggcagcgccagcgacatgaaggccgagctgagccagctgatcagcgacctgggcgagctgagcttcggcaacgacgtgagaaccctgcaggccgacctgagagtgaccagactgctgagcggcgacagcaccggcagcgagagcagcatcgagggcggcggccccgacgccaccagcgccaccgccggcgacagcagcagacaggccgacggcgccagcgccgacgagccccacagcggctag

SEQ ID NO: 21149 - DNA, 990 bp, Artificial Sequence
  Description of Artificial Sequence: Synthetic coding sequence
atgctgccctggagaagaaacaagttcgtgctggtggaggacgaggccaagtgcaaggccaagagcctgagccccggcctggcctacaccagcctgctgagcagcttcctgagaagctgccccgacctgctgcccgactggcccctggagagactgggcagagtgttcagaagcagaagacagaaggtggagctgaacaaggaggaccccacctacaccgtgtggtacctgggcaacgccgtgaccctgcacgccaagggcgacggctgcaccgacgacgccgtgggcaagatctgggccagatgcggccccggcggcggcaccaagatgaagctgaccctgggcccccacggcatcagaatgcagccctgcgagagaagcgccgccggcggcagcggcggcagaagacccgcccacgcctacctgctgcccagaatcacctactgcaccgccgacggcagacaccccagagtgttcgcctgggtgtacagacaccaggccagacacaaggccgtggtgctgagatgccacgccgtgctgctggccagagcccacaaggccagagccctggccagactgctgagacagaccgccctggccgccttcagcgacttcaagagactgcagagacagagcgacgccagacacgtgagacagcagcacctgagagccggcggcgccgccgccagcgtgcccagagcccccctgagaagactgctgaacgccaagtgcgcctacagacccccccccagcgagagaagcagaggcgcccccagactgagcagcatccaggaggaggacgaggaggaggaggaggacgacgccgaggagcaggagggcggcgtgccccagagagagagacccgaggtgctgagcctggccagagagctgagaacctgcagcctgagaggcgcccccgccccccccccccccgcccagcccagaagatggaaggccggccccagagagagagccggccaggccagatag

SEQ ID NO: 21150 - DNA, 1074 bp, Artificial Sequence
  Description of Artificial Sequence: Synthetic coding sequence
atggccgccgccgaggtggccgacacccagctgatgctgggcgtgggcctgatcgagaaggacaccaacggcgaggtgctgtgggtgtggtgctaccccagcaccaccgccaccctgagaaacctgctgctgagaaagtgctgcctgaccgacgagaacaagctgctgcaccccttcgtgttcggccagtacagaagaacctggttctacatcaccaccatcgaggtgcccgacagcagcatcctgaagaaggtgacccacttcagcatcgtgctgaccgccaaggacttcaaccccgagaagtacgccgccttcaccagaatcctgtgcagaatgtacctgaagcacggcagccccgtgaagatgatggagagctacatcgccgtgctgaccaagggcatctgccagagcgaggagaacggcagcttcctgagcaaggacttcgacgccagaaaggcctacctggccggcagcatcaaggacatcgtgagccagttcggcatggagaccgtgatcctgcacaccgccctgatgctgaagaagagaatcgtggtgtaccaccccaagatcgaggccgtgcaggagttcaccagaaccctgcccgccctggtgtggcacagacaggactggaccatcctgcacagctacgtgcacctgaacgccgacgagctggaggccctgcagatgtgcaccggctacgtggccggcttcgtggacctggaggtgagcaacagacccgacctgtacgacgtgttcgtgaacctggccgagagcgagatcaccatcgcccccctggccaaggaggccatggccatgggcaagctgcacaaggagatgggccagctgatcgtgcagagcgccgaggaccccgagaagagcgagagccacgtgatccaggacatcgccctgaagaccagagagatcttcaccaacctggcccccttcagcgaggtgagcgccgacggcgagaagagagtgctgaacctggaggccctgaagcagaagagattcccccccgccaccgagaacttcctgtaccacctggccgccgccgagcagatgctgaagatctag

SEQ ID NO: 21151 - DNA, 603 bp, Artificial Sequence
  Description of Artificial Sequence: Synthetic coding sequence
atggccgccgccgaggtggccgacacccagctgatgctgggcgtgggcctgatcgagaaggacaccaacggcgaggtgctgtgggtgtggtgctaccccagcaccaccgccaccctgagaaacctgctgctgagaaagtgctgcctgaccgacgagaacaagctgctgcaccccttcgtgttcggccagtacagaagaacctggttctacatcaccaccatcgaggtgcccgacagcagcatcctgaagaaggtgacccacttcagcatcgtgctgaccgccaaggacttcaaccccgagaagtacgccgccttcaccagaatcctgtgcagaatgtacctgaagcacggcagccccgtgaagatgatggagagctacatcgccgtgctgaccaagggcatctgccagagcgaggagaacggcagcttcctgagcaaggacttcgacgccagaaaggcctacctggccggcagcatcaagggcctgtgcctgccctggtgcggcaccgacagaaccggccccagcttcaccctgacctgcaccagcacccccatgagctggaagccctgcagatgcgcccaggtgaccagcctggacctgtag

SEQ ID NO: 21152 - DNA, 621 bp, Artificial Sequence
  Description of Artificial Sequence: Synthetic coding sequence
atgctgcccagcctgggctactgcgtggacatcgtgagccagttcggcatggagaccgtgatcctgcacaccgccctgatgctgaagaagagaatcgtggtgtaccaccccaagatcgaggccgtgcaggagttcaccagaaccctgcccgccctggtgtggcacagacaggactggaccatcctgcacagctacgtgcacctgaacgccgacgagctggaggccctgcagatgtgcaccggctacgtggccggcttcgtggacctggaggtgagcaacagacccgacctgtacgacgtgttcgtgaacctggccgagagcgagatcaccatcgcccccctggccaaggaggccatggccatgggcaagctgcacaaggagatgggccagctgatcgtgcagagcgccgaggaccccgagaagagcgagagccacgtgatccaggacatcgccctgaagaccagagagatcttcaccaacctggcccccttcagcgaggtgagcgccgacggcgagaagagagtgctgaacctggaggccctgaagcagaagagattcccccccgccaccgagaacttcctgtaccacctggccgccgccgagcagatgctgaagatctag

SEQ ID NO: 21153 - DNA, 666 bp, Artificial Sequence
  Description of Artificial Sequence: Synthetic coding sequence
atggccgccgccgaggtggccgacacccagctgatgctgggcgtgggcctgatcgagaaggacaccaacggcgaggtgctgtgggtgtggtgctaccccagcaccaccgccaccctgagaaacctgctgctgagaaagtgctgcctgaccgacgagaacaagctgctgcaccccttcgtgttcggccagtacagaagaacctggttctacatcaccaccatcgaggtgcccgacagcagcatcctgaagaaggtgacccacttcagcatcgtgctgaccgccaaggacttcaaccccgagaagtacgccgccttcaccagaatcctgtgcagaatgtacctgaagcacggcagccccgtgaagatgatggagagctacatcgccgtgctgaccaagggcatctgccagagcgaggagaacggcagcttcctgagcaaggacttcgacgccagaaaggcctacctggccggcagcatcaaggacatcgtgagccagttcggcatgaactgctacctgacccacagcaccgacgccaaggagaagaactgcggcgtgagcccccaggacagaagcggccccggcgtgcaccaggacagcgcctgccccggcgtggcccccaccggcctggaccaccccagcctgctgagagccccccagagaagatag

SEQ ID NO: 21154 - DNA, 1386 bp, Artificial Sequence
  Description of Artificial Sequence: Synthetic coding sequence
atgcaccagagatacttctggaccgaccagggccaggtggccctgggcggccactacatggccgagggcgagggctacttcgccatgagcgaggacgagctggcctgcagcccctacatccccctgggcggcgacttcggcggcggcgacttcggcggcggcgacttcggcggcggcgacttcggcggcggcggcagcttcggcggccactgcctggactactgcgagagccccaccgcccactgcaacgtgctgaactgggagcaggtgcagagactggacggcatcctgagcgagaccatccccatccacggcagaggcaacttccccaccctggagctgcagcccagcctgatcgtgaaggtggtgagaagaagactggccgagaagagaatcggcgtgagagacgtgagactgaacggcagcgccgccagccacgtgctgcaccaggacagcggcctgggctacaaggacctggacctgatcttctgcgccgacctgagaggcgagggcgagttccagaccgtgaaggacgtggtgctggactgcctgctggacttcctgcccgagggcgtgaacaaggagaagatcacccccctgaccctgaaggaggcctacgtgcagaagatggtgaaggtgtgcaacgacagcgacagatggagcctgatcagcctgagcaacaacagcggcaagaacgtggagctgaagttcgtggacagcctgagaagacagttcgagttcagcgtggacagcttccagatcaagctggacagcctgctgctgttctacgagtgcagcgagaaccccatgaccgagaccttccaccccaccatcatcggcgagagcgtgtacggcgacttccaggaggccttcgaccacctgtgcaacaagatcatcgccaccagaaaccccgaggagatcagaggcggcggcctgctgaagtactgcaacctgctggtgagaggcttcagacccgccagcgacgagatcaagaccctgcagagatacatgtgcagcagattcttcatcgacttcagcgacatcggcgagcagcagagaaagctggagagctacctgcagaaccacttcgtgggcctggaggacagaaagtacgagtacctgatgaccctgcacggcgtggtgaacgagagcaccgtgtgcctgatgggccacgagagaagacagaccctgaacctgatcaccatgctggccatcagagtgctggccgaccagaacgtgatccccaacgtggccaacgtgacctgctactaccagcccgccccctacgtggccgacgccaacttcagcaactactacatcgcccaggtgcagcccgtgttcacctgccagcagcagacctacagcacctggctgccctgcaactag

SEQ ID NO: 21155 - DNA, 1572 bp, Artificial Sequence
  Description of Artificial Sequence: Synthetic coding sequence
atgcagatgagaagagtgtggagaacctgcagaagcggccccagaaagagaagagaggccagatacaagaagagcaccgaggacatcttccccgcccagctgctgaagctgcagagacacgagagagtgtggcagcaggagccccccgtgagagaccacagaagctggggcggcagcggcgccggcggcgtggccggcagagagtggaccgaccagggccaggtggccctgggcggccactacatggccgagggcgagggctacttcgccatgagcgaggacgagctggcctgcagcccctacatccccctgggcggcgacttcggcggcggcgacttcggcggcggcgacttcggcggcggcgacttcggcggcggcggcagcttcggcggccactgcctggactactgcgagagccccaccgcccactgcaacgtgctgaactgggagcaggtgcagagactggacggcatcctgagcgagaccatccccatccacggcagaggcaacttccccaccctggagctgcagcccagcctgatcgtgaaggtggtgagaagaagactggccgagaagagaatcggcgtgagagacgtgagactgaacggcagcgccgccagccacgtgctgcaccaggacagcggcctgggctacaaggacctggacctgatcttctgcgccgacctgagaggcgagggcgagttccagaccgtgaaggacgtggtgctggactgcctgctggacttcctgcccgagggcgtgaacaaggagaagatcacccccctgaccctgaaggaggcctacgtgcagaagatggtgaaggtgtgcaacgacagcgacagatggagcctgatcagcctgagcaacaacagcggcaagaacgtggagctgaagttcgtggacagcctgagaagacagttcgagttcagcgtggacagcttccagatcaagctggacagcctgctgctgttctacgagtgcagcgagaaccccatgaccgagaccttccaccccaccatcatcggcgagagcgtgtacggcgacttccaggaggccttcgaccacctgtgcaacaagatcatcgccaccagaaaccccgaggagatcagaggcggcggcctgctgaagtactgcaacctgctggtgagaggcttcagacccgccagcgacgagatcaagaccctgcagagatacatgtgcagcagattcttcatcgacttcagcgacatcggcgagcagcagagaaagctggagagctacctgcagaaccacttcgtgggcctggaggacagaaagtacgagtacctgatgaccctgcacggcgtggtgaacgagagcaccgtgtgcctgatgggccacgagagaagacagaccctgaacctgatcaccatgctggccatcagagtgctggccgaccagaacgtgatccccaacgtggccaacgtgacctgctactaccagcccgccccctacgtggccgacgccaacttcagcaactactacatcgcccaggtgcagcccgtgttcacctgccagcagcagacctacagcacctggctgccctgcaactag

SEQ ID NO: 21156 - DNA, 267 bp, Artificial Sequence
  Description of Artificial Sequence: Synthetic coding sequence
tgaaagagaatcggcgtgagagacgtgagactgaacggcagcgccgccagccacgtgctgcaccaggacagcggcctgggctacaaggacctggacctgatcttctgcgccgacctgagaggcgagggcgagttccagaccgtgaaggacgtggtgctggactgcctgctggacttcctgcccgagggcgtgaacaaggagaagatcacccccctgaccctgaaggaggagagccacaccaccacctacttcctgaacatcagctag

SEQ ID NO: 21157 - DNA, 261 bp, Artificial Sequence
  Description of Artificial Sequence: Synthetic coding sequence
tgacaggacagcggcctgggctacaaggacctggacctgatcttctgcgccgacctgagaggcgagggcgagttccagaccgtgaaggacgtggtgctggactgcctgctggacttcctgcccgagggcgtgaacaaggagaagatcacccccctgaccctgaaggtgttccacagactgctgagacactggagagccgccgagaagaccggcgtgctgttcgccgagcccctgtgcggcatcggcagaccccaggtgtag

SEQ ID NO: 21158 - DNA, 1278 bp, Artificial Sequence
  Description of Artificial Sequence: Synthetic coding sequence
atgatgcccagcgagagcggcgccgagagaagagacagagccgccgcccaggtgggcaccgccgccgccaccgccgtggccaccgccgcccccgccggcggcggccccgaccccgaggccctgagcgccttccccggcagacacctgagcggcctgagctggccccaggtgaagagactggacgccctgctgagcgagcccatccccatccacggcagaggcaacttccccaccctgagcgtgcagcccagacagatcgtgcaggtggtgagaagcaccctggaggagcagggcctgcacgtgcacagcgtgagactgcacggcagcgccgccagccacgtgctgcaccccgagagcggcctgggctacaaggacctggacctggtgttcagagtggacctgagaagcgaggccagcttccagctgaccaaggccgtggtgctggcctgcctgctggacttcctgcccgccggcgtgagcagagccaagatcacccccctgaccctgaaggaggcctacgtgcagaagctggtgaaggtgtgcaccgacagcgacagatggagcctgatcagcctgagcaacaagagcggcaagaacgtggagctgaagttcgtggacagcgtgagaagacagttcgagttcagcatcgacagcttccagatcatcctggacagcctgctgctgttcggccagtgcagcagcacccccatgagcgaggccttccaccccaccgtgaccggcgagagcctgtacggcgacttcaccgaggccctggagcacctgagacacagagtgatcgccaccagaagccccgaggagatcagaggcggcggcctgctgaagtactgccacctgctggtgagaggcttcagacccagacccagcaccgacgtgagagccctgcagagatacatgtgcagcagattcttcatcgacttccccgacctggtggagcagagaagaaccctggagagatacctggaggcccacttcggcggcgccgacgccgccagaagatacgcctgcctggtgaccctgcacagagtggtgaacgagagcaccgtgtgcctgatgaaccacgagagaagacagaccctggacctgatcgccgccctggccctgcaggccctggccgagcagggccccgccgccaccgccgccctggcctggagaccccccggcaccgacggcgtggtgcccgccaccgtgaactactacgtgacccccgtgcagcccctgctggcccacgcctaccccacctggctgccctgcaactag

SEQ ID NO: 21159 - DNA, 1170 bp, Artificial Sequence
  Description of Artificial Sequence: Synthetic coding sequence
atgagcgagatcagattcaccaacctgacctgggaccaggtgatcaccctggaccaggtgctggacgaggtgatccccatccacggcaagggcaacttccccaccatggaggtgaagcccaaggacatcatccacgtggtgaaggaccagctgatcggccagggcatcatcgtgaaggacgccagactgaacggcagcgtggccagctacatcctggccagccacaacggcatcagctacaaggacctggacgtgatcttcggcgtggagctgcccggcaacgaggagttccaggtggtgaaggacgccgtgctggactgcctgctggacttcctgcccaaggacgtgaagaaggagaagctgagccccgacatcatgaaggacgcctacgtgcagaagctggtgaaggtgtgcaacggccacgactgctggagcctgatcagcctgagcaacaacaccggcaagaacctggagctgaagttcgtgagcagcctgagaagacagttcgagttcagcgtggacagcttccagatcgtgctggaccccatgctggacttctacagcgacaagaacgccaagctgaccaaggagagctaccccgtggtggtggccgagagcatgtacggcgacttccaggaggccatgacccacctgcagcacaagctgatctgcaccagaaagcccgaggagatcagaggcggcggcctgctgaagtactgcagcctgctggtgcacggcttcaagcccgcctgcatgagcgagatcaagaacctggagagatacatgtgcagcagattcttcatcgacttcccccacatcgaggagcagcagaagaagatcgagagctacctgcacaaccacttcatcggcgagggcatgaccaagtacgactacctgatgaccctgcacggcgtggtgaacgagagcaccgtgtgcctgatgagctacgagagaagacagatcctgcacctgatcaccatgatggccctgaaggtgctgggcgagctgaacatcctgcccaacacccagaaggtgacctgcttctaccagcccgccccctacttcgccgccgaggccagataccccatctacgtgatccccgagcccccccccgtgagcttccagccctaccaccccctgcacttcagaggcagcaacggcatgagctag

SEQ ID NO: 21160 - DNA, 1170 bp, Artificial Sequence; identical to SEQ ID NO: 21159
  Description of Artificial Sequence: Synthetic coding sequence

SEQ ID NO: 21161 - DNA, 888 bp, Artificial Sequence
  Description of Artificial Sequence: Synthetic coding sequence
atgcagatgagcgtgccctgcgtgctgagcagcctgcagaaccacgagcccaacaagcccctgttcaccacccagagccagctgctgagcaaggtgctggaggtgctggaccccgacagaaagctggaggacacctgggcctactgccaggacaccagaaagggcatgaaggagcccaccaagctgctgaagaagcacagcacccaggtgtacctgggccccagcaagaagaccagcgtgagcaacgccggccagtggctgtacgaggagaagccccacaagatggacctgctgcacgagaacggccccagacccggcctgcacgagaacgtgtgcaaggccgtgagcgacttctgcaagtgggtgaccaccttcggcatcagcgacatcgacgaggagttcatcctgaagcagttcgacatcgactacgagaccaagcccagccacgacgccctgcacaccatgaagctgaaccaggtgcccctggagctgaagagaagcgtgggcctgagcaagctgcaggagaccgagttcttccagaagctgggctacgagagaaagctgcagaagccccagaacccctacaagcccaagtgggtgaagatgagatacggcgcctggtacctgaaccccaagctgtggaagaagcagagagtggacgagcccctggtggaccccgaggtgagccacaaggcccaggaggagaacttcaagaaggagctgcaggagcaggaggagctgctggccgacctgcacggcaccgtggccttcaaggacttcatcctgagcagaggctacagaacccccagattcctggagaacatgtacatcggcaaggagtgcaagagagcctgcaacaagacccccatcaagagaacccaggcctag

SEQ ID NO: 21162 - DNA, 1056 bp, Artificial Sequence
  Description of Artificial Sequence: Synthetic coding sequence
atggccgacagaagaagaagactgagacccggcaccctggcccccgtgagagagggcgtgaactgcagaagcagatgcttcaccaagcacaagaacggcctgaagttccccaccagcctgcacagcagacagctggtgttccccagaaagggcctggacgacttcagaaagggctgccccccctgcaccggcctggtgacccaggtgcccgtggagggcttcctgccccagatctaccacagagccccccagctggcccccaagaagagacagatcaagctgctgaaggaggccgacgtgctgagcaagctgagccccgcccagcaggccagaaaggccttcctggaggacgtggaggcccacctgaccccccaccccctggccctgtacctgaacctggaggaggccatgcccatcgagctgctgagcaaggtgctggaggtgctggaccccgacagaaagctggaggacacctgggcctactgccaggacaccagaaagggcatgaaggagcccaccaagctgctgaagaagcacagcacccaggtgtacctgggccccagcaagaagaccagcgtgagcaacgccggccagtggctgtacgaggagaagccccacaagatggacctgctgcacgagaacggccccagacccggcctgcacgagaacggcatcagcgacatcgacgaggagttcatcctgaagcagttcgacatcgactacgagaccaagcccagccacgacgccctgcacaccatgaagctgaaccaggtgcccctggagctgaagagaagcgtgggcctgagcaagctgcaggagaccgagttcttccagaagctgggctacgagagaaagctgcagaagccccagaacccctacaagcccaagtgggtgaagatgagatacggcgcctggtacctgaaccccaagctgtggaagaagcagagagtggacgagcccctggtggaccccgaggtgagccacaaggcccaggaggagaacttcaagaaggagctgcaggagcagagcatcttcaagaaggccatggacatctag

SEQ ID NO: 21163 - DNA, 2376 bp, Artificial Sequence
  Description of Artificial Sequence: Synthetic coding sequence
atgggcgaccagagactgcaggactggctgagaagccccggcatggacagcaagccctggtactgcaacaagagacccagcaagtgcttcgccaagtgcaagcacagaagactgagattcccccccatggacacccagaactgggtgttcgtgaaggagggcatggacgacttcagatacggctgccccagccccgaggacaccctggtgtgcagaagagacgagttcctgctgcccaagatcagcctgagaggcccccaggccgaccccaagagcggccagaagaagctgctgaagaaggccgccctgttcagcaagctgagccccgcccagctggccagaaaggccttcgtggagcaggtggaggcccagctgatggccaagcaccccctggccatgtaccccaacctgggcgaggacatgccccccgacctgctgctgcaggtgctgaagcacctggaccccgagagagagctggaggacgcctgggcctgctgcgagacccaggagaagaccaccgaggtgcccaccgagcccggcaagcacccctgcggcgagttctgcctgaagccccccgagacccccgtgagccacctgctgcccgagccccccgagaccggcgtgagccacctgagccccgagccccccaagacccccgtgagcagcctgagacccgagccccccgagaccggcgtgagccacctgagacccgagccccccgagaccggcgtgagccacatcagacccggcccccccatcaccagaagaagaagcagcctgctgagacagctgctgaagctggacagcgagagaaagctggaggacgccagagccccctgcgagggcagagagaagaccaccgacgagcccaccgagcccggcaagtacccctgcggcaagttctgccccagacccttcgagacccccctgagccacctgagacaggagccccccaagacccccgtgagcagcctgagacccgagccccccgagaccggcgagagccacctgagactggagcacagcaagaccagaagaggcagcagcctgagaagcgagcccagcgagaccggcgtgagcagactgagactggccccccccaagaccagaagaggcagcagcctgcacgccgagcccagcaagaccggcgtgagccacctgagccccgagccccccaagaccgaggtgagccacctgcaccccgtgccccccaagaccggcgtgtgccacctgagactggagccccccgacaccagccaggtgagcaacctgctgctgtacatcctgaaggtgctggacagcggcagaaccctgaaggacgtgtgggacagatgcgaggccagagtgaagaagaccaaggagcccaccgagccccacaagagcccctgcggcgagccctgcctgcagccccccgagacccaggtgagccacccccaccccgagcaccccaagaccagaagaagaagcagcctgcacagccagccccccaagaccagaagaaccagcagcctgagaagcgagccccccaagaccagaagaaccagcagcctgagaagcgagccccccaagaccagaagaaccagcagcctgggccccgagccccccaagaccagaagagtgagcagcctgagacccgagctgcccaagagcagaagagtgagcagcctgcaccccgagccccccaaggcccccgagagccaccagttcagcgagccccccaagatcagagccagctacatcaaggagctgctgcaggaggacacccccagcaccaaggagtgcgtgagcgacagcctgcagtacagatacaccagcgagaagctgagagagttcttcaagtgggccggcgacctgggcgccgacgaggagagcatcagaaacctgttcgacttcacccccaagtacagagccacccacgaggaccagaagttcaagaaggtgaaggagtgcagcagcgagctgaagtacagcatggagctggacgagaaggacgaggacaagttcttcagccaggagaagtactggggcagaaagttccacacccccagcaacagctacaccgcccagagagtgaagatgaagtacggcgcctggtacctgaagcccaagctgtggaagaagctgagaagcgacgagcccctgatcgaccccaagctgctgctgaagaagcccgacgagcccgacgtgctggacgacctgtacggccccatcgccttcaaggacttcatcctgagcaagggctacgagatgcccggcatcatccagagactgttcgccagaagaggctggacctacgacagcgtgaagacccccatccagagagccatgatcttctacaagtacaaggagatcgtggaggccagcgaggaggactag

SEQ ID NO: 21164 - DNA, 1938 bp, Artificial Sequence
  Description of Artificial Sequence: Synthetic coding sequence
atgggcgacagaagaccccaggacagacccagaagccagggcatggacagcaagccctggtactgcgacaagccccccagcaagtacttcgccaagagaaagcacagaagactgagattcccccccgtggacacccagaactgggtgttcgtgaccgagggcatggacgacttcagatacgcctgccagagccccgaggacaccctggtgtgcagaagagacgagttcctgctgcccaagatcagcctgagaggcccccaggccgacagaaagagcagaaagaagaagctgctgaagaaggccgccctgttcagcgagctgagccccgtgcagcccgccagaaaggccttcgtggaggaggtggaggcccagctgatgaccaagcaccccctggccatgtaccccaacctgggcaaggacatgccccccgacctgctgctgcaggtgctgaagcagctggaccccgagagaaagctggaggacgcctgggccagatgcgaggccagagagaagaccaccgaggtgcccaccgagagcggcaagtacccctgcggcgagagctgccccagaccccccgagacccccgtgagcagactgagaccccagctgcccaagacccccgtgagcagcagaagacccgagccccccaagaccagagtgagcagcctgagacccgagccccccaagaccagagtgagcagcctgcaccccgagccccccgagaccagagccagccacctgagagtggacccccccgagaccggcgtgagccacctgtgccccgagccccccaagaccctggtgagcagcgtgcaccccgagccccccgacaccggcgccagccacctgtgccccgagccccccgagaccagagtgagccacctgcaccccgagccccccgagaccggcgtgagccacctgagacccgagcccagcaagacccaggtgagcagcctgtgccccgagccccccgaggccggcgtgagccacctgtgcctggagccccccaacacccacagagtgagcagcttcctgctgcaggtgctgaagctggacagcgagaagaagctggaggacgccagagccagatgcgagggccaggagatgaccaccgaggagctgaccaagcccggcaagtaccacttctgggagagctgccccagacccttcgagagcagaatgccccacctgagactggtgctgcccatcaccagaagaatggccagcctgtgcctgaagccccccaagaccagaagagtgagcagcctgtgccccgagcccaccaagaccggcgccagccacctgaaggagctgttccaggaggacacccccagcaccatggagtgcgtgagcgacagcctgcagagaagacacaccagcagaaagctgagagacttcaagtgggccggcgacctgggcgtgaacgaggagagcatcagcagcctgttcgacttcacccccgagtgcagaaccaccgaccaggaccagaagatcaagaaggccaacgagtgcgccagcagactgatgtacggcatggagctggacgacatggacgaggtggagttcctgagaatcaagtactgggacagaagaagaagagccgccccccacagctacagcgcccagagaggcagaatcagatacggcccctggtacttcgagcccaagctgggcaagaagctgagaagcgacgagcccctgatcgaccccaagcccgtgctggagaagcccgacgagcccgacatcctggacggcctgtacggccccatcgccttcaaggacttcatcctgagcaagggctacagaatgcccggcgtgatcgagaagctgttcgccaagaagggctggacctacgacagcgtgaagacccccatccagagagccgtgcaggtgtacaagtacaaggaggacgtgaccgacgccagcaaggaggactag

SEQ ID NO: 21165 - DNA, 3108 bp, Artificial Sequence
  Description of Artificial Sequence: Synthetic coding sequence
atgggcgaccagagaccccaggacagacccagcagccccggcatggacagcaccccctggtactgcgacaagccccccagcaagtacttcgccaagagaaagcacagaagactgagattcccccccgtggacacccagaactgggtgttcgtgaccgagggcatggacgacttcagatacggctgccagagccccgaggacaccctggtgtgcagaagagacgagttcctgctgcccaagatcagcctgagaggcccccaggccgaccccaagagcagaaagaagaagctgctgaagaaggccgccctgttcagcaagctgagccccgcccagcccgccagaaaggccttcgtggaggaggtggaggcccagctgatgaccaagcaccccctggccatgtaccccaacctgggcgaggacatgccccccgacctgctgctgcaggtgctgaagcccctggaccccgagagaaagctggaggacgccggcagctgcgagggccaggagaagaccaccgacgagcccaccgagcccggcaagtacccctgcggcgagttcagccccagaccccccgagaccagagtgagctgcctgccccccgagccccccaagacccccgtgagcagcctgagacccgagccccccgagaccggcgtgagccacctgagaccccagccccccaagacccaggtgagcagcctgcacctggagccccccgagaccggcgtgagccacctgagacccgagccccccaagacccaggtgagcagcctgcacctggagccccccgagaccggcgtgagccacctgtacctggagccccccggcaccggcgtgagccacctgtgccccgagccccccaagaccagagtgagccacctgcacagagagccccccgagaccggcgtgcccgacctgtgcctggagccccccaagagcagagtgagccacctgagacccgagcccagcgagaccggcgtgagccacctgcaccccgagccccccaagaccctggtgagcagcctgcaccccgagccccccgagaccggcgtgagccacctgtgccccgagccccccgagaccagagtgagccccctgagacagctgccccccgaggccggcgtgagccacctgtgccccgagccccccaagaccagagtgccccccctgagacccgagacccccaagaacggcgtgagccccctgttccccgagccccccaagaccagaatcagcaacctgagaagcgagccccccaagatcggcgtgagccacctgtgcctggagccccccaagaccagaggcagccacctgagacccgagccccccgagaccggcgtgagccacctgagacccgagccccccaagaccagagtgagcagcctgcacctggagccccccgagaccggcgtgagccacctgtgccccgagccccccgagaaggacgtgagccacctgagacccgagccccccgacaccggcgtgagccacctgtgccccgagccccccaagaccagagtgagccacctgagacccgagcccagcgagaccggcgtgagccacctgagacccgagccccccaagatcctggtgagcagcctgcaccaggccccccccgagagcagcgtgagccacctgagacccgagccccccgagaccggcgtgagccacctgagacccgagccccccaagaccagaatgtacagcctgagacccgagccccccgacaccggcgtgagccacctgtgccccgagccccccaagaccagagtgagcagcctgccccccgagccccccgagaccggcgtgagccacctgtgccccgagccccccgagaccagagtgagccacctgagacccgagccccccgagaccggcgtgagccacctgagacccgagccccccaagaccagaatgtacagcctgagacccgagccccccaacaccggcgtgagccacctgtgccccgagccccccaagaccagagtgagcagcctgccccccgagccccccgagaccggcgtgagccacctgtgccccgagccccccgagaccagagtgagccacctgagacccgagccccccgagaccggcgtgagcagactgcaccccgagccccccaagaccagagtgagcagcctgcacgccgagccccccgagagcagagtgagccacctgtgccccgagccccccgagaccggcgtgagccacctgagacccgagccccccaagcccagagtgagcagcctgagacccgagcccctggagaccagagtgagccacctgagacccgagccccccgagaccggcgtgagccacctgcaccccgagctgcccaagcccagagtgagcagcctgcacctggagccccccaagaccagaagagtgagcagcctgagactggagccccccaagaccggcagagtgagcagcctgtgccccgagcccaccaagaccggcgccagccacctgaaggagctgttccaggagggcaccagcagcaccatggagtgcgtgagcgacagcctgcagagaagacacaccagcagaaagctgagagacttcaagtgggccggcgacctgggcgtgaacgaggagagcatcagcagcctgttcgacttcacccccgagtgcagagccacctaccaggaccagaagaacaagaaggccaacgagtgcagcagcggcctgaagtacagcatggagctggacgagatggacgaggtgaagttcttcagccaggagaaggacctggacggcaagatccagaacgcccccaacagccacagcgcccagcacgtgaagatgggctacggcgcctggtacctgaagcccaagctgggcaagaagctgagaagcgacgagcccctgatcgaccccaagctggtgctggagaagcccgacgagcccgacatcctggacggcctgtacggccccatcgccttcaaggacttcatcctgagcaagggctacgagatgcccggcatcatccagagactgttcgccagaagaggctggacctacgacagcgtgaagacccccatccagagagccatgcaggtgtacaagtacaaggaggacgtgaccgacgccagcgaggaggactag

SEQ ID NO: 21166 - DNA, 888 bp, Artificial Sequence; identical to SEQ ID NO: 21161
  Description of Artificial Sequence: Synthetic coding sequence

SEQ ID NO: 21167 - DNA, 1182 bp, Artificial Sequence
  Description of Artificial Sequence: Synthetic coding sequence
atggccgacagaagaagaagactgagacccggcaccctggcccccgtgagagagggcgtgaactgcagaagcagatgcttcaccaagcacaagaacggcctgaagttccccaccagcctgcacagcagacagctggtgttccccagaaagggcctggacgacttcagaaagggctgccccccctgcaccggcctggtgacccaggtgcccgtggagggcttcctgccccagatctaccacagagccccccagctggcccccaagaagagacagatcaagctgctgaaggaggccgacgtgctgagcaagctgagccccgcccagcaggccagaaaggccttcctggaggacgtggaggcccacctgaccccccaccccctggccctgtacctgaacctggaggaggccatgcccatcgagctgctgagcaaggtgctggaggtgctggaccccgacagaaagctggaggacacctgggcctactgccaggacaccagaaagggcatgaaggagcccaccaagctgctgaagaagcacagcacccaggtgtacctgggccccagcaagaagaccagcgtgagcaacgccggccagtggctgtacgaggagaagccccacaagatggacctgctgcacgagaacggccccagacccggcctgcacgagaacggcatcagcgacatcgacgaggagttcatcctgaagcagttcgacatcgactacgagaccaagcccagccacgacgccctgcacaccatgaagctgaaccaggtgcccctggagctgaagagaagcgtgggcctgagcaagctgcaggagaccgagttcttccagaagctgggctacgagagaaagctgcagaagccccagaacccctacaagcccaagtgggtgaagatgagatacggcgcctggtacctgaaccccaagctgtggaagaagcagagagtggacgagcccctggtggaccccgaggtgagccacaaggcccaggaggagaacttcaagaaggagctgcaggagcaggaggagctgctggccgacctgcacggcaccgtggccttcaaggacttcatcctgagcagaggctacagaacccccagattcctggagaacatgtacatcggcaaggagtgcaagagagcctgcaacaagacccccatcaagagaacccaggcctag

SEQ ID NO: 21168 - DNA, 972 bp, Artificial Sequence
  Description of Artificial Sequence: Synthetic coding sequence
atgggcaacctgctgaaggtgctgaccagagagatcgagaactacccccacttcttcctggacttcgagaacgcccagcccaccgagggcgagagagagatctggaaccagatcagcgccgtgctgcaggacagcgagagcatcctggccgacctgcaggcctacaagggcgccggccccgagatcagagacgccatccagaaccccaacgacatccagctgcaggagaaggcctggaacgccgtgtgccccctggtggtgagactgaagagattctacgagttcagcatcagactggagaaggccctgcagagcctgctggagagcctgacctgccccccctacacccccacccagcacctggagagagagcaggccctggccaaggagttcgccgagatcctgcacttcaccctgagattcgacgagctgaagatgagaaaccccgccatccagaacgacttcagctactacagaagaaccatcagcagaaacagaatcaacaacatgcacctggacatcgagaacgaggtgaacaacgagatggccaacagaatgagcctgttctacgccgaggccacccccatgctgaagaccctgagcaacgccaccatgcacttcgtgagcgagaacaagaccctgcccatcgagaacaccaccgactgcctgagcaccatgaccagcgtgtgcaaggtgatgctggagacccccgagtacagaagcagattcaccagcgaggagaccctgatgttctgcatgagagtgatggtgggcgtgatcatcctgtacgaccacgtgcaccccgtgggcgccttctgcaagaccagcaagatcgacatgaagggctgcatcaaggtgctgaaggagcaggcccccgacagcgtggagggcctgctgaacgccctgagattcaccaccaagcacctgaacgacgagagcaccagcaagcagatcagagccatgctgcagtag

SEQ ID NO: 21169 - DNA, 972 bp, Artificial Sequence; identical to SEQ ID NO: 21168
  Description of Artificial Sequence: Synthetic coding sequence

SEQ ID NO: 21170 - DNA, 972 bp, Artificial Sequence; identical to SEQ ID NO: 21168
  Description of Artificial Sequence: Synthetic coding sequence

SEQ ID NO: 21171 - DNA, 285 bp, Artificial Sequence
  Description of Artificial Sequence: Synthetic coding sequence
atgggcaacctgctgaaggtgctgaccagagagatcgagaactacccccacttcttcctggacttcgagaacgcccagcccaccgagggcgagagagagatctggaaccagatcagcgccgtgctgcaggacagcgagagcatcctggccgacctgcaggcctacaagggcgccggccccgagatcagagacgccatccagaaccccaacgacatccagctgcaggagaaggcctggaacgccgtgtgccccctggtggtgagactgaagagattctacgagtag

SEQ ID NO: 21172 - DNA, 264 bp, Artificial Sequence
  Description of Artificial Sequence: Synthetic coding sequence
atgggcaacctgctgaaggtgctgaccagagagatcgagaactacccccacttcttcctggacttcgagaacgcccagcccaccgagggcgagagagagatctggaaccagatcagcgccgtgctgcaggacagcgagagcatcctggccgacctgcaggcctacaagggcgccggccccgagatcagagacgccatccagaaccccaacgacatccagctgcaggagaaggcctggaacgccgtgtgccccctggtggtgtag

SEQ ID NO: 21173 - DNA, 654 bp, Artificial Sequence
  Description of Artificial Sequence: Synthetic coding sequence
atgcagaaggccagctggagaacctgcagccacaccgaggagctggccaccaagtacgagagagccatccagcaccccgccgacgagaagctgcaggagaaggcctggggcgccgtggtgcccctggtgggcaaggagatcctgagaatcttcagcgaggtgagaagcagcatcaagagaagcagcggcagcctgaacaagtaccccatcttcagccaccccgccagcagagccagacaggccctggccaagcagttcgccgagatcctgcacttcaccctgagattcgacgagctgaagatgaccaaccccgccatccagaacgacttcagctactacagaagaaccctgagcagaatgagaatcaccatgtacagagccgagggcgagaacgaggtgaacaacgagctggccaacagaatgagcctgttctacgccgaggccacccccatgctgaagaccctgagcgacgccaccaccaagttcgtgagcgagaacaagaacctgcccatcgagaacaccaccgactgcctgagcaccatggccagcgtgtgcagagtgatgctggagacccccgagtacagaagcagattcaccaacgaggagaccgtgagcttcctggagggcaacggcggctgccacaacaccctgtag

SEQ ID NO: 21174 - DNA, 975 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagaggccatccagcaccccgccgacgagaagctgcaggagaaggcctggggcgccgtggtgcccctggtgggcaagctgaagaagttctacgagttcagccagagactggaggccgccctgagaggcctgctgggcgccctgaccagcaccccctacagccccacccagcacctggagagagagcaggccctggccaagcagttcgccgagatcctgcacttcaccctgagattcgacgagctgaagatgaccaaccccgccatccagaacgacttcagctactacagaagaaccctgagcagaatgagaatcaacaacgtgcccgccgagggcgagaacgaggtgaacaacgagctggccaacagaatgagcctgttctacgccgaggccacccccatgctgaagaccctgagcgacgccaccaccaagttcgtgagcgagaacaagaacctgcccatcgagaacaccaccgactgcctgagcaccatggccagcgtgtgcagagtgatgctggagacccccgagtacagaagcagattcaccaacgaggagaccgtgagcttctgcctgagagtgatggtgggcgtgatcatcctgtacgaccacgtgcaccccgtgggcgccttcgccaagaccagcaagatcgacatgaagggctgcatcaaggtgctgaaggaccagccccccaacagcgtggagggcctgctgaacgccctgagatacaccaccaagcacctgaacgacgagaccaccagcaagcagatcaagagcatgctgcagtag

SEQ ID NO: 21175 - DNA, 975 bp, Artificial Sequence; identical to SEQ ID NO: 21174
  Description of Artificial Sequence: Synthetic coding sequence

SEQ ID NO: 21176 - DNA, 192 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatctag

SEQ ID NO: 21177 - DNA, 198 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagagtag

SEQ ID NO: 21178 - DNA, 297 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagaggccatccagcaccccgccgacgagaagctgcaggagaaggcctggggcgccgtggtgcccctggtgggcaagctgaagaagttctacgagttcagccagtag

SEQ ID NO: 21179 - DNA, 207 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagaggccatccagtag

SEQ ID NO: 21180 - DNA, 147 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggctag

SEQ ID NO: 21181 - DNA, 975 bp, Artificial Sequence; identical to SEQ ID NO: 21174
  Description of Artificial Sequence: Synthetic coding sequence

SEQ ID NO: 21182 - DNA, 468 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagaggccatccagcaccccgccgacgagaagctgcaggagaaggcctggggcgccgtggtgcccctggtgggcaagctgaagaagttctacgagttcagccagagactggaggccgccctgagaggcctgctgggcgccctgaccagcaccccctacagccccacccagcacctggagagagagcaggccctggccaagcagttcgccgagatcctgcacttcaccctgagattcgacgagctgaaggtggagctgagcatcggccccgactgctag

SEQ ID NO: 21183 - DNA, 975 bp, Artificial Sequence; identical to SEQ ID NO: 21174
  Description of Artificial Sequence: Synthetic coding sequence

SEQ ID NO: 21184 - DNA, 975 bp, Artificial Sequence; identical to SEQ ID NO: 21174
  Description of Artificial Sequence: Synthetic coding sequence

SEQ ID NO: 21185 - DNA, 303 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagaggccatccagcaccccgccgacgagaagctgcaggagaaggcctggggcgccgtggtgcccctggtgggcaagctgaagaagttctacgagttcagccagagactgtag

SEQ ID NO: 21186 - DNA, 240 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagaggccatccagcaccccgccgacgagaagctgcaggagaaggcctag

SEQ ID NO: 21187 - DNA, 141 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgcctag

SEQ ID NO: 21188 - DNA, 975 bp, Artificial Sequence; identical to SEQ ID NO: 21174
  Description of Artificial Sequence: Synthetic coding sequence

SEQ ID NO: 21189 - DNA, 975 bp, Artificial Sequence; identical to SEQ ID NO: 21174
  Description of Artificial Sequence: Synthetic coding sequence

SEQ ID NO: 21190 - DNA, 282 bp, Artificial Sequence
  Description of Artificial Sequence: Synthetic coding sequence
atgggcaacctgctgaaggtgctgacctgcaccgacctggagcagggccccaacttcttcctggacttcgagaacgcccagcccaccgagagcgagaaggagatctacaaccaggtgaacgtggtgctgaaggacgccgagggcatcctggaggacctgcagagctacagaggcgccggccacgagatcagagaggccatccagcaccccgccgacgagaagctgcaggagaaggcctggggcgccgtggtgcccctggtgggcaagctgaagaagttctag

SEQ ID NO: 21191 - DNA, 978 bp, Artificial Sequence
  Description of Artificial Sequence: Synthetic coding sequence
atggcccagtacaagggcaccatgagagaggccggcagagccatgcacctgctgaagaagagagagagacagagagagcagatggaggtgctgaagcagagaatcgccgaggagaccatcctgaagagccaggtggacaagagattcagcgcccactacgacgccgtggaggccgagctgaagagcagcaccgtgggcctggtgaccctgaacgacatgaaggccagacaggaggccctggtgagagagagagagagacagctggccaagagacagcacctggaggagcagagactgcagcaggagagacagagagagcaggagcagagaagagagagaaagagaaagatcagctgcctgagcttcgccctggacgacctggacgaccaggccgacgccgccgaggccagaagagccggcaacctgggcaagaaccccgacgtggacaccagcttcctgcccgacagagacagagaggaggaggagaacagactgagagaggagctgagacaggagtgggaggcccagagagagaaggtgaaggacgaggagatggaggtgaccttcagctactgggacggcagcggccacagaagaaccgtgagagtgagaaagggcaacaccgtgcagcagttcctgaagaaggccctgcagggcctgagaaaggacttcctggagctgagaagcgccggcgtggagcagctgatgttcatcaaggaggacctgatcctgccccactaccacaccttctacgacttcatcatcgccagagccagaggcaagagcggccccctgttcagcttcgacgtgcacgacgacgtgagactgctgagcgacgccaccatggagaaggacgagagccacgccggcaaggtggtgctgagaagctggtacgagaagaacaagcacatcttccccgccagcagatgggaggcctacgaccccgagaagaagtgggacaagtacaccatcagatag

SEQ ID NO: 21192 - DNA, 978 bp, Artificial Sequence; identical to SEQ ID NO: 21191
  Description of Artificial Sequence: Synthetic coding sequence

SEQ ID NO: 21193 - DNA, 1269 bp, Artificial Sequence
  Description of Artificial Sequence: Synthetic coding sequence
atggtgatggtgctgagcgagagcctgagcaccagaggcgccgacagcatcgcctgcggcaccttcagcagagagctgcacacccccaagaagatgagccagggccccaccctgttcagctgcggcatcatggagaacgacagatggagagacctggacagaaagtgccccctgcagatcgaccagcccagcaccagcatctgggagtgcctgcccgagaaggacagcagcctgtggcacagagaggccgtgaccgcctgcgccgtgaccagcctgatcaaggacctgagcatcagcgaccacaacggcaaccccagcgccccccccagcaagagacagtgcagaagcctgagcttcagcgacgagatgagcagctgcagaaccagctggagacccctgggcagcaaggtgtggacccccgtggagaagagaagatgctacagcggcggcagcgtgcagagatacagcaacggcttcagcaccatgcagagaagcagcagcttcagcctgcccagcagagccaacgtgctgagcagcccctgcgaccaggccggcctgcaccacagattcggcggccagccctgccagggcgtgcccggcagcgccccctgcggccaggccggcgacacctggagccccgacctgcaccccgtgggcggcggcagactggacctgcagagaagcctgagctgcagccacgagcagttcagcttcgtggagtactgcccccccagcgccaacagcacccccgccagcacccccgagctggccagaagaagcagcggcctgagcagaagcagaagccagccctgcgtgctgaacgacaagaaggtgggcgtgaagagaagaagacccgaggaggtgcaggagcagagacccagcctggacctggccaagatggcccagaactgccagaccttcagcagcctgagctgcctgagcgccggcaccgaggactgcggcccccagagccccttcgccagacacgtgagcaacaccagagcctggaccgccctgctgagcgccagcggccccggcggcagaacccccgccggcacccccgtgcccgagcccctgccccccagcttcgacgaccacctggcctgccaggaggacctgagctgcgaggagagcgacagctgcgccctggacgaggactgcggcagaagagccgagcccgccgccgcctggagagacagaggcgcccccggcaacagcctgtgcagcctggacggcgagctggacatcgagcagatcgagaagaactag

SEQ ID NO: 21194 - DNA, 1269 bp, Artificial Sequence; identical to SEQ ID NO: 21193
  Description of Artificial Sequence: Synthetic coding sequence

SEQ ID NO: 21195 - DNA, 1179 bp, Artificial Sequence
  Description of Artificial Sequence: Synthetic coding sequence
atgatcaccctgatcaccgagcagctgcagaagcagaccctggacgagctgaagtgcaccagattcagcatcagcctgcccctgcccgaccacgccgacatcagcaactgcggcaacagcttccagctggtgagcgagggcgccagctggagaggcctgccccactgcagctgcgccgagttccaggacagcctgaacttcagctaccaccccagcggcctgagcctgcacctgagaccccccagcagaggcaacagccccaaggagcagcccttcagccaggtgctgagacccgagccccccgaccccgagaagctgcccgtgccccccgccccccccagcaagagacactgcagaagcctgagcgtgcccgtggacctgagcagatggcagcccgtgtggagacccgcccccagcaagctgtggacccccatcaagcacagaggcagcggcggcggcggcggcccccaggtgccccaccagagcccccccaagagagtgagcagcctgagattcctgcaggcccccagcgccagcagccagtgcgcccccgcccacagaccctacagcccccccttcttcagcctggccctggcccaggacagcagcagaccctgcgccgccagcccccagagcggcagctgggagagcgacgccgagagcctgagcccctgccccccccagagaagattcagcctgagccccagcctgggcccccaggccagcagattcctgcccagcgccagaagcagccccgccagcagccccgagctgccctggagacccagaggcctgagaaacctgcccagaagcagaagccagccctgcgacctggacgccagaaagaccggcgtgaagagaagacacgaggaggaccccagaagactgagacccagcctggacttcgacaagatgaaccagaagccctacagcggcggcctgtgcctgcaggagaccgccagagagggcagcagcatcagccccccctggttcatggcctgcagccccccccccctgagcgccagctgcagccccaccggcggcagcagccaggtgctgagcgagagcgaggaggaggaggagggcgccgtgagatggggcagacaggccctgagcaagagaaccctgtgccagagagacttcggcgacctggacctgaacctgatcgaggagaactag

SEQ ID NO: 21196 - DNA, 1179 bp, Artificial Sequence; identical to SEQ ID NO: 21195
  Description of Artificial Sequence: Synthetic coding sequence

SEQ ID NO: 21197 - DNA, 1158 bp, Artificial Sequence
  Description of Artificial Sequence: Synthetic coding sequence
atgagcctgatcctgaacatcctgagagagatgctggagtacttcggcgtgcccgtggagcaggtgctgctgatctgggagaacaaggactacggcagcaccagaagcatcgtgagaatcatcggcaagatgctgcccctggagccctgcagaagacccaacttcgagctgatccccctgctgaacagcgtggacagcgacaactgcggcagcatggtgcccagcttcgccgacatcctgtacgtggccaacgacgaggaggccagctacctgagattcagaaacagcatctggaagaacgaggaggagaaggtggagatcttccaccccctgagactggtgagagaccccctgagccccgccgtgagacagaaggagaccgtgaagaacgacctgcccgtgaacgaggccgccatcagaaagatcgccgccctggagaacgagctgaccttcctgagaagccagatcgccgccatcgtggagatgcaggagctgaagaacagcaccaacagcagcagcttcggcctgagcgacgagagaatcagcctgggccagctgagcagcagcagagccgcccacctgagcgtggaccccgaccagctgcccggcagcgtgctgagcccccccccccccccccccctgcccccccagttcagcagcctgcagcccccctgcttcccccccgtgcagcccggcagcaacaacatctgcgacagcgacaaccccgccaccgagatgagcaagcagaaccccgccgccaacaagaccaactacagccaccacagcaagagccagagaaacaaggacatccccaacatgctggacgtgctgaaggacatgaacaaggtgaagctgagagccatcgagagaagccccggcggcagacccatccacaagagaaagagacagaacagccactgggaccccgtgagcctgatcagccacgccctgaagcagaagttcgccttccaggaggacgacagcttcgagaaggagaacagaagctgggagagcagccccttcagcagccccgagaccagcagattcggccaccacatcagccagagcgagggccagagaaccaaggaggagatggtgaacaccaaggccgtggaccagggcatcagcaacaccagcctgctgaacagcagaatctag

SEQ ID NO: 21198 - DNA, 1158 bp, Artificial Sequence; identical to SEQ ID NO: 21197
  Description of Artificial Sequence: Synthetic coding sequence

SEQ ID NO: 21199 - DNA, 879 bp, Artificial Sequence
  Description of Artificial Sequence: Synthetic coding sequence
atgagcggcatggaggccaccgtgaccatccccatctggcagaacaagccccacggcgccgccagaagcgtggtgagaagaatcggcaccaacctgcccctgaagccctgcgccagagccagcttcgagaccctgcccaacatcagcgacctgtgcctgagagacgtgccccccgtgcccaccctggccgacatcgcctggatcgccgccgacgaggaggagacctacgccagagtgagaagcgacaccagacccctgagacacacctggaagcccagccccctgatcgtgatgcagagaaacgccagcgtgcccaacctgagaggcagcgaggagagactgctggccctgaagaagcccgccctgcccgccctgagcagaaccaccgagctgcaggacgagctgagccacctgagaagccagatcgccaagatcgtggccgccgacgccgccagcgccagcctgacccccgacttcctgagccccggcagcagcaacgtgagcagccccctgccctgcttcggcagcagcttccacagcaccaccagcttcgtgatcagcgacatcaccgaggagaccgaggtggaggtgcccgagctgcccagcgtgcccctgctgtgcagcgccagccccgagtgctgcaagcccgagcacaaggccgcctgcagcagcagcgaggaggacgactgcgtgagcctgagcaaggccagcagcttcgccgacatgatgggcatcctgaaggacttccacagaatgaagcagagccaggacctgaacagaagcctgctgaaggaggaggaccccgccgtgctgatcagcgaggtgctgagaagaaagttcgccctgaaggaggaggacatcagcagaaagggcaactag

SEQ ID NO: 21200 - DNA, 879 bp, Artificial Sequence; identical to SEQ ID NO: 21199
  Description of Artificial Sequence: Synthetic coding sequence

SEQ ID NO: 21201 - DNA, 879 bp, Artificial Sequence; identical to SEQ ID NO: 21199
  Description of Artificial Sequence: Synthetic coding sequence

SEQ ID NO: 21202 - DNA, 843 bp, Artificial Sequence
  Description of Artificial Sequence: Synthetic coding sequence
atgagcggcatggaggccaccgtgaccatccccatctggcagaacaagccccacggcgccgccagaagcgtggtgagaagaatcggcaccaacctgcccctgaagccctgcgccagagccagcttcgagaccctgcccaacatcagcgacctgtgcctgagagacgtgccccccgtgcccaccctggccgacatcgcctggatcgccgccgacgaggaggagacctacgccagagtgagaagcgacaccagacccctgagacacacctggaagcccagccccctgatcgtgatgcagagaaacgccagcgtgcccaacctgagaggcagcgaggagagactgctggccctgaagaagcccgccctgcccgccctgagcagaaccaccgagctgcaggacgagctgagccacctgagaagccagatcgccaagatcgtggccgccgacgccggcagcagcaacgtgagcagccccctgccctgcttcggcagcagcttccacagcaccaccagcttcgtgatcagcgacatcaccgaggagaccgaggtggaggtgcccgagctgcccagcgtgcccctgctgtgcagcgccagccccgagtgctgcaagcccgagcacaaggccgcctgcagcagcagcgaggaggacgactgcgtgagcctgagcaaggccagcagcttcgccgacatgatgggcatcctgaaggacttccacagaatgaagcagagccaggacctgaacagaagcctgctgaaggaggaggaccccgccgtgctgatcagcgaggtgctgagaagaaagttcgccctgaaggaggaggacatcagcagaaagggcaactag

SEQ ID NO: 21203 - DNA, 459 bp, Artificial Sequence
  Description of Artificial Sequence: Synthetic coding sequence
atgagcggcatggaggccaccgtgaccatccccatctggcagaacaagccccacggcgccgccagaagcgtggtgagaagaatcggcaccaacctgcccctgaagccctgcgccagagccagcttcgagaccctgcccaacatcagcgacctgtgcctgagagacgtgccccccgtgcccaccctggccgacatcgcctggatcgccgccgacgaggaggagacctacgccagagtgagaagcgacaccagacccctgagacacacctggaagcccagccccctgatcgtgatgcagagaaacgccagcgtgcccaacctgagaggcagcgaggagagactgctggccctgaagaagcccgccctgcccgccctgagcagaaccaccgagctgcaggacgagctgagccacctgagaagccagatcgccaagatcgtggccgccgacgccgccagctag

SEQ ID NO: 21204 - DNA, 618 bp, Artificial Sequence
  Description of Artificial Sequence: Synthetic coding sequence
atgagcggcatggaggccaccgtgaccatccccatctggcagaacaagccccacggcgccgccagaagcgtggtgagaagaatcggcaccaacctgcccctgaagccctgcgccagagccagcttcgagaccctgcccaacatcagcgacctgtgcctgagagacgtgccccccgtgcccaccctggccgacatcgcctggatcgccgccgacgaggaggagacctacgccagagtgagaagcgacaccagacccctgagacacacctggaagcccagccccctgatcgtgatgcagagaaacgccagcgtgcccaacctgagaggcagcgaggagagactgctggccctgaagaagcccgccctgcccgccctgagcagaaccaccgagctgcaggacgagctgagccacctgagaagccagatcgccaagatcgtggccgccgacgccgtgaccagccccagaagacagagatggagaagcctgagcttccaccagagcccctgcttcgtgctgcccgccctgaacgtggccaaccagaacaccaagctgcccgccgtgagactgaagagaatgaccgccagcctgtgccccagacccgccgccctgcagacctag

SEQ ID NO: 21205 - DNA, 618 bp, Artificial Sequence; identical to SEQ ID NO: 21204
  Description of Artificial Sequence: Synthetic coding sequence

SEQ ID NO: 21206 - DNA, 333 bp, Artificial Sequence
  Description of Artificial Sequence: Synthetic coding sequence
atgagcggcatggaggccaccgtgaccatccccatctggcagaacaagccccacggcgccgccagaagcgtggtgagaagaatcggcaccaacctgcccctgaagccctgcgccagagccagcttcgagaccctgcccaacatcagcgacctgtgcctgagagacgtgccccccgtgcccaccctggccgacatcgcctggatcgccgccgacgaggaggagacctacgccagagtgagaagcgacaccagacccctgagacacacctggaagcccagccccctgatcgtgatgcagagaaacgccagcgtgcccaacctgagaggcagctag

SEQ ID NO: 21207 - DNA, 513 bp, Artificial Sequence
  Description of Artificial Sequence: Synthetic coding sequence
atgagcggcatggaggccaccgtgaccatccccatctggcagaacaagccccacggcgccgccagaagcgtggtgagaagaatcggcaccaacctgcccctgaagccctgcgccagagccagcttcgagaccctgcccaacatcagcgacctgtgcctgagagacgtgccccccgtgcccaccctggccgacatcgcctggatcgccgccgacgaggaggagacctacgccagagtgagaagcgacaccagacccctgagacacacctggaagcccagccccctgatcgtgatgcagagaaacgccagcgtgcccaacctgagaggcagcgaggagagactgctggccctgaagaagcccgccctgcccgccctgagcagaaccaccgagctgcaggacgagctgagccacctgagaagccagatcgccaagatcgtggccgccgacgccgccagcgccagcctgacccccgacttcctgagccccggcagcagcaacgtgagcagcccctag

SEQ ID NO: 21208 - DNA, 348 bp, Artificial Sequence
  Description of Artificial Sequence: Synthetic coding sequence
atgagcggcatggaggccaccgtgaccatccccatctggcagaacaagccccacggcgccgccagaagcgtggtgagaagaatcggcaccaacctgcccctgaagccctgcgccagagccagcttcgagaccctgcccaacatcagcgacctgtgcctgagagacgtgccccccgtgcccaccctggccgacatcgcctggatcgccgccgacgaggaggagacctacgccagagtgagaagcgacaccagacccctgagacacacctggaagcccagccccctgatcgtgatgcagagaaacgccagcgtgcccaacctgagaggcagcgaggagagactgctgtag

SEQ ID NO: 21209 - DNA, 1995 bp, Artificial Sequence
  Description of Artificial Sequence: Synthetic coding sequence
atgcacagaatgcccgaccccggcaagttcaagctgctggagcaggccagagacgtgagagagcccgtgagatacttcagcagcgtggaggaggtggccagcgtgttccccgacagaatcttcgtgatggaggccatcaccttcagcgtgaaggtggtgagcggcgagttcagcgaggacagcgaggtgtacaacttcaccctgcacgccggcgacgagctgaccctgatgggccaggccgagatcctgtgcgccaagaccaccaaggagagaagcagattcaccaccctgctgagaaagctgggcagagccggcgccctggccggcgtgggcggcggcggccccgccagcgccggcgccgccggcggcaccggcggcggcggcgccagacccgtgaagggcaagatgccctgcctgatctgcatgaaccacagaaccaacgagagcctgagcctgcccttccagtgccagggcagattcagcaccagaagccccctggagctgcagatgcaggagggcgagcacaccgtgagagccatcatcgagagagtgagactgcccgtgaacgtgctggtgcccagcagaccccccagaaacccctacgacctgcaccccgtgagagagggccactgctacaagctggtgagcatcatcagcaagaccgtggtgctgggcctggccctgagaagagagggccccgcccccctgcacttcctgctgctgaccgacacccccagattcgccctgccccagggcctgctggccggcgaccccagagtggagagactggtgagagacagcgccagctactgcagagagagattcgaccccgacgagtacagcaccgccgtgagagaggcccccgccgagctggccgaggactgcgccagccccagaagagccagactgtgcctgcccgcccccagagcccccggcctggccagagcccccggccccctggcccccgcccccgccggcgagggcgaccaggagtacgtgagccccgactgggccgccgcccccgagcccgccgccccccccgccgagatcccctacgaggagctgtgggcccaccagggccccgagggcctggtgagacccccccccggcctggacctgatcagcttcggcgccgccggcccccccagaagagagcccgaggccccccccccccccgtgccccccaagagcgaggccgtgaaggaggagtgcagactgctgaacgccccccccgtgccccccagaggcggcaacggcagcggcagactgagcagcagcccccccgtgccccccagattccccaagctgcagcccgtgcacagccccagcagcagcctgagctactacagcagcggcctgcaggacggcgccggcagcagaagcggcagcggcagccccagccccgacacctacagcctgtactgctacccctgcacctggggcgactgcaaggagcccgtgctggagcccttcgaccccttcgagctgggccagggcagcagccccgagcccgagctgctgagaagccaggagcccagagccgtgggcacccccggccccggccccagactgagccccctgggccccagcaaggccttcgagcccgagggcctggtgctgcaccaggtgcccacccccctgagccccgccgccctgcagggccccgaggccggcggcgccctgttcctgacccagggcagactggagggcccccccgccagccccagagacggcgccaccggcttcggcgtgagagacgccagcagctggcagccccccgccgacctgagcgccctgagcctggaggaggtgagcagaagcctgagattcatcggcctgagcgaggacgtggtgagcttcttcgccagagagagaatcgacggcagcatcttcgtgcagctgagcgaggacatcctggccgacgacttccacctgaccaagctgcaggtgaagaagatcatgcagttcatcaagggctggagacccaagatctag

SEQ ID NO: 21210 - DNA, 2631 bp, Artificial Sequence
  Description of Artificial Sequence: Synthetic coding sequence
atggaccccgcccccagcctgggctgcagcctgaaggacgtgaagtggagcagcgtggccgtgcccctggacctgctggtgagcacctacagactgccccagatcgccagactggacaacggcgagtgcgtggagggcctgagagagaacgactacctgctgatccacagctgcagacagtggaccaccatcaccgcccacagcctggaggagggccactacgtgatcggccccaagatcgagatccccgtgcactacgccggccagttcaagctgctggagcaggacagagacatcaaggagcccgtgcagtacttcaacagcgtggaggaggtggccaaggccttccccgagagagtgtacgtgatggaggacatcaccttcaacgtgaaggtggccagcggcgagtgcaacgaggacaccgaggtgtacaacatcaccctgtgcaccggcgacgagctgaccctgatgggccaggccgagatcctgtacgccaagaccttcaaggagaagagcagactgaacaccatcttcaagaagatcggcaagctgaacagcatcagcaagctgggcaagggcaagatgccctgcctgatctgcatgaaccacagaaccaacgagagcatcagcctgcccttccagtgcaagggcagattcagcaccagaagccccctggagctgcagatgcaggagggcgagcacaccatcagaaacatcgtggagaagaccagactgcccgtgaacgtgaccgtgcccagccccccccccagaaacccctacgacctgcacttcatcagagagggccacagatacaagttcgtgaacatccagaccaagaccgtggtggtgtgctgcgtgctgagaaacaacaagatcctgcccatgcacttccccctgcacctgaccgtgcccaagttcagcctgcccgagcacctggtgaagggcgagagctggcccgagaccctggtgcaccactggctgggcatctgccaggagcagttcgacatcgacgagtacagcagagccgtgagagacgtgaagaccgactggaacgaggagtgcaagagccccaagaagggcagatgcagcggccacaaccacgtgcccaacagcctgagctacgccagagacgagctgacccagagcttccacagactgagcgtgtgcgtgtacggcaacaacctgcacggcaacagcgaggtgaacctgcacggctgcagagacctgggcggcgactgggcccccttcccccacgacatcctgccctaccaggacagcggcgacagcggcagcgactacctgttccccgaggccagcgaggagagcgccggcatccccggcaagagcgagctgccctacgaggagctgtggctggaggagggcaagcccagccaccagcccctgaccagaagcctgagcgagaagaacagatgcgaccagttcagaggcagcgtgagaagcaagtgcgccaccagccccctgcccatccccggcaccctgggcgccgccgtgaagagcagcgacaccgccctgccccccccccccgtgccccccaagagcgaggccgtgagagaggagtgcagactgctgaacgccccccccgtgccccccagaagcgccaagcccctgagcaccagccccagcatcccccccagaaccgtgaagcccgccagacagcagaccagaagccccagccccaccctgagctactacagcagcggcctgcacaacatcagcgtgaccaagaccgacaccaaccccagcgagagcacccccgtgagctgctacccctgcaacagagtgaagaccgacagcgtggacctgaagagccccttcggcagccccagcgccgaggccgtgagcagcagactgagctggcccaaccactacagcggcgccagcgagagccagaccagaagcgacttcctgctggaccccagcagaagctacagctaccccagacagaagacccccggcacccccaagagaaactgccccgcccccttcgacttcgacggctgcgagctgctggccagccccaccagccccgtgaccgccgagttcagcagcagcgtgagcggctgccccaagagcgccagctacagcctggagagcaccgacgtgaagagcctggccgccggcgtgaccaagcagagcaccagctgccccgccctgccccccagagcccccaagctggtggaggagaaggtggccagcgagaccagccccctgcccctgaagatcgacggcgccgaggaggaccccaagagcggcagccccgacctgagcgaggaccagtacttcgtgaagaagggcatgcaggacatcttcagcgccagctaccccttcagcagccccctgcacctgcagctggcccccagaagctgcggcgacggcagcccctggcagccccccgccgacctgagcggcctgagcatcgaggaggtgagcaagagcctgagattcatcggcctgagcgaggacgtgatcagcttcttcgtgaccgagaagatcgacggcaacctgctggtgcagctgaccgaggagatcctgagcgaggacttcaagctgagcaagctgcaggtgaagaagatcatgcagttcatcaacggctggagacccaagatctag

SEQ ID NO: 21211 - DNA, 2628 bp, Artificial Sequence
  Description of Artificial Sequence: Synthetic coding sequence
atggaccccgcccccagcctgggctgcagcctgaaggacgtgaagtggagcagcgtggccgtgcccctggacctgctggtgagcacctacagactgccccagatcgccagactggacaacggcgagtgcgtggagggcctgagagagaacgactacctgctgatccacagctgcagacagtggaccaccatcaccgcccacagcctggaggagggccactacgtgatcggccccaagatcgagatccccgtgcactacgccggccagttcaagctgctggagcaggacagagacatcaaggagcccgtgcagtacttcaacagcgtggaggaggtggccaaggccttccccgagagagtgtacgtgatggaggacatcaccttcaacgtgaaggtggccagcggcgagtgcaacgaggacaccgaggtgtacaacatcaccctgtgcaccggcgacgagctgaccctgatgggccaggccgagatcctgtacgccaagaccttcaaggagaagagcagactgaacaccatcttcaagaagatcggcaagctgaacagcatcagcaagctgggcaagggcaagatgccctgcctgatctgcatgaaccacagaaccaacgagagcatcagcctgcccttccagtgcaagggcagattcagcaccagaagccccctggagctgcagatgcaggagggcgagcacaccatcagaaacatcgtggagaagaccagactgcccgtgaacgtgaccgtgcccagccccccccccagaaacccctacgacctgcacttcatcagagagggccacagatacaagttcgtgaacatccagaccaagaccgtggtggtgtgctgcgtgctgagaaacaacaagatcctgcccatgcacttccccctgcacctgaccgtgcccaagttcagcctgcccgagcacctggtgaagggcgagagctggcccgagaccctggtgcaccactggctgggcatctgccaggagcagttcgacatcgacgagtacagcagagccgtgagagacgtgaagaccgactggaacgaggagtgcaagagccccaagaagggcagatgcagcggccacaaccacgtgcccaacagcctgagctacgccagagacgagctgacccagagcttccacagactgagcgtgtgcgtgtacggcaacaacctgcacggcaacagcgaggtgaacctgcacggctgcagagacctgggcggcgactgggcccccttcccccacgacatcctgccctaccaggacagcggcgacagcggcagcgactacctgttccccgaggccagcgaggagagcgccggcatccccggcaagagcgagctgccctacgaggagctgtggctggaggagggcaagcccagccaccagcccctgaccagaagcctgagcgagaagaacagatgcgaccagttcagaggcagcgtgagaagcaagtgcgccaccagccccctgcccatccccggcaccctgggcgccgccgtgaagagcagcgacaccgccctgccccccccccccgtgccccccaagagcgaggccgtgagagaggagtgcagactgctgaacgccccccccgtgccccccagaagcgccaagcccctgagcaccagccccagcatcccccccagaaccgtgaagcccgccagacagcagaccagaagccccagccccaccctgagctactacagcagcggcctgcacaacatcgtgaccaagaccgacaccaaccccagcgagagcacccccgtgagctgctacccctgcaacagagtgaagaccgacagcgtggacctgaagagccccttcggcagccccagcgccgaggccgtgagcagcagactgagctggcccaaccactacagcggcgccagcgagagccagaccagaagcgacttcctgctggaccccagcagaagctacagctaccccagacagaagacccccggcacccccaagagaaactgccccgcccccttcgacttcgacggctgcgagctgctggccagccccaccagccccgtgaccgccgagttcagcagcagcgtgagcggctgccccaagagcgccagctacagcctggagagcaccgacgtgaagagcctggccgccggcgtgaccaagcagagcaccagctgccccgccctgccccccagagcccccaagctggtggaggagaaggtggccagcgagaccagccccctgcccctgaagatcgacggcgccgaggaggaccccaagagcggcagccccgacctgagcgaggaccagtacttcgtgaagaagggcatgcaggacatcttcagcgccagctaccccttcagcagccccctgcacctgcagctggcccccagaagctgcggcgacggcagcccctggcagccccccgccgacctgagcggcctgagcatcgaggaggtgagcaagagcctgagattcatcggcctgagcgaggacgtgatcagcttcttcgtgaccgagaagatcgacggcaacctgctggtgcagctgaccgaggagatcctgagcgaggacttcaagctgagcaagctgcaggtgaagaagatcatgcagttcatcaacggctggagacccaagatctag

SEQ ID NO: 21212 - DNA, 2625 bp, Artificial Sequence
  Description of Artificial Sequence: Synthetic coding sequence
atggagaagctggccgccggcctggccggcctgagatggagcatgggcgccttccccctggacctgatcgtgagcagatgcagactgcccaccctggcctgcctgggccccggcgagtacgccgagggcgtgagcgagagagacatcctgctgatccacagctgcagacagtggaccaccgtgaccgcccacaccctggaggagggccactacgtgatcggccccaagatcgacatccccctgcagtaccccggcaagttcaagctgctggagcaggccagagacgtgagagagcccgtgagatacttcagcagcgtggaggaggtggccagcgtgttccccgacagaatcttcgtgatggaggccatcaccttcagcgtgaaggtggtgagcggcgagttcagcgaggacagcgaggtgtacaacttcaccctgcacgccggcgacgagctgaccctgatgggccaggccgagatcctgtgcgccaagaccaccaaggagagaagcagattcaccaccctgctgagaaagctgggcagagccggcgccctggccggcgtgggcggcggcggccccgccagcgccggcgccgccggcggcaccggcggcggcggcgccagacccgtgaagggcaagatgccctgcctgatctgcatgaaccacagaaccaacgagagcctgagcctgcccttccagtgccagggcagattcagcaccagaagccccctggagctgcagatgcaggagggcgagcacaccgtgagagccatcatcgagagagtgagactgcccgtgaacgtgctggtgcccagcagaccccccagaaacccctacgacctgcaccccgtgagagagggccactgctacaagctggtgagcatcatcagcaagaccgtggtgctgggcctggccctgagaagagagggccccgcccccctgcacttcctgctgctgaccgacacccccagattcgccctgccccagggcctgctggccggcgaccccagagtggagagactggtgagagacagcgccagctactgcagagagagattcgaccccgacgagtacagcaccgccgtgagagaggcccccgccgagctggccgaggactgcgccagccccagaagagccagactgtgcctgcccgcccccagagcccccggcctggccagagcccccggccccctggcccccgcccccgccggcgagggcgaccaggagtacgtgagccccgactgggccgccgcccccgagcccgccgccccccccgccgagatcccctacgaggagctgtgggcccaccagggccccgagggcctggtgagacccccccccggcctggacctgatcagcttcggcgccgccggcccccccagaagagagcccgaggccccccccccccccgtgccccccaagagcgaggccgtgaaggaggagtgcagactgctgaacgccccccccgtgccccccagaggcggcaacggcagcggcagactgagcagcagcccccccgtgccccccagattccccaagctgcagcccgtgcacagccccagcagcagcctgagctactacagcagcggcctgcaggacggcgccggcagcagaagcggcagcggcagccccagccccgacacctacagcctgtactgctacccctgcacctggggcgactgcaaggtgggcgagagcagcagcagacccgcccccggccccctgcccagcaccacccagcccagccaggccagcagagccctgaccgagcccctgagcggcagagccgccagcctgctgggcgccgacacccccgtgaagacctaccacagctgcccccccctgttcaagcccagccacccccagaagagattcgcccccttcggcgccctgaaccccttcagcggccccgcctaccccagcggccccagcgccgccctgagcagcggccccagaaccaccagcggccccgtggccaccagcggccccgcctacagccccggccccgccagccccggccaggcctacagcgccgccccccccagcagctgcgcccccagcagcagcagcagcagcgagtggcaggagcccgtgctggagcccttcgaccccttcgagctgggccagggcagcagccccgagcccgagctgctgagaagccaggagcccagagccgtgggcacccccggccccggccccagactgagccccctgggccccagcaaggccttcgagcccgagggcctggtgctgcaccaggtgcccacccccctgagccccgccgccctgcagggccccgaggccggcggcgccctgttcctgacccagggcagactggagggcccccccgccagccccagagacggcgccaccggcttcggcgtgagagacgccagcagctggcagccccccgccgacctgagcgccctgagcctggaggaggtgagcagaagcctgagattcatcggcctgagcgaggacgtggtgagcttcttcgccagagagagaatcgacggcagcatcttcgtgcagctgagcgaggacatcctggccgacgacttccacctgaccaagctgcaggtgaagaagatcatgcagttcatcaagggctggagacccaagatctag

SEQ ID NO: 21213 - DNA, 666 bp, Artificial Sequence
  Description of Artificial Sequence: Synthetic coding sequence
atgttcggcttccacaagcccaagatgtacagaagcatcgagggctgctgcatctgcagagccaagagcagcagcagcagattcaccgacagcaagagatacgagaaggacttccagagctgcttcggcctgcacgagaccagaagcggcgacatctgcaacgcctgcgtgctgctggtgaagagatggaagaagctgcccgccggcagcaagaagaactggaaccacgtggtggacgccagagccggccccagcctgaagaccaccctgaagcccaagaaggtgaagaccctgagcggcaacagaatcaagagcaaccagatcagcaagctgcagaaggagttcaagagacacaacagcgacgcccacagcaccaccagcagcgccagccccgcccagagcccctgctacagcaaccagagcgacgacggcagcgacaccgagatggccagcggcagcaacagaacccccgtgttcagcttcctggacctgacctactggaagagacagaagatctgctgcggcatcatctacaagggcagattcggcgaggtgctgatcgacacccacctgttcaagccctgctgcagcaacaagaaggccgccgccgagaagcccgaggagcagggccccgagcccctgcccatcagcacccaggagtggtag

SEQ ID NO: 21214 - DNA, 222 bp, Artificial Sequence
  Description of Artificial Sequence: Synthetic coding sequence
atggccagcggcagcaacagaacccccgtgttcagcttcctggacctgacctactggaagagacagaagatctgctgcggcatcatctacaagggcagattcggcgaggtgctgatcgacacccacctgttcaagccctgctgcagcaacaagaaggccgccgccgagaagcccgaggagcagggccccgagcccctgcccatcagcacccaggagtggtag

SEQ ID NO: 21215 - DNA, 789 bp, Artificial Sequence
  Description of Artificial Sequence: Synthetic coding sequence
atgagctacctgcccaccaacccccccggcagcatcctggccggcagcgccagcctgagcgccgtgaccggcgtgcccgagggcgaggccagattcaccgaggactactgccccgaggagaagatgttcggcttccacaagcccaagatgtacagaagcatcgagggctgctgcatctgcagagccaagagcagcagcagcagattcaccgacagcaagagatacgagaaggacttccagagctgcttcggcctgcacgagaccagaagcggcgacatctgcaacgcctgcgtgctgctggtgaagagatggaagaagctgcccgccggcagcaagaagaactggaaccacgtggtggacgccagagccggccccagcctgaagaccaccctgaagcccaagaaggtgaagaccctgagcggcaacagaatcaagagcaaccagatcagcaagctgcagaaggagttcaagagacacaacagcgacgcccacagcaccaccagcagcgccagccccgcccagagcccctgctacagcaaccagagcgacgacggcagcgacaccgagatggccagcggcagcaacagaacccccgtgttcagcttcctggacctgacctactggaagagacagaagatctgctgcggcatcatctacaagggcagattcggcgaggtgctgatcgacacccacctgttcaagccctgctgcagcaacaagaaggccgccgccgagaagcccgaggagcagggccccgagcccctgcccatcagcacccaggagtggtag

SEQ ID NO: 21216 - DNA, 666 bp, Artificial Sequence; identical to SEQ ID NO: 21213
  Description of Artificial Sequence: Synthetic coding sequence

SEQ ID NO: 21217 - DNA, 405 bp, Artificial Sequence
  Description of Artificial Sequence: Synthetic coding sequence
atgttcggcttccacaagcccaagatgtacagaagcatcgagggctgctgcatctgcagagccaagagcagcagcagcagattcaccgacagcaagagatacgagaaggacttccagagctgcttcggcctgcacgagaccagaagcggcgacatctgcaacgcctgcgtgctgctggtgaagagatggaagaagctgcccgccggcagcaagaagaactggaaccacgtggtggacgccagagccggccccagcctgaagaccaccctgaagcccaagaaggtgaagaccctgagcggcaacagaatcaagagcaaccagatcagcaagctgcagaaggagttcaagagacacaacagcgacgcccacagcaccaccagcagcgccagccccgcccagagctag

SEQ ID NO: 21218 - DNA, 384 bp, Artificial Sequence
  Description of Artificial Sequence: Synthetic coding sequence
atgttcggcttccacaagcccaagatgtacagaagcatcgagggctgctgcatctgcagagccaagagcagcagcagcagattcaccgacagcaagagatacgagaaggacttccagagctgcttcggcctgcacgagaccagaagcggcgacatctgcaacgcctgcgtgctgctggtgaagagatggaagaagctgcccgccggcagcaagaagaactggaaccacgtggtggacgccagagccggccccagcctgaagaccaccctgaagcccaagaaggtgaagaccctgagcggcaacagaatcaagagcaaccagatcagcaagctgcagaaggagttcaagagacacaacagcgacgcccacagcaccaccagctag

SEQ ID NO: 21219 - DNA, 984 bp, Artificial Sequence
  Description of Artificial Sequence: Synthetic coding sequence
atgaacatcctgttcctgcagtggaaggtgaagctgcccccccagaaggaggtgatcaccagcgacgagctgatggcccacctgggcaactgcctgctgagcatcaagccccaggagaagagcgagggcctgcagctgaacttccagcagaacgtggacgacgccatgaccgtgctgcccaagctggccaccggcctggacgtgaacgtgagattcaccggcgtgagcgacttcgagtacacccccgagtgcagcgtgttcgacctgctgggcatccccctgtaccacggctggctggtggacccccagagccccgaggccgtgagagccgtgggcaagctgagctacaaccagctggtggagagaatcatcacctgcaagcacagcagcgacaccaacctggtgaccgagggcctgatcgccgagcagttcctggagaccaccgccgcccagctgacctaccacggcctgtgcgagctgaccgccgccgccaaggagggcgagctgagcgtgttcttcagaaacaaccacttcagcaccatgaccaagcacaagagccacctgtacctgctggtgaccgaccagggcttcctgcaggaggagcaggtggtgtgggagagcctgcacaacgtggacggcgacagctgcttctgcgacagcgacttccacctgagccacagcctgggcaagggccccggcgccgagggcggcagcggcagccccgagacccagctgcaggtggaccaggactacctgatcgccctgagcctgcagcagcagcagcccagaggccccctgggcctgaccgacctggagctggcccagcagctgcagcaggaggagtaccagcagcagcaggccgcccagcccgtgagaatgagaaccagagtgctgagcctgcagggcagaggcgccaccagcggcagacccgccggcgagagaagacagagacccaagcacgagagcgactgcatcctgctgtag

SEQ ID NO: 21220 - DNA, 1554 bp, Artificial Sequence
  Description of Artificial Sequence: Synthetic coding sequence
atgctgctgggccccccccccttcaacgagagcaccaagcccagccccagcccctgccacagcttcgccagccaggcctggctgagacaggtgcccgaggtgagcaagcacctgcagtgccccagcgccaagagcctgctgaccatggagtaccaccagcccgaggaccccgcccccggcaaggccggcaccgccgaggccgtgatccccgagaaccacgaggtgctggccggccccgacgagcacccccaggacaccgacgccagagacgccgacggcgaggccagagagagagagcccgccgaccaggccctgctgcccagccagtgcggcgacaacctggagagccccctgcccgaggccagcagcgccccccccggccccaccctgggcaccctgcccgaggtggagaccatcagagcctgcagcatgccccaggagctgccccagagccccagaaccagacagcccgagcccgacttctactgcgtgaagtggatcccctggaagggcgagcagacccccatcatcacccagagcaccaacggcccctgccccctgctggccatcatgaacatcctgttcctgcagtggaaggtgaagctgcccccccagaaggaggtgatcaccagcgacgagctgatggcccacctgggcaactgcctgctgagcatcaagccccaggagaagagcgagggcctgcagctgaacttccagcagaacgtggacgacgccatgaccgtgctgcccaagctggccaccggcctggacgtgaacgtgagattcaccggcgtgagcgacttcgagtacacccccgagtgcagcgtgttcgacctgctgggcatccccctgtaccacggctggctggtggacccccagagccccgaggccgtgagagccgtgggcaagctgagctacaaccagctggtggagagaatcatcacctgcaagcacagcagcgacaccaacctggtgaccgagggcctgatcgccgagcagttcctggagaccaccgccgcccagctgacctaccacggcctgtgcgagctgaccgccgccgccaaggagggcgagctgagcgtgttcttcagaaacaaccacttcagcaccatgaccaagcacaagagccacctgtacctgctggtgaccgaccagggcttcctgcaggaggagcaggtggtgtgggagagcctgcacaacgtggacggcgacagctgcttctgcgacagcgacttccacctgagccacagcctgggcaagggccccggcgccgagggcggcagcggcagccccgagacccagctgcaggtggaccaggactacctgatcgccctgagcctgcagcagcagcagcccagaggccccctgggcctgaccgacctggagctggcccagcagctgcagcaggaggagtaccagcagcagcaggccgcccagcccgtgagaatgagaaccagagtgctgagcctgcagggcagaggcgccaccagcggcagacccgccggcgagagaagacagagacccaagcacgagagcgactgcatcctgctgtag

SEQ ID NO: 21221 - DNA, 1410 bp, Artificial Sequence
  Description of Artificial Sequence: Synthetic coding sequence
atggagtaccaccagcccgaggaccccgcccccggcaaggccggcaccgccgaggccgtgatccccgagaaccacgaggtgctggccggccccgacgagcacccccaggacaccgacgccagagacgccgacggcgaggccagagagagagagcccgccgaccaggccctgctgcccagccagtgcggcgacaacctggagagccccctgcccgaggccagcagcgccccccccggccccaccctgggcaccctgcccgaggtggagaccatcagagcctgcagcatgccccaggagctgccccagagccccagaaccagacagcccgagcccgacttctactgcgtgaagtggatcccctggaagggcgagcagacccccatcatcacccagagcaccaacggcccctgccccctgctggccatcatgaacatcctgttcctgcagtggaaggtgaagctgcccccccagaaggaggtgatcaccagcgacgagctgatggcccacctgggcaactgcctgctgagcatcaagccccaggagaagagcgagggcctgcagctgaacttccagcagaacgtggacgacgccatgaccgtgctgcccaagctggccaccggcctggacgtgaacgtgagattcaccggcgtgagcgacttcgagtacacccccgagtgcagcgtgttcgacctgctgggcatccccctgtaccacggctggctggtggacccccagagccccgaggccgtgagagccgtgggcaagctgagctacaaccagctggtggagagaatcatcacctgcaagcacagcagcgacaccaacctggtgaccgagggcctgatcgccgagcagttcctggagaccaccgccgcccagctgacctaccacggcctgtgcgagctgaccgccgccgccaaggagggcgagctgagcgtgttcttcagaaacaaccacttcagcaccatgaccaagcacaagagccacctgtacctgctggtgaccgaccagggcttcctgcaggaggagcaggtggtgtgggagagcctgcacaacgtggacggcgacagctgcttctgcgacagcgacttccacctgagccacagcctgggcaagggccccggcgccgagggcggcagcggcagccccgagacccagctgcaggtggaccaggactacctgatcgccctgagcctgcagcagcagcagcccagaggccccctgggcctgaccgacctggagctggcccagcagctgcagcaggaggagtaccagcagcagcaggccgcccagcccgtgagaatgagaaccagagtgctgagcctgcagggcagaggcgccaccagcggcagacccgccggcgagagaagacagagacccaagcacgagagcgactgcatcctgctgtag

SEQ ID NO: 21222 - DNA, 1125 bp, Artificial Sequence
  Description of Artificial Sequence: Synthetic coding sequence
atgccccaggagctgccccagagccccagaaccagacagcccgagcccgacttctactgcgtgaagtggatcccctggaagggcgagcagacccccatcatcacccagagcaccaacggcccctgccccctgctggccatcatgaacatcctgttcctgcagtggaaggtgaagctgcccccccagaaggaggtgatcaccagcgacgagctgatggcccacctgggcaactgcctgctgagcatcaagccccaggagaagagcgagggcctgcagctgaacttccagcagaacgtggacgacgccatgaccgtgctgcccaagctggccaccggcctggacgtgaacgtgagattcaccggcgtgagcgacttcgagtacacccccgagtgcagcgtgttcgacctgctgggcatccccctgtaccacggctggctggtggacccccagagccccgaggccgtgagagccgtgggcaagctgagctacaaccagctggtggagagaatcatcacctgcaagcacagcagcgacaccaacctggtgaccgagggcctgatcgccgagcagttcctggagaccaccgccgcccagctgacctaccacggcctgtgcgagctgaccgccgccgccaaggagggcgagctgagcgtgttcttcagaaacaaccacttcagcaccatgaccaagcacaagagccacctgtacctgctggtgaccgaccagggcttcctgcaggaggagcaggtggtgtgggagagcctgcacaacgtggacggcgacagctgcttctgcgacagcgacttccacctgagccacagcctgggcaagggccccggcgccgagggcggcagcggcagccccgagacccagctgcaggtggaccaggactacctgatcgccctgagcctgcagcagcagcagcccagaggccccctgggcctgaccgacctggagctggcccagcagctgcagcaggaggagtaccagcagcagcaggccgcccagcccgtgagaatgagaaccagagtgctgagcctgcagggcagaggcgccaccagcggcagacccgccggcgagagaagacagagacccaagcacgagagcgactgcatcctgctgtag

SEQ ID NO: 21223 - DNA, 1863 bp, Artificial Sequence
  Description of Artificial Sequence: Synthetic coding sequence
atggagagcagccccgagagcctgcagcccctggagcacggcgtggccgccggccccgccagcggcaccggcagcagccaggagggcctgcaggagaccagactggccgccggcgacggccccggcgtgtgggccgccgagaccagcggcggcaacggcctgggcgccgccgccgccagaagaagcctgcccgacagcgccagccccgccggcagccccgaggtgcccggcccctgcagcagcagcgccggcctggacctgaaggacagcggcctggagagccccgccgccgccgaggcccccctgagaggccagtacaaggtgaccgccagccccgagaccgccgtggccggcgtgggccacgagctgggcaccgccggcgacgccggcgccagacccgacctggccggcacctgccaggccgagctgaccgccgccggcagcgaggagcccagcagcgccggcggcctgagcagcagctgcagcgaccccagcccccccggcgagagccccagcctggacagcctggagagcttcagcaacctgcacagcttccccagcagctgcgagttcaacagcgaggagggcgccgagaacagagtgcccgaggaggaggagggcgccgccgtgctgcccggcgccgtgcccctgtgcaaggaggaggagggcgaggagaccgcccaggtgctggccgccagcaaggagagattccccggccagagcgtgtaccacatcaagtggatccagtggaaggaggagaacacccccatcatcacccagaacgagaacggcccctgccccctgctggccatcctgaacgtgctgctgctggcctggaaggtgaagctgccccccatgatggagatcatcaccgccgagcagctgatggagtacctgggcgactacatgctggacgccaagcccaaggagatcagcgagatccagagactgaactacgagcagaacatgagcgacgccatggccatcctgcacaagctgcagaccggcctggacgtgaacgtgagattcaccggcgtgagagtgttcgagtacacccccgagtgcatcgtgttcgacctgctggacatccccctgtaccacggctggctggtggacccccagatcgacgacatcgtgaaggccgtgggcaactgcagctacaaccagctggtggagaagatcatcagctgcaagcagagcgacaacagcgagctggtgagcgagggcttcgtggccgagcagttcctgaacaacaccgccacccagctgacctaccacggcctgtgcgagctgaccagcaccgtgcaggagggcgagctgtgcgtgttcttcagaaacaaccacttcagcaccatgaccaagtacaagggccagctgtacctgctggtgaccgaccagggcttcctgaccgaggagaaggtggtgtgggagagcctgcacaacgtggacggcgacggcaacttctgcgacagcgagttccacctgagaccccccagcgaccccgagaccgtgtacaagggccagcaggaccagatcgaccaggactacctgatggccctgagcctgcagcaggagcagcagagccaggagatcaactgggagcagatccccgagggcatcagcgacctggagctggccaagaagctgcaggaggaggaggacagaagagccagccagtactaccaggagcaggagcaggccgccgccgccgccgccgccgccagcacccaggcccagggccagcccgcccaggccagccccagcagcggcagacagagcggcaacagcgagagaaagagaaaggagcccagagagaaggacaaggagaaggagaaggagaagaacagctgcgtgatcctgtag

SEQ ID NO: 21224 - DNA, 1866 bp, Artificial Sequence
  Description of Artificial Sequence: Synthetic coding sequence
atggagagcagccccgagagcctgcagcccctggagcacggcgtggccgccggccccgccagcggcaccggcagcagccaggagggcctgcaggagaccagactggccgccggcgacggccccggcgtgtgggccgccgagaccagcggcggcaacggcctgggcgccgccgccgccagaagaagcctgcccgacagcgccagccccgccggcagccccgaggtgcccggcccctgcagcagcagcgccggcctggacctgaaggacagcggcctggagagccccgccgccgccgaggcccccctgagaggccagtacaaggtgaccgccagccccgagaccgccgtggccggcgtgggccacgagctgggcaccgccggcgacgccggcgccagacccgacctggccggcacctgccaggccgagctgaccgccgccggcagcgaggagcccagcagcgccggcggcctgagcagcagctgcagcgaccccagcccccccggcgagagccccagcctggacagcctggagagcttcagcaacctgcacagcttccccagcagctgcgagttcaacagcgaggagggcgccgagaacagagtgcccgaggaggaggagggcgccgccgtgctgcccggcgccgtgcccctgtgcaaggaggaggagggcgaggagaccgcccaggtgctggccgccagcaaggagagattccccggccagagcgtgtaccacatcaagtggatccagtggaaggaggagaacacccccatcatcacccagaacgagaacggcccctgccccctgctggccatcctgaacgtgctgctgctggcctggaaggtgaagctgccccccatgatggagatcatcaccgccgagcagctgatggagtacctgggcgactacatgctggacgccaagcccaaggagatcagcgagatccagagactgaactacgagcagaacatgagcgacgccatggccatcctgcacaagctgcagaccggcctggacgtgaacgtgagattcaccggcgtgagagtgttcgagtacacccccgagtgcatcgtgttcgacctgctggacatccccctgtaccacggctggctggtggacccccagatcgacgacatcgtgaaggccgtgggcaactgcagctacaaccagctggtggagaagatcatcagctgcaagcagagcgacaacagcgagctggtgagcgagggcttcgtggccgagcagttcctgaacaacaccgccacccagctgacctaccacggcctgtgcgagctgaccagcaccgtgcaggagggcgagctgtgcgtgttcttcagaaacaaccacttcagcaccatgaccaagtacaagggccagctgtacctgctggtgaccgaccagggcttcctgaccgaggagaaggtggtgtgggagagcctgcacaacgtggacggcgacggcaacttctgcgacagcgagttccacctgagaccccccagcgaccccgagaccgtgtacaagggccagcaggaccagatcgaccaggactacctgatggccctgagcctgcagcaggagcagcagagccaggagatcaactgggagcagatccccgagggcatcagcgacctggagctggccaagaagctgcaggaggaggaggacagaagagccagccagtactaccaggagcaggagcaggccgccgccgccgccgccgccgccagcacccaggcccagcagggccagcccgcccaggccagccccagcagcggcagacagagcggcaacagcgagagaaagagaaaggagcccagagagaaggacaaggagaaggagaaggagaagaacagctgcgtgatcctgtag

SEQ ID NO: 21225 - DNA, 2841 bp, Artificial Sequence
  Description of Artificial Sequence: Synthetic coding sequence
atgagcgtgagactgagattcctgagccccggcgacaccggcgccgtgggcgtggtgggcagaagcgccagcttcgccggcttcagcagcgcccagagcagaagaatcgccaagagcatcaacagaaacagcgtgagaagcagaatgcccgccaagagcagcaagatgtacggcaccctgagaaagggcagcgtgtgcgccgaccccaagccccagcaggtgaagaagatcttcgaggccctgaagagaggcctgaaggagtacctgtgcgtgcagcaggccgagctggaccacctgagcggcagacacaaggacaccagaagaaacagcagactggccttctactacgacctggacaagcagaccagatgcgtggagagacacatcagaaagatggagttccacatcagcaaggtggacgagctgtacgaggactactgcatccagtgcagactgagagacggcgccagcagcatgcagagagccttcgccagatgcccccccagcagagccgccagagagagcctgcaggagctgggcagaagcctgcacgagtgcgccgaggacatgtggctgatcgagggcgccctggaggtgcacctgggcgagttccacatcagaatgaagggcctggtgggctacgccagactgtgccccggcgaccactacgaggtgctgatgagactgggcagacagagatggaagctgaagggcagaatcgagagcgacgacagccagacctgggacgaggaggagaaggccttcatccccaccctgcacgagaacctggacatcaaggtgaccgagctgagaggcctgggcagcctggccgtgggcgccgtgacctgcgacatcgccgacttcttcaccaccagaccccaggtgatcgtggtggacatcaccgagctgggcaccatcaagctgcagctggaggtgcagtggaaccccttcgacaccgagagcttcctggtgagccccagccccaccggcaagttcagcatgggcagcagaaagggcagcctgtacaactggaccccccccagcacccccagcttcagagagagatactacctgagcgtgctgcagcagcccacccagcaggccctgctgctgggcggccccagagccaccagcatcctgagctacctgagcgacagcgacctgagaggccccagcctgagaagccagagccaggagctgcccgagatggacagcttcagcagcgaggaccccagagacaccgagaccagcaccagcgccagcaccagcgacgtgggcttcctgcccctgaccttcggcccccacgccagcatcgaggaggaggccagagaggaccccctgccccccggcctgctgcccgagatggcccacctgagcggcggccccttcgccgagcagcccggctggagaaacctgggcggcgagagccccagcctgccccagggcagcctgttccacagcggcaccgccagcagcagccagaacggccacgaggagggcgccaccggcgacagagaggacggccccggcgtggccctggagggccccctgcaggaggtgctggagctgctgagacccaccgacagcacccagccccagctgagagagctggagtaccaggtgctgggcttcagagacagactgaagccctgcagagccagacaggagcacaccagcgccgagagcctgatggagtgcatcctggagagcttcgccttcctgaacgccgacttcgccctggacgagctgagcctgttcggcggcagccagggcctgagaaaggacagacccctgcccccccccagcagcctgaaggccagcagcagagagctgaccgccggcgcccccgagctggacgtgctgctgatggtgcacctgcaggtgtgcaaggccctgctgcagaagctggccagccccaacctgagcagactggtgcaggagtgcctgctggaggaggtggcccagcagaagcacgtgctggagaccctgagcgtgctggacttcgagaaggtgggcaaggccaccagcatcgaggagatcatcccccaggccagcagaaccaagggctgcctgaagctgtggagaggctgcaccggccccggcagagtgctgagctgccccgccaccaccctgctgaaccagctgaagaagaccttccagcacagagtgagaggcaagtaccccggccagctggagatcgcctgcagaagactgctggagcaggtggtgagctgcggcggcctgctgcccggcgccggcctgcccgaggagcagatcatcacctggttccagttccacagctacctgcagagacagagcgtgagcgacctggagaagcacttcacccagctgaccaaggaggtgaccctgatcgaggagctgcactgcgccggccaggccaaggtggtgagaaagctgcagggcaagagactgggccagctgcagcccctgccccagaccctgagagcctgggccctgctgcagctggacggcacccccagagtgtgcagagccgccagcgccagactggccggcgccgtgagaaacagaagcttcagagagaaggccctgctgttctacaccaacgccctggccgagaacgacgccagactgcagcaggccgcctgcctggccctgaagcacctgaagggcatcgagagcatcgaccagaccgccagcctgtgccagagcgacctggaggccgtgagagccgccgccagagagaccaccctgagcttcggcgagaagggcagactggccttcgagaagatggacaagctgtgcagcgagcagagagaggtgttctgccaggaggccgacgtggagatcaccatcttctag

SEQ ID NO: 21226 - DNA, 2841 bp, Artificial Sequence; identical to SEQ ID NO: 21225
  Description of Artificial Sequence: Synthetic coding sequence

SEQ ID NO: 21227 - DNA, 2853 bp, Artificial Sequence
  Description of Artificial Sequence: Synthetic coding sequence
atggtgaccaccatgagcgtgagactgagattcctgagccccggcgacaccggcgccgtgggcgtggtgggcagaagcgccagcttcgccggcttcagcagcgcccagagcagaagaatcgccaagagcatcaacagaaacagcgtgagaagcagaatgcccgccaagagcagcaagatgtacggcaccctgagaaagggcagcgtgtgcgccgaccccaagccccagcaggtgaagaagatcttcgaggccctgaagagaggcctgaaggagtacctgtgcgtgcagcaggccgagctggaccacctgagcggcagacacaaggacaccagaagaaacagcagactggccttctactacgacctggacaagcagaccagatgcgtggagagacacatcagaaagatggagttccacatcagcaaggtggacgagctgtacgaggactactgcatccagtgcagactgagagacggcgccagcagcatgcagagagccttcgccagatgcccccccagcagagccgccagagagagcctgcaggagctgggcagaagcctgcacgagtgcgccgaggacatgtggctgatcgagggcgccctggaggtgcacctgggcgagttccacatcagaatgaagggcctggtgggctacgccagactgtgccccggcgaccactacgaggtgctgatgagactgggcagacagagatggaagctgaagggcagaatcgagagcgacgacagccagacctgggacgaggaggagaaggccttcatccccaccctgcacgagaacctggacatcaaggtgaccgagctgagaggcctgggcagcctggccgtgggcgccgtgacctgcgacatcgccgacttcttcaccaccagaccccaggtgatcgtggtggacatcaccgagctgggcaccatcaagctgcagctggaggtgcagtggaaccccttcgacaccgagagcttcctggtgagccccagccccaccggcaagttcagcatgggcagcagaaagggcagcctgtacaactggaccccccccagcacccccagcttcagagagagatactacctgagcgtgctgcagcagcccacccagcaggccctgctgctgggcggccccagagccaccagcatcctgagctacctgagcgacagcgacctgagaggccccagcctgagaagccagagccaggagctgcccgagatggacagcttcagcagcgaggaccccagagacaccgagaccagcaccagcgccagcaccagcgacgtgggcttcctgcccctgaccttcggcccccacgccagcatcgaggaggaggccagagaggaccccctgccccccggcctgctgcccgagatggcccacctgagcggcggccccttcgccgagcagcccggctggagaaacctgggcggcgagagccccagcctgccccagggcagcctgttccacagcggcaccgccagcagcagccagaacggccacgaggagggcgccaccggcgacagagaggacggccccggcgtggccctggagggccccctgcaggaggtgctggagctgctgagacccaccgacagcacccagccccagctgagagagctggagtaccaggtgctgggcttcagagacagactgaagccctgcagagccagacaggagcacaccagcgccgagagcctgatggagtgcatcctggagagcttcgccttcctgaacgccgacttcgccctggacgagctgagcctgttcggcggcagccagggcctgagaaaggacagacccctgcccccccccagcagcctgaaggccagcagcagagagctgaccgccggcgcccccgagctggacgtgctgctgatggtgcacctgcaggtgtgcaaggccctgctgcagaagctggccagccccaacctgagcagactggtgcaggagtgcctgctggaggaggtggcccagcagaagcacgtgctggagaccctgagcgtgctggacttcgagaaggtgggcaaggccaccagcatcgaggagatcatcccccaggccagcagaaccaagggctgcctgaagctgtggagaggctgcaccggccccggcagagtgctgagctgccccgccaccaccctgctgaaccagctgaagaagaccttccagcacagagtgagaggcaagtaccccggccagctggagatcgcctgcagaagactgctggagcaggtggtgagctgcggcggcctgctgcccggcgccggcctgcccgaggagcagatcatcacctggttccagttccacagctacctgcagagacagagcgtgagcgacctggagaagcacttcacccagctgaccaaggaggtgaccctgatcgaggagctgcactgcgccggccaggccaaggtggtgagaaagctgcagggcaagagactgggccagctgcagcccctgccccagaccctgagagcctgggccctgctgcagctggacggcacccccagagtgtgcagagccgccagcgccagactggccggcgccgtgagaaacagaagcttcagagagaaggccctgctgttctacaccaacgccctggccgagaacgacgccagactgcagcaggccgcctgcctggccctgaagcacctgaagggcatcgagagcatcgaccagaccgccagcctgtgccagagcgacctggaggccgtgagagccgccgccagagagaccaccctgagcttcggcgagaagggcagactggccttcgagaagatggacaagctgtgcagcgagcagagagaggtgttctgccaggaggccgacgtggagatcaccatcttctag

SEQ ID NO: 21228 - DNA, 1269 bp, Artificial Sequence
  Description of Artificial Sequence: Synthetic coding sequence
atgaagaagaacaccagcaagaccaccatgagaatcaacaagcaggacgccctgtgcaccccccacagccacgaccccagagacctgcagaacatgctggacggcggcgagtacgcccccttcgtgagcccccccatgctggagagcaacttcatccaggtgaacagaagaggcgagagcatctacctgcacaacagagccaactgggtgaccgtgggcatctgcttcagcagcagcacccacaagatccccaacgtgatgctgctggcccacctgacccccggcgcccagaaggacaccgagaccctgttcaagagcctgctgaccagcccccccgccgagaagctggtgctgaccagattcctgcccctgcagttcgtgaccctgagcgtgcacgacgccgagaacatgagcctgaaggtgaagctggtgagcggcagagcctactacctgcagctgtgcaccagcgcctacaagcaggacaccctgttcagccagtgggtggccctgatcagcctgctgaaccaggagaaggccaaggtgagcaaggtgagcgaggtgagcagcctgagcggcatcaccaacagcaccgacatcaccggcagcatggacgtgaccgacgtgaccaccttcaccgccatcctgaccccctacatgtacgccggcaccggccccgagcacgtgagagacagcatcgacttccccgagttcaccgacatcaccgacatcaccgacgtgaccgacctgcccgagaacgaggtgcccgaggtgcccgacgtgagaatcgtgaccgaggtgatcgaggtgagagaggccaccgaggtgaccgacagcagcgacatcaccaactgcagcggcgtgaccgtggtgttcgagaacaacgacctgatcagagccaagcaggaggagaaggagaagctgaagaacatcctgaagcccggctgcctgcaggacaccaagagcaagagcgagctgaaggagagcagcaagcacgtgaccatcagcaacatcaccctgaccttcgagggcaagagatacttccagaccaccctgacccccgtggagagcgaggccaacaccagcaaggagatgaaggacaagaccagcgaggagaagatgcccgacttccagagcaccgccctgaaggccgaggagagcagaagcctgagaaccgagagcaacaccagcgtgctgagcccccacatcaagagccccagcaacttcctgaagctggtgccccacctgagcgcccccttcagcagagagtag

SEQ ID NO: 21229 - DNA, 1785 bp, Artificial Sequence
  Description of Artificial Sequence: Synthetic coding sequence
atgaacgccgacttcctgctgccctactacaccgcccagagcggcagcagcatgagcatgttcaacaccaccatgggcaagctgcagagacagctgtacaagggcgagtacgacatcttcaagtacgcccccatcttcgagagcgacttcatccagatcaccaagagaggcgaggtgatcgacgtgcacaacagagtgagaatggtgaccatgggcatcgccagaaccagccccatcctgcccctgcccgacgtgatgctgctggccagacccgccaccggctgcgaggagtacgccggccacggccaggccaccaagagaaagaagagaaaggccgccaagaacctggagctgaccagactgctgcccctgagattcgtgagaatcagcgtgcaggaccacgagaagcagcagctgagactgaagttcgccaccggcagaagctgctacctgcagctgtgccccgccctggacaccagagacgacctgttcgcctactgggagaagctgatctacctgctgagaccccccatggagagcaacagcagcacctgcggcatccccgccgaggacatgatgtggatgcccgtgttccaggaggacagaagaagcctgggcgccgtgaacctgcagggcaagggcgaccaggaccaggtgagcatccagagcctgcacatggtgagcgaggtgtgcggcgccaccagcgccgcctacgccggcggcgagggcctgcagaacgacttcaacaagcccaccaacgtgctgaacgccagcatccccaagaccagcaccgagctggccgaggagcccgccaccggcggcatcaaggaggccgccgccgccggcgccgccgccggcgccgccaccggcaccgtggccggcgccctgagcgtggccgccgccaacagcgcccccggccaggtgagcgccgccatcgccggcgccgccaccatcggcgccggcggcaacaagggcaacatggccctggccggcaccgccagcatggcccccaacagcaccaaggtggccgtggccggcgccgccggcaagagcagcgagcacgtgagcagcgccagcatgagcctgagcagagagggcagcgtgagcctggccatcgccggcgtggtgctgaccagcagaaccgccgccgaggccgacatggacgccgccgccggcccccccgtgagcaccagacagagcaagagcagcctgagcggccagcacggcagagagagaacccaggccagcgccgagggctgcaaggagggcagagagagaagagagaaggacagagccctgggcagaagcagccacagaagaagaaccggcgagagcagacacaagaccagaggcgacaagatcgcccagaagagcagcagcagaagcagcttcagccacagagccaacagagacgacaagaaggagaagggctgcggcaaccccggcagcagcagacacagagacagccacaagggcgtgagccacacccccatcagcaaggagagcagaaccagccacaagagcggcagaagcctgtggaccaccagcagcggcagcagcaagggcctgggcagagtgagcagcttcctgagaaacgtgagagccaacctgaccaccaaggtggtgggcaccccccacggcagagacgtgaacgtgatggccaagatggccgagagaagcaccaacgtggccatcgccgagaccgccgagggcggccagggcctggagaccgtgggcagcatgacccccgacatcatggagaccgtgaccttcgaggcccactag

SEQ ID NO: 21230 - DNA, 1110 bp, Artificial Sequence
  Description of Artificial Sequence: Synthetic coding sequence
atggtgagcgaggtgtgcggcgccaccagcgccgcctacgccggcggcgagggcctgcagaacgacttcaacaagcccaccaacgtgctgaacgccagcatccccaagaccagcaccgagctggccgaggagcccgccaccggcggcatcaaggaggccgccgccgccggcgccgccgccggcgccgccaccggcaccgtggccggcgccctgagcgtggccgccgccaacagcgcccccggccaggtgagcgccgccatcgccggcgccgccaccatcggcgccggcggcaacaagggcaacatggccctggccggcaccgccagcatggcccccaacagcaccaaggtggccgtggccggcgccgccggcaagagcagcgagcacgtgagcagcgccagcatgagcctgagcagagagggcagcgtgagcctggccatcgccggcgtggtgctgaccagcagaaccgccgccgaggccgacatggacgccgccgccggcccccccgtgagcaccagacagagcaagagcagcctgagcggccagcacggcagagagagaacccaggccagcgccgagggctgcaaggagggcagagagagaagagagaaggacagagccctgggcagaagcagccacagaagaagaaccggcgagagcagacacaagaccagaggcgacaagatcgcccagaagagcagcagcagaagcagcttcagccacagagccaacagagacgacaagaaggagaagggctgcggcaaccccggcagcagcagacacagagacagccacaagggcgtgagccacacccccatcagcaaggagagcagaaccagccacaagagcggcagaagcctgtggaccaccagcagcggcagcagcaagggcctgggcagagtgagcagcttcctgagaaacgtgagagccaacctgaccaccaaggtggtgggcaccccccacggcagagacgtgaacgtgatggccaagatggccgagagaagcaccaacgtggccatcgccgagaccgccgagggcggccagggcctggagaccgtgggcagcatgacccccgacatcatggagaccgtgaccttcgaggcccactag

SEQ ID NO: 21231 - DNA, 726 bp, Artificial Sequence
  Description of Artificial Sequence: Synthetic coding sequence
atggaggactgctgcatgctgccctactacaccgcccagagcagccccgccatgggcatgttcaacaccagcatgggcaagctgcagagacagctgtacaagggcgagtacaccatcttcagatacgcccccatgttcgagagcgacttcatccagatcagcaagagaggcgaggtgatcgacgtgcacaacagagccagaatggtgaccatgggcatcgtgagaaccagcccctgcctgaccctgcccgacgtgatgctgctggccagacccgccgccgtgtgcgacaacgccagatgcggccccgccacccagaagagagagagcccccccgccgagatcctggagctgaccagactgctgcccctgatgttcgtgaagatcaccatccacaacagcgtgaagaagcagctgcacctgaagctggccaccggcagaagcttctacctgcagctgtgcccccccagcgacgccagcgaggacctgttcgtgcactgggagaacctggtgtacatcctgagaccccccgtggaggcctacagcgacaccagagccatcctggccggcaacaccctggacagcagcgtgctggaggaggtgcagagaagccccgtgggctacgccatgaagttctgcgaggagaaggagcagttcagaatcagcagactgcacatgaacgccgagatgttcggcagcacctactgcgactacaccatcgagatctag

SEQ ID NO: 21232 - DNA, 696 bp, Artificial Sequence
  Description of Artificial Sequence: Synthetic coding sequence
atgggcccccccctgtggcccgacctgcaggagccccccccccccggcaccagcagccagatcagaagccccctgctgtgcgacgtgatcaagcccgccccccaccacgacgtgaccgtgagagtggtgcccccccccagattcctgcccctgctgctgagacccctgcccagcgacggcgacatcgccatgagaagagacagaggccccaagcccgccctgggcggcgccggcgaggtggagcccggcggcatggccgccagccccaccggcagacccagaagactgcagagatacctgcagagcggcgagttcgaccagttcagagacttccccatcttcgagagcaacttcgtgcaggtgaccagactgggcgaggtggccaacgaggtgaccatgggcgtggccgccagcagccccgccctggagctgcccgacctgctgctgctggccggccccgccaaggagaacggccacctgcagctgttcggcctgttccccctgaagttcgtgcagctgttcgtgcacgacaagagcagatgccagctggaggtgaagctgaacaccagcagaaccttctacctgcagctgagagcccccctgaagaccagagacagagagttcggccagtgggtgagactgctgtacagactgagattcctgagcgccagcgccgtgcccttcacccaggagtag

SEQ ID NO: 21233 - DNA, 744 bp, Artificial Sequence
  Description of Artificial Sequence: Synthetic coding sequence
atgggcccccccctgtggcccgacctgcaggagccccccccccccggcaccagcagccagatcagaagccccctgctgtgcgacgtgatcaagcccgccccccaccacgacgtgaccgtgagagtggtgcccccccccagattcctgcccctgctgctgagacccctgcccagcgacggcgacatcgccatgagaagagacagaggccccaagcccgccctgggcggcgccggcgaggtggagcccggcggcatggccgccagccccaccggcagacccagaagactgcagagatacctgcagagcggcgagttcgaccagttcagagacttccccatcttcgagagcaacttcgtgcagttctgccccgacatctaccccgcccccaccagcgacctgtggccccaggtgaccagactgggcgaggtggccaacgaggtgaccatgggcgtggccgccagcagccccgccctggagctgcccgacctgctgctgctggccggccccgccaaggagaacggccacctgcagctgttcggcctgttccccctgaagttcgtgcagctgttcgtgcacgacaagagcagatgccagctggaggtgaagctgaacaccagcagaaccttctacctgcagctgagagcccccctgaagaccagagacagagagttcggccagtgggtgagactgctgtacagactgagattcctgagcgccagcgccgtgcccttcacccaggagtag

SEQ ID NO: 21234 - DNA, 2769 bp, Artificial Sequence
  Description of Artificial Sequence: Synthetic coding sequence
atgatctggctgagaaacagaagatgcctggagcccctgcagggcacccccaagtgggtgcccgtgctgggcgagctgcagaagaccctgcagaagggcgagtacctgcccctgagacccctgcccatgttcgagagcaacttcgtgcaggtgacccaccagggcggccccgtgttcgtgaaccacagaaccaacagactggccatgggcgtggccgccagcctgcccggcctggtgctgcccgacatcctgctgatcggccagcccgccgaggacagagactgcagcggcctggtgctgaccagaatgatccccctggacctggtgcacctgtgcgtgcacgacctgagcgcctggagactgaagctgagactggtgagcggcagacagtactacctggccctggacgcccccgacaacgaggtgggcttcctgttccactgctgggtgagactgatcaacctgctgcaggagcccgcccccacctggacccccagaaccaccagaaccgcccccctggacatgcccctggccgaggcccccgccagcacctggcacctgcaggaccagcccatcagcagacacgccgtgagagtggccgagagaaacttcccccacaagaccgtggccgcccagagacagagaaaggccaaggccctgaagagaagcttcaagagccaggccgtgggcgacagcgtgcccctgatctggagccagctggagcacgccgacgtgagaaagaagcccgccgagaagaagagccacagcgaccccagacccgacagaacccacacccagatcagactgcccgagaagaccagcatcaccacctggaccatcttcagcatcatcagcagcaccgccaaccagacccagagcagccccaaggcctgcaccagcgccagcgacgaggccaccggccagggccacgtggtggagagccccagccactgcgtgagcgccgacagccccgacggcttcttcctgggcagctgcagcagcctggacccctgcctgtggcaccaggacaccgaggacctgatggacagcggcggcagcaccctgagcagcgccgccagcggcctggccccctacccccccgccgcctgcctgagcaccccctacagcagcatccccagaggcagagagaaggccggccccatgggcagccaccagggccccggcccccccccctgccagaaggcccccagcggcctggtgaccagctgcaaggcccccttcctggtggaccagagccagaagctgcccgccgtgcccgccagcagctggaagcccccccccggcctggcccccccccagaaggcccccgccgccagcgccccccccagaaaggcccccgccgtgcccgcccccagccagaaggcccccgccgtgcccgcccccagccagaaggcccccgccatccccgcccccagcagaaaggccagcgccgccagcgccagccccagaaaggccagcgccgtgcccgcccccccccagaagacccccccccccagccagaaggcccccagcgtgcccaccatcccccagaaggccgtgagccccaccgcccccaagaagaagagcctgctgctgcccgcccccagccagaaggccctgcccaccagccccaccgagtaccagatggccctgagcccccccgccagcagaggcaagctgcccggcgacttcgacgtgctgcccaccggcatccccggcagagccgtgctggagagaagccagagcggcggcaagcccgagcccgtggtgaccgtgagaacccaggagaccgacgtggtggagatgaccacccaggccaagagccccgagagccccttcaccgtgaccaagaaggagagcaaggacatcctgatcagccagaccaaggaggtgaccctggaggccttcagaggccagggcaagctggaggactgggcccactgggccaagctggaggagagaagccccgacctgcccggcgtgagaagcaaggagctggagcagagaaagagatgggtgaaggccaaggagctggccgtggagggccccagccaggagcacagcagacccttcagcgtggaggccctgaccctgaccaagctgatgatcaccgccaacagcaaggagcagcccagcaagagcgccctggtgagcctgcccagctggctgctggccaccccccaggccagcgccaccagcatgatggccagcgtgcccagcagacccggccagctgagcctgctggagggcaagcccgtggtggtgagagagcagcccgagagccacacctgggtgaaggagggcaagagaccctggggcgagatgaaggagcagccctggggcgagatgaaggagcccccctgggaccccaagggcccccccaaggtgcccttcagaagcaagcccaccagcgccagcctgaagagagagggcatcagccaggcccccatccccctgaccgccagcccctgggaggacctgagacccagccccctgagcgagaccctgatcagcaagatggaggccaccgccagagccagccagcagcccaagagagtgagccaggagcccatgagaatgcccgcccagcaccccctggccaccgtgggcagcagcagcgagatcctgctgcccatgctgctggagctggagaccgtgagaaacaccgccaccaaggccgaggagatccaggaggagagcggcgtgctgaacctgctgcccagcctgcagcacagccagcacagcgagtggcccgacgccggcgcctag

SEQ ID NO: 21235 - DNA, 1035 bp, Artificial Sequence
  Description of Artificial Sequence: Synthetic coding sequence
atgctgagcagcttcccccacagaaagacctggagaaagagcaagaagaccgtgaaggtgaccagaagctaccccaccttccccagcctgaacgcctgggaggagttcagaggcctgctgcccgtggacggcgagcccaaccccggcgccggcctgggcgtggaggagggcctgctgtgcagagtggtgcacagccccgagttcaacctgttcctggacagcgtggtgttcgagagcaacttcatccaggtgaagagaggcagaaactggagagacgtgtacaaggccagcaacaccatggccctgggcgtgaccagcagcgtgccctgcctgcccctgcccaacatcctgctgatggccagcgtgaagtggcaccagggccagaaccagacctggaacagacccagcatcgcccccaacatcttcctgaagagaatcctgcccctgagattcgtggagctgcaggtgtgcgaccactaccagagaatcctgcagctgagaaccgtgaccgagaagatctactacctgaagctgcaccccgaccaccccgagaccgtgttccacttctggatcagactggtgcagatcctgcagaagggcctgagcatcaccaccaaggaccccagaatcctggtgacccactgcctggtgcccaagaactgcagcagccccagcggcgacagcaagctggtgcagaagaagctgcaggccagccagcccagcgagagcctgatccagctgatgaccaagggcgagagcgaggccctgagccagatcttcgccgacctgcaccagcagaaccagctgagcttcagaagcagcagaaaggtggagaccaacaagaacagcagcggcaaggacagcagcagagaggacagcatcccctgcacctgcgacctgagatggagagccagcttcacctacggcgagtgggagagagagaaccccagcggcctgcagcccctgagcctgctgagcaccctggccgccagcaccggcccccagctggccccccccatcggcaacagcatctag

SEQ ID NO: 21236 - DNA, 903 bp, Artificial Sequence
  Description of Artificial Sequence: Synthetic coding sequence
atgagcaagatcagaggcctgccccccgaggtgagagagcccggccccggcgtggagctgggcgtggagaacggcctgctgtgccagctgatccacagccccgagttcaacctgttcagcaacagcgtggtgttcgagagcaacttcatccaggtgaccaagcccggcaactggagagacgtgtgcgagggcagcgccaccgtgatcctgggcgtgaccagcagcgtgcccagcctgcccctgcccaacgtgctgctgatggccaacgtgacctggccccagggccccttcaccacctggagcacccccggcgacgcccccgtgatcaacctgagcagactgctgcccctgaagtacgtggagctgagaatctacgacagactgcagagaatcctgagagtgagaaccgtgaccgagaagatctactacctgaagctgcacgagaagcaccccgagatcgtgttccagttctgggtgagactggtgaagatcctgcagaagggcctgagcatcaccaccaaggaccccagaatcaagttcacccactgcctggtgcccaagatgcccaccaacagcaccgagaccacccccgagaacagcctgctgagcagcccccagcccagcgagcccctggtgctgctggccgccgagcagaccagcggcagcttcagccagctgagcggcaagccccagctgaccgccgacagaaacaacgacaccgccatcgagatcgacaactgcagcagctacaagatccccagccccgtggccagccccatcaacctgaacatccccatgagagccgccctgagccacagcctgtgggagcaggaggactggaacgagcacctgctgcaggtgcacatcgccagctacctgggcgagcacttcctgggcgcctag

SEQ ID NO: 21237 - DNA, 903 bp, Artificial Sequence; identical to SEQ ID NO: 21236
  Description of Artificial Sequence: Synthetic coding sequence

SEQ ID NO: 21238 - DNA, 903 bp, Artificial Sequence; identical to SEQ ID NO: 21236
  Description of Artificial Sequence: Synthetic coding sequence

SEQ ID NO: 21239 - DNA, 930 bp, Artificial Sequence
  Description of Artificial Sequence: Synthetic coding sequence
atgagcaagatcagaggcctgccccccgaggtgagagagcccggccccggcgtggagctgggcgtggagaacggcctgctgtgccagctgatccacagccccgagttcaacctgttcagcaacagcgtggtgttcgagagcaacttcatccagacccacgtgcccgaggccgacttccaggtgaccaagcccggcaactggagagacgtgtgcgagggcagcgccaccgtgatcctgggcgtgaccagcagcgtgcccagcctgcccctgcccaacgtgctgctgatggccaacgtgacctggccccagggccccttcaccacctggagcacccccggcgacgcccccgtgatcaacctgagcagactgctgcccctgaagtacgtggagctgagaatctacgacagactgcagagaatcctgagagtgagaaccgtgaccgagaagatctactacctgaagctgcacgagaagcaccccgagatcgtgttccagttctgggtgagactggtgaagatcctgcagaagggcctgagcatcaccaccaaggaccccagaatcaagttcacccactgcctggtgcccaagatgcccaccaacagcaccgagaccacccccgagaacagcctgctgagcagcccccagcccagcgagcccctggtgctgctggccgccgagcagaccagcggcagcttcagccagctgagcggcaagccccagctgaccgccgacagaaacaacgacaccgccatcgagatcgacaactgcagcagctacaagatccccagccccgtggccagccccatcaacctgaacatccccatgagagccgccctgagccacagcctgtgggagcaggaggactggaacgagcacctgctgcaggtgcacatcgccagctacctgggcgagcacttcctgggcgcctag

SEQ ID NO: 21240 - DNA, 330 bp, Artificial Sequence
  Description of Artificial Sequence: Synthetic coding sequence
atgagcaccaacatctgcagcttcaaggacagcgccgtggacttcaccggcagatgctacttcaccaagatctgcaagtgcaagctgaaggacatcgcctgcctgaagtgcggcaacatcgtgggctaccacgtgatcgtgccctgcagcagctgcctgctgagctgcaacaacggccacttctggatgttccacagccaggccgtgtacgacatcaacagactggacagcaccggcgtgaacgtgctgctgtggggcaacctgcccgagatcgaggagagcaccgacgaggacgtgctgaacatcagcgccgaggagtgcatcagatag

SEQ ID NO: 21241 - DNA, 450 bp, Artificial Sequence
  Description of Artificial Sequence: Synthetic coding sequence
atgagcaccaacatctgcagcttcaaggacagatgcgtgagcatcctgtgctgcaagttctgcaagcaggtgctgagcagcagaggcatgaaggccgtgctgctggccgacaccgagatcgacctgttcagcaccgacatcccccccaccaacgccgtggacttcaccggcagatgctacttcaccaagatctgcaagtgcaagctgaaggacatcgcctgcctgaagtgcggcaacatcgtgggctaccacgtgatcgtgccctgcagcagctgcctgctgagctgcaacaacggccacttctggatgttccacagccaggccgtgtacgacatcaacagactggacagcaccggcgtgaacgtgctgctgtggggcaacctgcccgagatcgaggagagcaccgacgaggacgtgctgaacatcagcgccgaggagtgcatcagatag

SEQ ID NO: 21242 - DNA, 450 bp, Artificial Sequence
  Description of Artificial Sequence: Synthetic coding sequence
atgcccaccaccaccgccctgagatggaccgccgccgccagagtgagaagaaagggcagaggcggctgggtgcccgccgccctgagaagcgtgagccaggacggcgtgcccggctgcaccgtgatgggcggcgagaccagaagccccgagaacgccgtggacttcaccggcagatgctacttcaccaagatctgcaagtgcaagctgaaggacatcgcctgcctgaagtgcggcaacatcgtgggctaccacgtgatcgtgccctgcagcagctgcctgctgagctgcaacaacggccacttctggatgttccacagccaggccgtgtacgacatcaacagactggacagcaccggcgtgaacgtgctgctgtggggcaacctgcccgagatcgaggagagcaccgacgaggacgtgctgaacatcagcgccgaggagtgcatcagatag

SEQ ID NO: 21243 - DNA, 330 bp, Artificial Sequence
  Description of Artificial Sequence: Synthetic coding sequence
atgagcaccaacatctgcagcttcaaggacagcgccgtggacttcaccggcagatgctacttcaccaagatctgcaagtgcaagctgaaggacatcgcctgcctgaagtgcggcaacatcgtgggctaccacgtgatcgtgccctgcagcagctgcctgcccagctgcaacaacggccacttctggatgttccacagccaggccgtgtacgacatcaacagactggacagcaccggcgtgaacatcctgctgtggggcaacctgcccgagatcgaggagagcaccgacgaggacgtgctgaacatcagcgccgaggagtgcatcagatag

SEQ ID NO: 21244 - DNA, 450 bp, Artificial Sequence
  Description of Artificial Sequence: Synthetic coding sequence
atgagcaccaacatctgcagcttcaaggacagatgcgtgagcatcctgtgctgcaagttctgcaagcaggtgctgagcagcagaggcatgaaggccgtgctgctggccgacaccgagatcgacctgttcagcaccgacatcccccccaccaacgccgtggacttcaccggcagatgctacttcaccaagatctgcaagtgcaagctgaaggacatcgcctgcctgaagtgcggcaacatcgtgggctaccacgtgatcgtgccctgcagcagctgcctgcccagctgcaacaacggccacttctggatgttccacagccaggccgtgtacgacatcaacagactggacagcaccggcgtgaacatcctgctgtggggcaacctgcccgagatcgaggagagcaccgacgaggacgtgctgaacatcagcgccgaggagtgcatcagatag

SEQ ID NO: 21245 - DNA, 363 bp, Artificial Sequence
  Description of Artificial Sequence: Synthetic coding sequence
atgaaggccgtgctgctggccgacaccgagatcgacctgttcagcaccgacatcccccccaccaacgccgtggacttcaccggcagatgctacttcaccaagatctgcaagtgcaagctgaaggacatcgcctgcctgaagtgcggcaacatcgtgggctaccacgtgatcgtgccctgcagcagctgcctgcccagctgcaacaacggccacttctggatgttccacagccaggccgtgtacgacatcaacagactggacagcaccggcgtgaacatcctgctgtggggcaacctgcccgagatcgaggagagcaccgacgaggacgtgctgaacatcagcgccgaggagtgcatcagatag

SEQ ID NO: 21246 - DNA, 363 bp, Artificial Sequence; identical to SEQ ID NO: 21245
  Description of Artificial Sequence: Synthetic coding sequence

SEQ ID NO: 21247 - DNA, 222 bp, Artificial Sequence
  Description of Artificial Sequence: Synthetic coding sequence
tgaggcaacatcgtggtgtaccacgtgatcgtgccctgcagcagctgcctgctgagctgcaacaacagacacttctggatgttccacagccaggccgtgtacgacatcaacagactggacagcaccggcgtgaacgtgctgctgagaggcaacctgcccgagatcgaggagagcaccgacgaggacgtgctgaacatcagcgccgaggagtgcatcagatag

SEQ ID NO: 21248 - DNA, 450 bp, Artificial Sequence
  Description of Artificial Sequence: Synthetic coding sequence
atgagcaccaacatctgcagcttcaaggacagatgcgtgagcatcctgtgctgcaagttctgcaagcaggtgctgagcagcagaggcatgaaggccgtgctgctggccgacaccgagatcgacctgttcagcaccgacatcccccccaccaacgccgtggacttcaccggcagatgctacttcaccaagatctgcaagtgcaagctgaaggacatcgcctgcctgaagtgcggcaacatcgtgggctaccacgtgatcgtgccctgcagcagctgcctgctgagctgcaacaacagacacttctggatgttccacagccaggccgtgtacgacatcaacagactggacagcaccggcgtgaacgtgctgctgagaggcaacctgcccgagatcgaggagagcaccgacgaggacgtgctgaacatcagcgccgaggagtgcatcagatag

SEQ ID NO: 21249 - DNA, 549 bp, Artificial Sequence
  Description of Artificial Sequence: Synthetic coding sequence
atgaagccctggtgggccagagactgggccctgcccagcagaggccagtgcgtgtgccccggcgagaccaacgcctgcctggacgccgagagagcctgcagagagtgccccagaggcctggaggagacctgggacctgctgagccagctgcagagcctgctgggcacccacctggacaagggcgacttcggccagctgagcggccccgagccccccggcgaggtgggcaagagagcccccgacggcgccagcagaagcagcctggagcccatggaggacgccgcccccatcatctacctgctggccagccccgaccccagaatcaagcacccccaggacctggccagcacccccagccccggccccatgaccaccagcgtgagcagcctgagcgccagccagccccccgagcccagcctgctgctggagagacccagccccaagccccccgccctgttcctgacccaccacacccccctgatcctgtggcccgccctgctgctgctgcagaagaccagcctgctgctgccctgcggcacccccctgtag

SEQ ID NO: 21250 - DNA, 1026 bp, Artificial Sequence
  Description of Artificial Sequence: Synthetic coding sequence
atggccgccctgtacgcctgcaccaagtgccaccagagattccccttcgaggccctgagccagggccagcagctgtgcaaggagtgcagaatcgcccaccccgtggtgaagtgcacctactgcagaaccgagtaccagcaggagagactggagtgcaacggcaccatcagcgcccactgcaacctgcacctgcccggcagcagcgacagccccgccagcagcagcagagtggccggcatcaccggcatcaagaccaacaccatctgcaagaagtgcgcccagaacgtgcagctgtacggcacccccaagccctgccagtactgcaacatcatcgccgccttcatcggcaacaagtgccagagatgcaccaacagcgagaagaagtacggccccccctacagctgcgagcagtgcaagcagcagtgcgccttcgacagaaaggacgacagaaagaaggtggacggcaagctgctgtgctggctgtgcaccctgagctacaagagagtgctgcagaagaccaaggagcagagaaagcacctgagcagcagcagcagagccggccaccaggagaaggagcagtacagcagactgagcggcggcggccactacaacagccagaagaccctgagcaccagcagcatccagaacgagatccccaagaagaagagcaagttcgagagcatcaccaccaacggcgacagcttcagccccgacctggccctggacagccccggcaccgaccacttcgtgatcatcgcccagctgaaggaggaggtggccaccctgaagaagatgctgcaccagaaggaccagatgatcctggagaaggagaagaagatcaccgagctgaaggccgacttccagtaccaggagagccagatgagagccaagatgaaccagatggagaagacccacaaggaggtgaccgagcagctgcaggccaagaacagagagctgctgaagcaggccgccgccctgagcaagagcaagaagagcgagaagagcggcgccatcaccagcccctag

SEQ ID NO: 21251 - DNA, 2352 bp, Artificial Sequence
  Description of Artificial Sequence: Synthetic coding sequence
atggaggacgagcagcccgacagcctggagggctgggtgcccgtgagagagggcctgttcgccgagcccgagagacacagactgagattcctggtggcctggaacggcgccgagggcaagttcgccgtgacctgccacgacagaaccgcccagcagagaagactgagagagggcgccagactgggccccgagcccgagcccaagcccgaggccgccgtgagccccagcagctgggccggcctgctgagcgccgccggcctgagaggcgcccacagacagctggccgccctgtggccccccctggagagatgcttccccagactgccccccgagctggacgtgggcggcggcggcgcctggggcctgggcctgggcctgtgggccctgctgtggcccaccagagccggccccggcgaggccgccctgcaggagctgtgcggccagctggagagatacctgggcgccgccgccgacggctgcggcggcgccaccgtgagagacgccctgttccccgccgagggcggcgccgccgactgcgagagccccagagagttcagagagagagccctgagagccagatgggtggaggccgacgccagactgagacaggtgatccagggccacggcaaggccaacaccatggtggccctgatgaacgtgtaccaggaggaggacgaggcctaccaggagctggtgaccgtggccaccatgttcttccagtacctgctgcagcccttcagagccatgagagaggtggccaccctgtgcaagctggacatcctgaagagcctggacgaggacgacctgggccccagaagagtggtggccctggagaaggaggccgaggagtggaccagaagagccgaggaggccgtggtgagcatccaggacatcaccgtgaactacttcaaggagaccgtgaaggccctggccggcatgcagaaggagatggagcaggacgccaagagattcggccaggccgcctgggccaccgccatccccagactggagaagctgcagctgatgctggccagagagaccctgcagctgatgagagccaaggagctgtgcctgaaccacaagagagccgagatccagggcaagatggaggacctgcccgagcaggagaagaacaccaacgtggtggacgagctggagatccagttctacgagatccagctggagctgtacgaggtgaagttcgagatcctgaagaacgaggagatcctgctgaccacccagctggacagcctgaagagactgatcaaggagaagcaggacgaggtggtgtactacgacccctgcgagaaccccgaggagctgaaggtgatcgactgcgtggtgggcctgcaggacgacaagaacctggaggtgaaggagctgagaagacagtgccagcagctggagagcaagagaggcagaatctgcgccaagagagccagcctgagaagcagaaaggaccagtgcaaggagaaccacagattcagactgcagcaggccgaggagagcatcagatacagcagacagcaccacagcatccagatgaagagagacaagatcaaggaggaggagcagaagaagaaggagtggatcaaccaggagagacagaagaccctgcagagactgagaagcttcaaggacaagagactggcccagagcgtgagaaacaccagcggcagcgagcccgtggcccccaacctgcccagcgacctgagccagcagatgtgcctgcccgccagccacgccgtgagcgtgatccaccccagcagcagaaagaccagaggcgtgcccctgagcgaggccggcaacgtgaagagccccaagtgccagaactgccacggcaacatccccgtgcaggtgttcgtgcccgtgggcgaccagacccacagcaagagcagcgaggagctgagcctgccccccccccccccccccccccccccccccccccccccccccccccccccccccccccccctgagagccctgagcagcagcagccaggccgccacccaccagaacctgggcttcagagcccccgtgaaggacgaccagcccagacccctggtgtgcgagagccccgccgagagacccagagacagcctggagagcttcagctgccccggcagcatggacgaggtgctggccagcctgagacacggcagagcccagggcgtgaagctgaagaaggtgcaccccgacctgggccccaaccccagcagcaagcccaccagcaacagaagaaccagcgacctggagagaagcatcaaggccgccctgcagagaatcaagagagtgagcgccgacagcgaggaggacagcgacgagcaggaccccggccagtgggacggctag

SEQ ID NO: 21252 - DNA, 837 bp, Artificial Sequence
  Description of Artificial Sequence: Synthetic coding sequence
atggccgccctgtacgcctgcaccaagtgccaccagagattccccttcgaggccctgagccagggccagcagctgtgcaaggagtgcagaatcgcccaccccgtggtgaagtgcacctactgcagaaccgagtaccagcaggagagcaagaccaacaccatctgcaagaagtgcgcccagaacgtgcagctgtacggcacccccaagccctgccagtactgcaacatcatcgccgccttcatcggcaacaagtgccagagatgcaccaacagcgagaagaagtacggccccccctacagctgcgagcagtgcaagcagcagtgcgccttcgacagaaaggacgacagaaagaaggtggacggcaagctgctgtgctggctgtgcaccctgagctacaagagagtgctgcagaagaccaaggagcagagaaagcacctgagcagcagcagcagagccggccaccaggagaaggagcagtacagcagactgagcggcggcggccactacaacagcttcagccccgacctggccctggacagccccggcaccgaccacttcgtgatcatcgcccagctgaaggaggaggtggccaccctgaagaagatgctgcaccagaaggaccagatgatcctggagaaggagaagaagatcaccgagctgaaggccgacttccagtaccaggagagccagatgagagccaagatgaaccagatggagaagacccacaaggaggtgaccgagcagctgcaggccaagaacagagagctgctgaagcaggccgccgccctgagcaagagcaagaagagcgagaagagcggcgccatcaccagcccctag

SEQ ID NO: 21253 - DNA, 924 bp, Artificial Sequence
  Description of Artificial Sequence: Synthetic coding sequence
atggccgccctgtacgcctgcaccaagtgccaccagagattccccttcgaggccctgagccagggccagcagctgtgcaaggagtgcagaatcgcccaccccgtggtgaagtgcacctactgcagaaccgagtaccagcaggagagcaagaccaacaccatctgcaagaagtgcgcccagaacgtgcagctgtacggcacccccaagccctgccagtactgcaacatcatcgccgccttcatcggcaacaagtgccagagatgcaccaacagcgagaagaagtacggccccccctacagctgcgagcagtgcaagcagcagtgcgccttcgacagaaaggacgacagaaagaaggtggacggcaagctgctgtgctggctgtgcaccctgagctacaagagagtgctgcagaagaccaaggagcagagaaagcacctgagcagcagcagcagagccggccaccaggagaaggagcagtacagcagactgagcggcggcggccactacaacagccagaagaccctgagcaccagcagcatccagaacgagatccccaagaagaagagcaagttcgagagcatcaccaccaacggcgacagcttcagccccgacctggccctggacagccccggcaccgaccacttcgtgatcatcgcccagctgaaggaggaggtggccaccctgaagaagatgctgcaccagaaggaccagatgatcctggagaaggagaagaagatcaccgagctgaaggccgacttccagtaccaggagagccagatgagagccaagatgaaccagatggagaagacccacaaggaggtgaccgagcagctgcaggccaagaacagagagctgctgaagcaggccgccgccctgagcaagagcaagaagagcgagaagagcggcgccatcaccagcccctag

SEQ ID NO: 21254 - DNA, 684 bp, Artificial Sequence
  Description of Artificial Sequence: Synthetic coding sequence
atggccgccctgtacgcctgcaccaagtgccaccagagattccccttcgaggccctgagccagggccagcagctgtgcaaggagtgcagaatcgcccaccccgtggtgaagtgcacctactgcagaaccgagtaccagcaggagagcaagaccaacaccatctgcaagaagtgcgcccagaacgtgcagctgtacggcaccgtggacggcaagctgctgtgctggctgtgcaccctgagctacaagagagtgctgcagaagaccaaggagcagagaaagcacctgagcagcagcagcagagccggccaccaggagaaggagcagtacagcagactgagcggcggcggccactacaacagcttcagccccgacctggccctggacagccccggcaccgaccacttcgtgatcatcgcccagctgaaggaggaggtggccaccctgaagaagatgctgcaccagaaggaccagatgatcctggagaaggagaagaagatcaccgagctgaaggccgacttccagtaccaggagagccagatgagagccaagatgaaccagatggagaagacccacaaggaggtgaccgagcagctgcaggccaagaacagagagctgctgaagcaggccgccgccctgagcaagagcaagaagagcgagaagagcggcgccatcaccagcccctag

SEQ ID NO: 21255 - DNA, 1020 bp, Artificial Sequence
  Description of Artificial Sequence: Synthetic coding sequence
atggccgccagcgccctgtacgcctgcaccaagtgcacccagagataccccttcgaggagctgagccagggccagcagctgtgcaaggagtgcagaatcgcccaccccatcgtgaagtgcacctactgcagaagcgagttccagcaggagagcaagaccaacaccatctgcaagaagtgcgcccagaacgtgaagcagttcggcacccccaagccctgccagtactgcaacatcatcgccgccttcatcggcaccaagtgccagagatgcaccaacagcgagaagaagtacggccccccccagacctgcgagcagtgcaagcagcagtgcgccttcgacagaaaggaggagggcagaagaaaggtggacggcaagctgctgtgctggctgtgcaccctgagctacaagagagtgctgcagaagaccaaggagcagagaaagagcctgggcagcagccacagcaacagcagcagcagcagcctgaccgagaaggaccagcaccaccccaagcaccaccaccaccaccaccaccaccaccacagacacagcagcagccaccacaagatcagcaacctgagccccgaggaggagcagggcctgtggaagcagagccacaagagcagcgccaccatccagaacgagacccccaagaagaagcccaagctggagagcaagcccagcaacggcgacagcagcagcatcaaccagagcgccgacagcggcggcaccgacaacttcgtgctgatcagccagctgaaggaggaggtgatgagcctgaagagactgctgcagcagagagaccagaccatcctggagaaggacaagaagctgaccgagctgaaggccgacttccagtaccaggagagcaacctgagaaccaagatgaacagcatggagaaggcccacaaggagaccgtggagcagctgcaggccaagaacagagagctgctgaagcaggtggccgccctgagcaagggcaagaagttcgacaagagcggcagcatcctgaccagcccctag

SEQ ID NO: 21256 - DNA, 843 bp, Artificial Sequence
  Description of Artificial Sequence: Synthetic coding sequence
atgaccagctacatcctgatcagcttcgtgctgctgatcggcgtgggctgcatcgagaaggaccagagctgccccgtgttcggcggcagaaagagactgcacctgctgttcgtgggcggccagctgagacaggtgagaatgctgagaggcagccccgaggccagcaccgactgctgctggctgcaccaggccaccggcagcggcagcgtgacccaggccggcgtgcagtggtacgacctgggcagcctgcagcccctgccccccagattcaagagattcagctgcctgagcctgcccagcagctgggactacagaagcagctgggagctgcccgacctgcaggagggcaagatccaggccatcagcgacagcgacggcgtgaactacccctggtacggcaacaccaccgagacctgcaccatcgtgggccccaccaagagagacagcaagttcatcatcagcatgaacgacaacttctaccccagcgtgacctgggccgtgcccgtgagcgagagcaacgtggccaagctgaccaacatctacagagaccagagcttcaccacctggctggtggccaccaacaccagcaccaacgacatgatcatcctgcagaccctgcactggagaatgcagctgagcatcgaggtgaaccccaacagacccctgggccagagagccagactgagagagcccatcgcccaggaccagcccaagatcctgagcaagaacgagcccatcccccccagcgccctggtgaagcccaacgccaacgacgcccaggtgctgatgtggagacccaagtacggccagcccctggtggtgatcccccccaagcacagatag

SEQ ID NO: 21257 - DNA, 852 bp, Artificial Sequence
  Description of Artificial Sequence: Synthetic coding sequence
atgcccggcttcttctgcgactgctggcccagcctggagatcagagccctgctgtacgccatgggctgcatccagagcatcggcggcaaggccagagtgttcagagagggcatcaccgtgatcgacgtgaaggccagcatcgaccccgtgcccaccagcatcgacgagagcagcagcgtggtgctgagatacagaaccccccacttcagagccagcgcccaggtggtgatgccccccatccccaagaaggagacctgggtggtgggctggatccaggcctgcagccacatggagttctacaaccagtacggcgagcagggcatgagcagctgggagctgcccgacctgcaggagggcaagatccaggccatcagcgacagcgacggcgtgaactacccctggtacggcaacaccaccgagacctgcaccatcgtgggccccaccaagagagacagcaagttcatcatcagcatgaacgacaacttctaccccagcgtgacctgggccgtgcccgtgagcgagagcaacgtggccaagctgaccaacatctacagagaccagagcttcaccacctggctggtggccaccaacaccagcaccaacgacatgatcatcctgcagaccctgcactggagaatgcagctgagcatcgaggtgaaccccaacagacccctgggccagagagccagactgagagagcccatcgcccaggaccagcccaagatcctgagcaagaacgagcccatcccccccagcgccctggtgaagcccaacgccaacgacgcccaggtgctgatgtggagacccaagtacggccagcccctggtggtgatcccccccaagcacagatag

SEQ ID NO: 21258 - DNA, 759 bp, Artificial Sequence
  Description of Artificial Sequence: Synthetic coding sequence
ggccagggcatcgccgccgccctgatccacctgcccagcaccggcaacaagcactggagacccagaagccccgaggccagcaccgactgctgctggctgcaccaggccaccggcagcggcagcgtgacccaggccggcgtgcagtggtacgacctgggcagcctgcagcccctgccccccagattcaagagattcagctgcctgagcctgcccagcagctgggactacagaagcagctgggagctgcccgacctgcaggagggcaagatccaggccatcagcgacagcgacggcgtgaactacccctggtacggcaacaccaccgagacctgcaccatcgtgggccccaccaagagagacagcaagttcatcatcagcatgaacgacaacttctaccccagcgtgacctgggccgtgcccgtgagcgagagcaacgtggccaagctgaccaacatctacagagaccagagcttcaccacctggctggtggccaccaacaccagcaccaacgacatgatcatcctgcagaccctgcactggagaatgcagctgagcatcgaggtgaaccccaacagacccctgggccagagagccagactgagagagcccatcgcccaggaccagcccaagatcctgagcaagaacgagcccatcccccccagcgccctggtgaagcccaacgccaacgacgcccaggtgctgatgtggagacccaagtacggccagcccctggtggtgatcccccccaagcacagatag

SEQ ID NO: 21259 - DNA, 786 bp, Artificial Sequence
  Description of Artificial Sequence: Synthetic coding sequence
atgggctgcatccagagcatcacctgcaaggccagaatcagaagagagaacatcgtggtgtacgacgtgtgcgccaccatcgaccagtgccccaccagaatcgaggagaccagccccatcgtgctgagatacaagaccccctacttcaaggccagcgccagagtggtgatgccccccatccccagacacgagacctgggtggtgggctggatccaggcctgcaaccagatggagttcttcaacacctacagcgacctgggcatgagcagctgggagctgcccgacctgagagagggcagagtgaaggccatcagcgacagcgacggcgtgagctacccctggtacggcaacaccaccgagaccgtgaccctggtgggccccaccaacaagatcagcagattcagcgtgagcatgaacgacaacttctaccccagcgtgacctgggccgtgcccgtgagcgacagcaacgtgcccctgctgaccagaatcaagagagaccagagcttcaccacctggctggtggccatgaacaccaccaccaaggagaagatcatcctgcagaccatcaagtggagaatgagagtggacatcgaggtggaccccctgcagctgctgggccagagagccagactggtgggcagaacccagcaggagcagcccagaatcctgagcagaatggagcccatcccccccaacgccctggtgaagcccaacgccaacgacgcccaggtgctgatgtggagacccaagagaggcccccccctggtggtgatcccccccaagtag

SEQ ID NO: 21260 - DNA, 786 bp, Artificial Sequence; identical to SEQ ID NO: 21259
  Description of Artificial Sequence: Synthetic coding sequence

SEQ ID NO: 21261 - DNA, 1107 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatcgtgaacagcctgcagaagatgcagaacaagggcggcggcgacagactggccagactgttcctggaggagcacatcagaaacatcaccgccatcgtgaagcagctgaacagagacatcgaggtgctgcaggagcagatcagagccagagacaacatcagctacggcaccaacagcgccctgaagaccctggagatgagacagctgagcggcctgggcgacctgagaggcagagtggccagatgcgacgccagcatcgccagactgagcgccgagcacaagaccacctacgagggcctgcagcacctgaacaaggagcagcaggccgccaagctgatcctggagaccaagatcaaggacgccgagggccagatcagccagctgctgaacagagtggacctgagcatcagcgagcagagcaccaagctgaagatgagccacagagacagcaaccaccagctgcagctgctggacaccaagttcaagggcaccgtggaggagctgagcaaccagatcctgagcgccagaagctggctgcagcaggagcaggagagaatcgagaaggagctgctgcagaagatcgaccagctgagcctgatcgtgaaggagaacagcggcgccagcgagagagacatggagaagaagctgagccagatgagcgccagactggacaagatcgaggagggccagaagaagaccttcgacggccagagaaccagacaggaggaggagaagatgcacggcagaatcaccaagctggagctgcagatgaaccagaacatcaaggagatgaaggccgaggtgaacgccggcttcaccgccgtgtacgagagcatcggcagcctgagacaggtgctggaggccaagatgaagctggacagagaccagctgcagaagcagatccagctgatgcagaagcccgagacccccatgtag

SEQ ID NO: 21262 - DNA, 207 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatcgtgaacagcctgcagaagatgcagaacaagtag

SEQ ID NO: 21263 - DNA, 327 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatcgtgaacagcctgcagaagatgcagaacaagggcggcggcgacagactggccagactgttcctggaggagcacatcagaaacatcaccgccatcgtgaagcagctgaacagagacatcgaggtgctgcaggagcagatcagagccagagactag

SEQ ID NO: 21264 - DNA, 204 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatcgtgaacagcctgcagaagatgcagaactag

SEQ ID NO: 21265 - DNA, 348 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatcgtgaacagcctgcagaagatgcagaacaagggcggcggcgacagactggccagactgttcctggaggagcacatcagaaacatcaccgccatcgtgaagcagctgaacagagacatcgaggtgctgcaggagcagatcagagccagagacaacatcagctacggcaccaactag

SEQ ID NO: 21266 - DNA, 177 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatctag

SEQ ID NO: 21267 - DNA, 402 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatcgtgaacagcctgcagaagatgcagaacaagggcggcggcgacagactggccagactgttcctggaggagcacatcagaaacatcaccgccatcgtgaagcagctgaacagagacatcgaggtgctgcaggagcagatcagagccagagacaacatcagctacggcaccaacagcgccctgaagaccctggagatgagacagctgagcggcctgggcgacctgagatag

SEQ ID NO: 21268 - DNA, 351 bp, Artificial Sequence
  Description of Artificial Sequence: Synthetic coding sequence
atggagaacatgcacctgagaagagtgagaaccatgcccagacacagccagagcctgaccatggccccctacagcagcgtgagcctggtggagcagctggaggacagaatcctgtgccacgagaagaccaccgccgccctggtggagcacgccttcagaatcaaggacgacatcgtgaacagcctgcagaagatgcagaacaagggcggcggcgacagactggccagactgttcctggaggagcacatcagaaacatcaccgccatcgtgaagcagctgaacagagacatcgaggtgctgcaggagcagatcagagccagagacaacatcagctacggcaccaacagctag

SEQ ID NO: 21269 - DNA, 1359 bp, Artificial Sequence
  Description of Artificial Sequence: Synthetic coding sequence
atgcagctgcagttcctgggcaccctggccagcagcgagaagagaaagaagagccagagactgttcttcaagaacatcaagagcaccaagaacaaggccggcaaggccagcatcatgagcagcgacaccaacgtgaacaagagcgccagccccaccgccaccgccgaggagcagcccgtggagcccgacggccccctgcccggcagcgacaacaaccaggagaagaaggtgagactgagccccgccaagatgagcaccaagaacagcaccgacctggtggagtacgtggacaagagccacgccttcctgcccatcatccccaacacccagagaggccagctggaggacagactgaacaaccaggccagaaccatcgccttcctgctggagcaggccttcagaatcaaggaggacatcagcgcctgcctgcagggcacccacggcttcagaaaggaggagagcctggccagaaagctgctggagagccacatccagaccatcaccagcatcgtgaagaagctgagccagaacatcgagatcctggaggaccagatcagagccagagaccaggccgccaccggcaccaacttcgccgtgcacgagatcaacatcaagcacctgcagggcgtgggcgacctgagaggcagagtggccagatgcgacagcagcatcgtgaagctgagcggcgacatccacctgttcagacaggagcacagacagatcgagaaggccatccaggagttcgtgcccgccctggagaccctgagcaagaacctggacatgaaggtgatgcagctgctgggcaagatcgagaccgccagccccgagcagaccagcaacctgaagatggtgcagggcgactacagacacgagatgaacctgctggagttcaagttccacagcctgagcagcaacctgtacgaggaggtggagaacaacaagaagtggaccgagaaccagttcctgaagtacagaaaggaccacctgggccacatcaacgagtgcctgaaggtgctgcaggagaagctggagaagagcgagaacaagatggaggagaagctgctgcagctgagcagcaaggtggagaacttcatcaacacccagaagcaggagacccagctgagcaaggtgaagcacatggagaacaagctgagcaagaagatggagcagatggagaagcagatctggggcgagctggagaccatgcagaacgagtaccagagcggcttcaagagcatccacgacagcctgagcagcctgcagcagatccagaagaccaagatggacctggagaagtacaaggtgcagaaggacctgaagaagctgcagagaaagatcgtggagctgcaggaggtgtag

SEQ ID NO: 21270 - DNA, 1104 bp, Artificial Sequence
  Description of Artificial Sequence: Synthetic coding sequence
atgagcagaagcagacacctgggcaagatcagaaagagactggaggacgtgaagagccagtgggtgagacccgccagagccgacttcagcgacaacgagagcgccagactggccaccgacgccctgctggacggcggcagcgaggcctactggagagtgctgagccaggagggcgaggtggacttcctgagcagcgtggaggcccagtacatccaggcccaggccagagagcccccctgcccccccgacaccctgggcggcgccgaggccggccccaagggcctggacagcagcagcctgcagagcggcacctacttccccgtggccagcgagggcagcgagcccgccctgctgcacagctgggccagcgccgagaagccctacctgaaggagaagagcagcgccaccgtgtacttccagaccgtgaagcacaacaacatcagagacctggtgagaagatgcatcaccagaaccagccaggtgctggtgatcctgatggacgtgttcaccgacgtggagatcttctgcgacatcctggaggccgccaacaagagaggcgtgttcgtgtgcgtgctgctggaccagggcggcgtgaagctgttccaggagatgtgcgacaaggtgcagatcagcgacagccacctgaagaacatcagcatcagaagcgtggagggcgagatctactgcgccaagagcggcagaaagttcgccggccagatcagagagaagttcatcatcagcgactggagattcgtgctgagcggcagctacagcttcacctggctgtgcggccacgtgcacagaaacatcctgagcaagttcaccggccaggccgtggagctgttcgacgaggagttcagacacctgtacgccagcagcaagcccgtgatgggcctgaagagccccagactggtggcccccgtgccccccggcgccgcccccgccaacggcagactgagcagcagcagcggcagcgccagcgacagaaccagcagcaaccccttcagcggcagaagcgccggcagccaccccgtgcccgagagcaagcagaacaagaccaagaccaagaagcagaccaccctgtggttcctgatggccttctag

SEQ ID NO: 21271 - DNA, 1305 bp, Artificial Sequence
  Description of Artificial Sequence: Synthetic coding sequence
atgagcagaagcagacacctgggcaagatcagaaagagactggaggacgtgaagagccagtgggtgagacccgccagagccgacttcagcgacaacgagagcgccagactggccaccgacgccctgctggacggcggcagcgaggcctactggagagtgctgagccaggagggcgaggtggacttcctgagcagcgtggaggcccagtacatccaggcccaggccagagagcccccctgcccccccgacaccctgggcggcgccgaggccggccccaagggcctggacagcagcagcctgcagagcggcacctacttccccgtggccagcgagggcagcgagcccgccctgctgcacagctgggccagcgccgagaagccctacctgaaggagaagagcagcgccaccgtgtacttccagaccgtgaagcacaacaacatcagagacctggtgagaagatgcatcaccagaaccagccaggtgctggtgatcctgatggacgtgttcaccgacgtggagatcttctgcgacatcctggaggccgccaacaagagaggcgtgttcgtgtgcgtgctgctggaccagggcggcgtgaagctgttccaggagatgtgcgacaaggtgcagatcagcgacagccacctgaagaacatcagcatcagaagcgtggagggcgagatctactgcgccaagagcggcagaaagttcgccggccagatcagagagaagttcatcatcagcgactggagattcgtgctgagcggcagctacagcttcacctggctgtgcggccacgtgcacagaaacatcctgagcaagttcaccggccaggccgtggagctgttcgacgaggagttcagacacctgtacgccagcagcaagcccgtgatgggcctgaagagccccagactggtggcccccgtgccccccggcgccgcccccgccaacggcagactgagcagcagcagcggcagcgccagcgacagaaccagcagcaaccccttcagcggcagaagcgccggcagccaccccggcaccagaagcgtgagcgccagcagcggcccctgcagccccgccgccccccaccccccccccccccccagattccagccccaccagggcccctggggcgcccccagcccccaggcccacctgagccccagaccccacgacggcccccccgccgccgtgtacagcaacctgggcgcctacagacccaccagactgcagctggagcagctgggcctggtgcccagactgacccccacctggagacccttcctgcaggccagcccccacttctag

SEQ ID NO: 21272 - DNA, 1305 bp, Artificial Sequence; identical to SEQ ID NO: 21271
  Description of Artificial Sequence: Synthetic coding sequence

SEQ ID NO: 21273 - DNA, 885 bp, Artificial Sequence
  Description of Artificial Sequence: Synthetic coding sequence
atgagcagaagcagacacctgggcaagatcagaaagagactggaggacgtgaagagccagtgggtgagacccgccagagccgacttcagcgacaacgagagcgccagactggccaccgacgccctgctggacggcggcagcgaggcctactggagagtgctgagccaggagggcgaggtggacttcctgagcagcgtggaggcccagtacatccaggcccaggccagagagcccccctgcccccccgacaccctgggcggcgccgaggccggccccaagggcctggacagcagcagcctgcagagcggcacctacttccccgtggccagcgagggcagcgagcccgccctgctgcacagctgggccagcgccgagaagccctacctgaaggagaagagcagcgccaccgtgtacttccagaccgtgaagcacaacaacatcagagacctggtgagaagatgcatcaccagaaccagccagaacatcagcatcagaagcgtggagggcgagatctactgcgccaagagcggcagaaagttcgccggccagatcagagagaagttcatcatcagcgactggagattcgtgctgagcggcagctacagcttcacctggctgtgcggccacgtgcacagaaacatcctgagcaagttcaccggccaggccgtggagctgttcgacgaggagttcagacacctgtacgccagcagcaagcccgtgatgggcctgaagagccccagactggtggcccccgtgccccccggcgccgcccccgccaacggcagactgagcagcagcagcggcagcgccagcgacagaaccagcagcaaccccttcagcggcagaagcgccggcagccaccccggcaccagaaccgacggctag

SEQ ID NO: 21274 - DNA, 1104 bp, Artificial Sequence; identical to SEQ ID NO: 21270
  Description of Artificial Sequence: Synthetic coding sequence

SEQ ID NO: 21275 - DNA, 885 bp, Artificial Sequence; identical to SEQ ID NO: 21273
  Description of Artificial Sequence: Synthetic coding sequence

SEQ ID NO: 21276 - DNA, 3036 bp, Artificial Sequence
  Description of Artificial Sequence: Synthetic coding sequence
atggagaccagcagcatgctgagcagcctgaacgacgagtgcaagagcgacaactacatcgagccccactacaaggagtggtacagagtggccatcgacatcctgatcgagcacggcctggaggcctaccaggagttcctggtgcaggagagagtgagcgacttcctggccgaggaggagatcaactacatcctgaagaacgtgcagaaggtggcccagagcaccgcccacggcaccgacgacagctgcgacgacaccctgagcagcggcacctactggcccgtggagagcgacgtggaggcccccaacctggacctgggctggccctacgtgatgcccggcctgctgggcggcacccacatcgacctgctgttccacccccccagagcccacctgctgaccatcaaggagaccatcagaaagatgatcaaggaggccagaaaggtgatcgccctggtgatggacatcttcaccgacgtggacatcttcaaggagatcgtggaggccagcaccagaggcgtgagcgtgtacatcctgctggacgagagcaacttcaaccacttcctgaacatgaccgagaagcagggctgcagcgtgcagagactgagaaacatcagagtgagaaccgtgaagggccaggactacctgagcaagaccggcgccaagttccacggcaagatggagcagaagttcctgctggtggactgccagaaggtgatgtacggcagctacagctacatgtggagcttcgagaaggcccacctgagcatggtgcagatcatcaccggccagctggtggagagcttcgacgaggagttcagaaccctgtacgccagaagctgcgtgcccagcagcttcgcccaggaggagagcgccagagtgaagcacggcaaggccctgtgggagaacggcacctaccagcacagcgtgagcagcctggccagcgtgagcagccagagaaacctgttcggcagacaggacaagatccacaagctggacagcagctacttcaagaacagaggcatctacaccctgaacgagcacgacaagtacaacatcagaagccacggctacaagccccacttcgtgcccaacttcaacggccccaacgccatcagacagttccagcccaaccagatcaacgagaactggaagagacacagctacgccggcgagcagcccgagaccgtgccctacctgctgctgaacagagccctgaacagaaccaacaacccccccggcaactggaagaagcccagcgacagcctgagcgtggccagcagcagcagagagggctacgtgagccaccacaacacccccgcccagagcttcgccaacagactggcccagagaaagaccaccaacctggccgacagaaacagcaacgtgagaagaagcttcaacggcaccgacaaccacatcagattcctgcagcagagaatgcccaccctggagcacaccaccaagagcttcctgagaaactggagaatcgagagctacctgaacgaccacagcgaggccacccccgacagcaacggcagcgccctgggcgacagattcgagggctacgacaaccccgagaacctgaaggccaacgccctgtacacccacagcagactgagaagcagcctggtgttcaagcccaccctgcccgagcagaaggaggtgaacagctgcaccaccggcagcagcaacagcaccatcatcggcagccagggcagcgagacccccaaggaggtgcccgacacccccaccaacgtgcagcacctgaccgacaagcccctgcccgagagcatccccaagctgcccctgcagagcgaggcccccaagatgcacaccctgcaggtgcccgagaaccacagcgtggccctgaaccagaccaccaacggccacaccgagagcaacaactacatctacaagaccctgggcgtgaacaagcagaccgagaacctgaagaaccagcagaccgagaacctgctgaagagaagaagcttccccctgttcgacaacagcaaggccaacctggaccccggcaacagcaagcactacgtgtacagcaccctgaccagaaacagagtgagacagcccgagaagcccaaggaggacctgctgaagagcagcaagagcatgcacaacgtgacccacaacctggaggaggacgaggaggaggtgaccaagagaaacagccccagcggcaccaccaccaagagcgtgagcatcgccgccctgctggacgtgaacaaggaggagagcaacaaggagctggccagcaagaaggaggtgaagggcagccccagcttcctgaagaagggcagccagaagctgagaagcctgctgagcctgacccccgacaagaaggagaacctgagcaagaacaaggcccccgccttctacagactgtgcagcagcagcgacaccctggtgagcgagggcgaggagaaccagaagcccaagaagagcgacaccaaggtggacagcagccccagaagaaagcacagcagcagcagcaacagccagggcagcatccacaagagcaaggaggacgtgaccgtgagccccagccaggagatcaacgccccccccgacgagaacaagagaacccccagccccggccccgtggagagcaagttcctggagagagccggcgacgccagcgcccccagattcaacaccgagcagatccagtacagagacagcagagagatcaacgccgtggtgacccccgagagaagacccaccagcagccccagacccaccagcagcgagctgctgagaagccacagcaccgacagaagagtgtacagcagattcgagcccttctgcaagatcgagagcagcatccagcccaccagcaacatgcccaacaccagcatcaacagacccgagatcaagagcgccaccatgggcaacagctacggcagaagcagccccctgctgaactacaacaccggcgtgtacagaagctaccagcccaacgagaacaagttcagaggcttcatgcagaagttcggcaacttcatccacaagaacaagtag

SEQ ID NO: 21277 - DNA, 2244 bp, Artificial Sequence
  Description of Artificial Sequence: Synthetic coding sequence
atgttcggcggccccggccccggcgtgctgggcgcccagggcatggccggccccctgagaggcagagtggaggagctgaagctgccctggtggagagagagcagccccctggtgctgagacacagcgaggccgccagactggccgccgacgccctgctggagagaggcgaggccgcctacctgagagtgatcagcgaggagagagagctgcccttcctgagcgccctggacgtggactacatgaccagccacgtgagaggcggccccgagctgagcgaggcccagggccaggaggccagcggccccgacagactgagcctgctgagcgaggtgaccagcggcacctacttccccatggccagcgacatcgacccccccgacctggacctgggctggcccgaggtgccccaggccaccggcttcagccccacccaggccgtggtgcacttccagagagacaaggccaagaacatcaaggacctgctgagattcctgttcagccaggcccacaccgtggtggccgtggtgatggacatcttcaccgacatggagctgctgtgcgacctgatggaggccagcagcagaagaggcgtgcccgtgtacctgctgctggcccaggagcacctgagacacttcctggagatgtgctacaagatggacctgaacggcgagcacctgcccaacatgagagtgagaagcacctgcggcgacacctactgcagcaaggccggcagaagattcaccggccaggccctggagaagttcgtgctgatcgactgcgagcaggtggtggccggcagctacagcttcacctggctgtgcagccaggcccacaccagcatggtgctgcagctgagaggcagaatcgtggaggacttcgacagagagttcagatgcctgtacgccgagagccagcccgtggagggcttctgcggcggcgaggaccccctgagccccagagccctgagacccccccccgtggccctggccttcagacccgacgtgcccagccccaccagcagcctgcccagcagcaccagcctgagcagcatcaagcagagccccctgatgggcagaagcagctacctggccctgcccggcggcggcgactgcagcgacaccggcgtggtgagcagcagcctgggccccgccagaagagaggccagcggccagcccagcctgcacagacagctgagcgaccccaaccacggcagcccccccggcctgtacagagccaacctgggcaagctgggcgcctacccctggagccagagcagccccgccctgaaccacaacagcaccagccccctgaccctggccgtgggcagccccctgctgcccagaagcagacccctgctgcagttccacagaggcgcccccgccctgagcagattccccgagaacggcctgcccggcagccaggagcccagccccctgagaggcagatgggtgcccggcaccaccctggagaccgtggaggagaaggagaagaaggccagccccagccagagcagaggccagctggacctgctggtgcccttccccagagccagagaggtgggcgaccccgacagcggcgtgacccccaacagcggccccctgagacccggcgagcaggcccccgaggacagaagactgagccccagccaggccgacagccagctggacctgctgagcagagccctgggcaccggcggcgcccccgagctgggcagcctgagacccggcgacagagccctggaggacagaagactgagcctgaaccagagcagaggccagagcgacctgctgatgcagtaccccaaggcccagggcagcagagtgcccctggagaccaacagcagcgccagacccgccagaagagcccccgacgagagaagacagaccctgggccacagccagctggacctgatcaccaagttcggccccttcagaggcgagggccccggccccaacggcctgcccatcagcagccccgccagaaccgccggcgccggcagcggcgacgagaagagactgaccctgggccacagcaagctggacctgatcaccaagtaccaccagctgcacggcgccagacagggcaccgagcccggcggccccaagggcggccacctgaacggcggcaacagcgacctggtgagagacgagaagagactgaccctgggccacagcaagctggacctgatcaccaagtacaacaagagcaagttcaagcagctgagaagcagattcgagagctag

SEQ ID NO: 21278 - DNA, 1437 bp, Artificial Sequence
  Description of Artificial Sequence: Synthetic coding sequence
atggccgccagccagctggccgccctggagggcgtggacagcggccccagagtgcccggcgccagccccggcttcctgtacagcgagggccagagactggccctggaggccctgctgagcaagggcgccgaggccttccagacctgcgtgcagagagaggagctgtggcccttcctgagcgccgacgaggtgcagggcctggccgccgccgccgaggactggaccgtggccaagcaggagcccagcggcatggccgagggcgccaccaccaccgacgtggacgccggcagcctgagctactggcccggccagagcgagcagcccgcccccgtgctgagactgggctggcccgtggacagcgcctggaagggcatcaccagagcccagctgtacacccagccccccggcgagggccagccccccctgaaggagctggtgagactggagatccaggccgcccacaagctggtggccgtggtgatggacgtgttcaccgaccccgacctgctgctggacctggtggacgccgccaccagaagatgggtgcccgtgtacctgctgctggacagacagcagctgcccgccttcctggagctggcccagcagctgggcgtgaacccctggaacaccgagaacgtggacgtgagagtggtgagaggctgcagcttccagagcagatggagaagacaggtgagcggcaccgtgagagagaagttcgtgctgctggacggcgagagagtgatcagcggcagctacagcttcacctggagcgacgccagactgcacagaggcctggtgaccctgctgaccggcgagatcgtggacgccttcagcctggagttcagaaccctgtacgccgccagctgccccctgccccccgcccccccccagaagcccagcgtgatcggcggcctgcagagaggcagaagcccccacagagtgagcagaagaagaagcgtggcccccgccagcccccccccccccgacggccccctggcccacagactggccgcctgcagagtgagccccgccacccccggccccgccctgagcgacatcctgagaagcgtgcagagagccagaacccccagcggcccccccgccagacccagcagaagcatgtgggacctgagcagactgagccagctgagcggcagcagcgacggcgacaacgagctgaagaagagctggggcagcaaggacacccccgccaaggccctgatgagacagagaggcaccggcggcggcccctggggcgaggtggacagcagacccccctggggcggcgccctgcccctgccccccgcccacagactgagatacctgagccccgccagaagaagattcggcggcgacgccaccttcaagctgcaggagcccagaggcgtgagacccagcgactgggcccccagagccggcctgggcggccagccctag

SEQ ID NO: 21279 - DNA, 1503 bp, Artificial Sequence
  Description of Artificial Sequence: Synthetic coding sequence
atggccgagagccagctgaactgcctggacgaggcccacgtgaacgagaaggtgaccgaggcccaggccgccttctactactgcgagagaagaagagccgccctggaggccctgctgggcggcggcgagcaggcctacagagagagactgaaggaggagcagctgagagacttcctgagcagccccgagagacaggccctgagagccgcctggagcccctacgaggacgccgtgcccgccgccaacgccagaggcaagagcaaggccaaggccaaggcccccgcccccgcccccgccgagagcggcgagagcctggcctactggcccgacagaagcgacaccgaggtgccccccctggacctgggctggaccgacaccggcttctacagaggcgtgagcagagtgaccctgttcacccacccccccaaggacgagaaggccccccacctgaagcaggtggtgagacagatgatccagcaggcccagaaggtgatcgccgtggtgatggacctgttcaccgacggcgacatcttccaggacatcgtggacgccgcctgcaagagaagagtgcccgtgtacatcatcctggacgaggccggcgtgaagtacttcctggagatgtgccaggacctgcagctgaccgacttcagaatcagaaacatcagagtgagaagcgtgaccggcgtgggcttctacatgcccatgggcagaatcaagggcaccctgagcagcagattcctgatggtggacggcgacaaggtggccaccggcagctacagattcacctggagcagcagccacgtggacagaaacctgctgctgctgctgaccggccagaacgtggagcccttcgacaccgagttcagagagctgtacgccatcagcgaggaggtggacctgtacagacagctgagcctggccggcagagtgggcctgcactacagcagcaccgtggccagaaagctgatcaaccccaagtacgccctggtgagcggctgcagacacccccccggcgagatgatgagatgggccgccagacagcagagagaggccggcggcaaccccgagggccaggaggagggcgccagcggcggcgagagcgcctggagactggagagcttcctgaaggacctggtgaccgtggagcaggtgctgccccccgtggagcccatccccctgggcgagctgagccagaaggacggcagaatggtgagccacatgcacagagacctgaagcccaagagcagagaggcccccagcagaaacggcatgggcgaggccgccagaggcgaggccgcccccgccagaagattcagcagcagactgttcagcagaagagccaagagacccgccgcccccaacggcatggccagcagcgtgagcaccgagaccagcgaggtggagttcctgaccggcaagagacccaacgagaacagcagcgccgacatcagcggcaagaccagccccagcagcgccaagcccagcaactgcgtgatcagctag

SEQ ID NO: 21280 - DNA, 2472 bp, Artificial Sequence
  Description of Artificial Sequence: Synthetic coding sequence
atggccttcagccaggtgcagtgcctggacgacaaccacgtgaactggagaagcagcgagagcaagcccgagttcttctacagcgaggagcagagactggccctggaggccctggtggccagaggcagagacgccttctacgaggtgctgaagagagagaacatcagagacttcctgagcgagctggagctgaagagaatcctggagaccatcgaggtgtacgaccccggcagcgaggaccccagaggcaccggccccagccagggccccgaggacaacggcgtgggcgacggcgaggaggccagcggcgccgacggcgtgcccatcgaggccgagcccctgcccagcctggagtactggccccagaagagcgacagaagcatcccccagctggacctgggctggcccgacaccatcgcctacagaggcgtgaccagagccagcgtgtacatgcagccccccatcgacggccaggcccacatcaaggaggtggtgagaaagatgatcagccaggcccagaaggtgatcgccgtggtgatggacatgttcaccgacgtggacatcttcaaggacctgctggacgccggcttcaagagaaaggtggccgtgtacatcatcgtggacgagagcaacgtgaagtacttcctgcacatgtgcgagagagcctgcatgcacctgggccacctgaagaacctgagagtgagaagcagcggcggcaccgagttcttcaccagaagcgccaccaagttcaagggcgccctggcccagaagttcatgttcgtggacggcgacagagccgtgtgcggcagctacagcttcacctggagcgccgccagaaccgacagaaacgtgatcagcgtgctgagcggccaggtggtggagatgttcgacagacagttccaggagctgtacctgatgagccacagcgtgagcctgaagggcatccccatggagaaggagcccgagcccgagcccatcgtgctgcccagcgtggtgcccctggtgcccgccggcaccgtggccaagaagctggtgaaccccaagtacgccctggtgaaggccaagagcgtggacgagatcgccaagatcagcagcgagaagcaggaggccaagaagcccctgggcctgaagggccccgccctggccgagcaccccggcgagctgcccgagctgctgccccccatccaccccggcctgctgcacctggagagagccaacatgttcgagtacctgcccacctgggtggagcccgaccccgagcccggcagcgacatcctgggctacatcaacatcatcgaccccaacatctggaacccccagcccagccagatgaacagaatcaagatcagagacaccagccaggccagcgcccagcaccagctgtggaagcagagccaggacagcagacccagacccgagccctgccccccccccgagcccagcgccccccaggacggcgtgcccgccgagaacggcctgccccagggcgaccccgagcccctgccccccgtgcccaagcccagaaccgtgcccgtggccgacgtgctggccagagacagcagcgacatcggctgggtgctggagctgcccaaggaggaggccccccagaacggcaccgaccacagactgcccagaatggccggccccggccacgcccccctgcagagacagctgagcgtgacccaggacgaccccgagagcctgggcgtgggcctgcccaacggcctggacggcgtggaggaggaggacgacgacgactacgtgaccctgagcgaccaggacagccacagcggcagcagcggcagaggccccggccccagaagacccagcgtggccagcagcgtgagcgaggagtacttcgaggtgagagagcacagcgtgcccctgagaagaagacacagcgagcaggtggccaacggccccacccccccccccagaagacagctgagcgccccccacatcaccagaggcaccttcgtgggcccccagggcggcagcccctgggcccagagcagaggcagagaggaggccgacgccctgaagagaatgcaggcccagagaagcaccgacaaggaggcccagggccagcagttccaccaccacagagtgcccgccagcggcaccagagacaaggacggcttccccggcccccccagatacagaagcgccgccgacagcgtgcagagcagcaccagaaacgccggccccgccatggccggcccccaccactggcaggccaagggcggccaggtgcccagactgctgcccgaccccggcagccccagactggcccagaacgccagacccatgaccgacggcagagccaccgaggagcaccccagccccttcggcatcccctacagcaagctgagccagagcaagcacctgaaggccagaaccggcggcagccagtgggccagcagcgacagcaagagaagagcccaggcccccagagacagaaaggacccctag

SEQ ID NO: 21281 - DNA, 2472 bp, Artificial Sequence; identical to SEQ ID NO: 21280
  Description of Artificial Sequence: Synthetic coding sequence

SEQ ID NO: 21282 - DNA, 819 bp, Artificial Sequence
  Description of Artificial Sequence: Synthetic coding sequence
atggccttcagccaggtgcagtgcctggacgacaaccacgtgaactggagaagcagcgagagcaagcccgagttcttctacagcgaggagcagagactggccctggaggccctggtggccagaggcagagacgccttctacgaggtgctgaagagagagaacatcagagacttcctgagcgagctggagctgaagagaatcctggagaccatcgaggtgtacgaccccggcagcgaggaccccagaggcaccggccccagccagggccccgaggacaacggcgtgggcgacggcgaggaggccagcggcgccgacggcgtgcccatcgaggccgagcccctgcccagcctggagtactggccccagaagagcgacagaagcatcccccagctggacctgggctggcccgacaccatcgcctacagaggcgtgaccagagccagcgtgtacatgcagccccccatcgacggccaggcccacatcaaggaggtggtgagaaagatgatcagccaggcccagaaggtgatcgccgtggtgatggacatgttcaccgacgtggacatcttcaaggacctgctggacgccggcttcaagagaaaggtggccgtgtacatcatcgtggacgagagcaacgtgaagtacttcctgcacatgtgcgagagagcctgcatgcacctgggccacctgaagaacctgagagtgagaagcagcggcggcaccgagttcttcaccagaagcgccaccaagttcaagggcgccctggcccagaagttcatgttcgtggacggcgacagagccgtgtgcggcagctacagatag

SEQ ID NO: 21283 - DNA, 879 bp, Artificial Sequence
  Description of Artificial Sequence: Synthetic coding sequence
atgggcaaccagctggacagaatcacccacctgaactacagcgagctgcccaccggcgaccccagcggcatcgagaaggacgagctgagagtgggcgtggcctacttcttcagcgacgacgaggaggacctggacgagagaggccagcccgacaagttcggcgtgaaggccccccccggctgcaccccctgccccgagagccccagcagacaccaccaccacctgctgcaccagctggtgctgaacgagacccagttcagcgccttcagaggccaggagtgcatcttcagcaaggtgagcggcggcccccagggcgccgacctgagcgtgtacgccgtgaccgccctgcccgccctgtgcgagcccggcgacctgctggagctgctgtggctgcagcccgcccccgagccccccgcccccgccccccactgggccgtgtacgtgggcggcggccagatcatccacctgcaccagggcgagatcagacaggacagcctgtacgaggccggcgccgccaacgtgggcagagtggtgaacagctggtacagatacagacccctggtggccgagctggtggtgcagaacgcctgcggccacctgggcctgaagagcgaggagatctgctggaccaacagcgagagcttcgccgcctggtgcagattcggcaagagagagttcaaggccggcggcgaggtgcccgccggcacccagcccccccagcagcagtactacctgaaggtgcacctgggcgagaacaaggtgcacaccgccagattccacagcctggaggacctgatcagagagaagagaagaatcgacgccagcggcagactgagagtgctgcaggagctggccgacctggtggacgacaaggagtag

SEQ ID NO: 21284 - DNA, 879 bp, Artificial Sequence; identical to SEQ ID NO: 21283
  Description of Artificial Sequence: Synthetic coding sequence

SEQ ID NO: 21285 - DNA, 1068 bp, Artificial Sequence
  Description of Artificial Sequence: Synthetic coding sequence
atgggcaaccagctggacagaatcacccacctgaactacagcgagctgcccaccggcgaccccagcggcatcgagaaggacgagctgagagtgggcgtggcctacttcttcagcgacgacgaggaggacctggacgagagaggccagcccgacaagttcggcgtgaaggccccccccggctgcaccccctgccccgagagccccagcagacaccaccaccacctgctgcaccagctggtgctgaacgagacccagttcagcgccttcagaggccaggagtgcatcttcagcaaggtgagcggcggcccccagggcgccgacctgagcgtgtacgccgtgaccgccctgcccgccctgtgcgagcccggcgacctgctggagctgctgtggctgcagcccgcccccgagccccccgcccccgccccccactggtgggccagcagagccagaagaagcgccggcagaaccagaagagccagcccccccggcgccgccctggccagcggcagcagcagaagagagggcagatgcagacaggccagaagccccagaagcagcagcaccatcagcagatgcacctgggagagaaccagaagcaccccccccggcttcaccgcctggaagaccagcagcgccagaagcgccgtgagcacccccgccgccgcctgcgagtgcagcagaagcagccccaccagctggaccaccagaagcagcagactgggcgccgccggccccagcgccagccccgcccccagaagcctgcccttccccgcccccggcctgagaagccagagattcagcaccagcgccccccccagacacgccagacccccccccgtggccagagccagagccgcccccccccacccccaggccagcggcagaaagagccaggagctgccccagggcagaaagggcgccgccgccagcgcctggctgaccgccaccgccgtggtgaccgtgctgggcgaccccgcctgcgccttccccctgagatgcaagcccggcaccggcaagggcctgagaggcgagagaacctggcccagccccagagtgcacggccagtag

SEQ ID NO: 21286 - DNA, 594 bp, Artificial Sequence
  Description of Artificial Sequence: Synthetic coding sequence
atgcacctgttccagagcgagagatggcccagcggcagaagacccaagagactgagaggccacagagccgccagcgccctgagaaccagaagacccgccggcgccgccgtggccgccgccagagccggcgccgccagagccagacccgccctgggcagactgagaggcagaagagccgaccacccccccgcccccagaagagacccccccggccagcccgaggccggcgccgccaacgtgggcagagtggtgaacagctggtacagatacagacccctggtggccgagctggtggtgcagaacgcctgcggccacctgggcctgaagagcgaggagatctgctggaccaacagcgagagcttcgccgcctggtgcagattcggcaagagagagttcaaggccggcggcgaggtgcccgccgccgcccccgccgccgccgtgctgagccagggcgcccccggcagagagcagggcccccacagattccacagcctggaggacctgatcagagagaagagatacagaagacagagaccccccgccagcgcccccggcgccagaagacccagaggcagacagggcgtggccgcctag

SEQ ID NO: 21287 - DNA, 993 bp, Artificial Sequence
  Description of Artificial Sequence: Synthetic coding sequence
atggcccccgaggagaacgccggcaccgagctgctgctgcagagcttcgagagaagattcctggccgccagaaccctgagaagcttcccctggcagagcctggaggccaagctgagagacagcagcgacagcgagctgctgagagacatcctgcacaagaccgtgaagcaccccgtgtgcgtgaagcacccccccagcgtgaagtacgccagatgcttcctgagcgagctgatcaagaagcacgaggccgtgcacaccgagcccctggacgagctgtacgaggccctggccgagaccctgatggccaaggagagcacccagggccacagaagctacctgctgcccagcggcggcagcgtgaccctgagcgagagcaccgccatcatcagctacggcaccaccggcctggtgacctgggacgccgccctgtacctggccgagtgggccatcgagaaccccgccgtgttcaccaacagaaccgtgctggagctgggcagcggcgccggcctgaccggcctggccatctgcaagatgtgcagacccagagcctacatcttcagcgactgccacagcagagtgctggagcagctgagaggcaacgtgctgctgaacggcctgagcctggaggccgacatcaccgccaagctggacagccccagagtgaccgtggcccagctggactgggacgtggccaccgtgcaccagctgagcgccttccagcccgacgtggtgatcgccgccgacgtgctgtactgccccgaggccatcatgagcctggtgggcgtgctgagaagactggccgcctgcagagagcaccagagagcccccgaggtgtacgtggccttcaccgtgagaaaccccgagacctgccagctgttcaccaccgagctgggcagagccggcatcagatgggaggtggagcccagacacgagcagaagctgttcccctacgaggagcacctggagatggccatgctgaacctgaccctgtag

SEQ ID NO: 21288 - DNA, 891 bp, Artificial Sequence
  Description of Artificial Sequence: Synthetic coding sequence
atggcccccgaggagaacgccggcaccgagctgctgctgcagagcttcgagagaagattcctggccgccagaaccctgagaagcttcccctggcagagcctggaggccaagctgagagacagcagcgacagcgagctgctgagagacatcctgcacaagaccgtgaagcaccccgtgtgcgtgaagcacccccccagcgtgaagtacgccagatgcttcctgagcgagctgatcaagaagcccagcggcggcagcgtgaccctgagcgagagcaccgccatcatcagctacggcaccaccggcctggtgacctgggacgccgccctgtacctggccgagtgggccatcgagaaccccgccgtgttcaccaacagaaccgtgctggagctgggcagcggcgccggcctgaccggcctggccatctgcaagatgtgcagacccagagcctacatcttcagcgactgccacagcagagtgctggagcagctgagaggcaacgtgctgctgaacggcctgagcctggaggccgacatcaccgccaagctggacagccccagagtgaccgtggcccagctggactgggacgtggccaccgtgcaccagctgagcgccttccagcccgacgtggtgatcgccgccgacgtgctgtactgccccgaggccatcatgagcctggtgggcgtgctgagaagactggccgcctgcagagagcaccagagagcccccgaggtgtacgtggccttcaccgtgagaaaccccgagacctgccagctgttcaccaccgagctgggcagagccggcatcagatgggaggtggagcccagacacgagcagaagctgttcccctacgaggagcacctggagatggccatgctgaacctgaccctgtag

SEQ ID NO: 21289 - DNA, 390 bp, Artificial Sequence
  Description of Artificial Sequence: Synthetic coding sequence
atgccccccagcaccctgcagaacggccccagcagaaccagacagcccagcctgaccgacgtgctgtactgccccgaggccatcgtgagcctggtgggcgtgctgcagagactggccgcctgcagagagcacaagagagcccccgaggtgtacgtggccttcaccgtgagaaaccccgagacctgccagctgttcaccaccgagctgggcgagccccccagaccccccggccccacctggtgccccagctgcccctgcagaacccccgtggaggtgaaggagctgggcgccggcgagaagctgggctgcagcaccctgccccactacgccggcaacagcggcagaggcagacccggctgggaccagatgggcagcggcagcagcagctag

SEQ ID NO: 21290 - DNA, 462 bp, Artificial Sequence
  Description of Artificial Sequence: Synthetic coding sequence
atggcccccgaggagaacgccggcaccgagctgctgctgcagggcttcgagagaagattcctggccgtgagaaccctgagaagcttcccctggcagagcctggaggccaagctgagagacagcagcgacagcgagctgctgagagacatcctgcagaagaccgtgagacaccccgtgtgcgtgaagcacccccccagcgtgaagtacgcctggtgcttcctgagcgagctgatcaagaagagcagcggcggcagcgtgaccctgagcaagagcaccgccatcatcagccacggcaccaccggcctggtgacctgggacgccgccctgtacctggccgagtgggccatcgagaaccccgccgccttcatcaacagaagagccgtgctgcccagaagccacagagtggccggcagaggccccgccgaggccggctgcctgcccggcgcccaggccggcagctag

SEQ ID NO: 21291 - DNA, 993 bp, Artificial Sequence
  Description of Artificial Sequence: Synthetic coding sequence
atggcccccgaggagaacgccggcaccgagctgctgctgcagggcttcgagagaagattcctggccgtgagaaccctgagaagcttcccctggcagagcctggaggccaagctgagagacagcagcgacagcgagctgctgagagacatcctgcagaagaccgtgagacaccccgtgtgcgtgaagcacccccccagcgtgaagtacgcctggtgcttcctgagcgagctgatcaagaagcacgaggccgtgcacaccgagcccctggacaagctgtacgaggtgctgaccgagaccctgatggccaaggagagcacccagggccacagaagctacctgctgagcagcggcggcagcgtgaccctgagcaagagcaccgccatcatcagccacggcaccaccggcctggtgacctgggacgccgccctgtacctggccgagtgggccatcgagaaccccgccgccttcatcaacagaaccgtgctggagctgggcagcggcgccggcctgaccggcctggccatctgcaagatgtgcagacccagagcctacatcttcagcgacccccacagcagagtgctggagcagctgagaggcaacgtgctgctgaacggcctgagcctggaggccgacatcaccggcaacctggacagccccagagtgaccgtggcccagctggactgggacgtggccatggtgcaccagctgagcgccttccagcccgacgtggtgatcgccgccgacgtgctgtactgccccgaggccatcgtgagcctggtgggcgtgctgcagagactggccgcctgcagagagcacaagagagcccccgaggtgtacgtggccttcaccgtgagaaaccccgagacctgccagctgttcaccaccgagctgggcagagacggcatcagatgggaggccgaggcccaccacgaccagaagctgttcccctacggcgagcacctggagatggccatgctgaacctgaccctgtag

SEQ ID NO: 21292 - DNA, 891 bp, Artificial Sequence
  Description of Artificial Sequence: Synthetic coding sequence
atggcccccgaggagaacgccggcaccgagctgctgctgcagggcttcgagagaagattcctggccgtgagaaccctgagaagcttcccctggcagagcctggaggccaagctgagagacagcagcgacagcgagctgctgagagacatcctgcagaagaccgtgagacaccccgtgtgcgtgaagcacccccccagcgtgaagtacgcctggtgcttcctgagcgagctgatcaagaagagcagcggcggcagcgtgaccctgagcaagagcaccgccatcatcagccacggcaccaccggcctggtgacctgggacgccgccctgtacctggccgagtgggccatcgagaaccccgccgccttcatcaacagaaccgtgctggagctgggcagcggcgccggcctgaccggcctggccatctgcaagatgtgcagacccagagcctacatcttcagcgacccccacagcagagtgctggagcagctgagaggcaacgtgctgctgaacggcctgagcctggaggccgacatcaccggcaacctggacagccccagagtgaccgtggcccagctggactgggacgtggccatggtgcaccagctgagcgccttccagcccgacgtggtgatcgccgccgacgtgctgtactgccccgaggccatcgtgagcctggtgggcgtgctgcagagactggccgcctgcagagagcacaagagagcccccgaggtgtacgtggccttcaccgtgagaaaccccgagacctgccagctgttcaccaccgagctgggcagagacggcatcagatgggaggccgaggcccaccacgaccagaagctgttcccctacggcgagcacctggagatggccatgctgaacctgaccctgtag

SEQ ID NO: 21293 - DNA, 462 bp, Artificial Sequence; identical to SEQ ID NO: 21290
  Description of Artificial Sequence: Synthetic coding sequence

SEQ ID NO: 21294 - DNA, 993 bp, Artificial Sequence
  Description of Artificial Sequence: Synthetic coding sequence
atggcccccgaggagaacgccggcaccgagctgctgctgcagggcttcgagagaagattcctggccgtgagaaccctgagaagcttcccctggcagagcctggaggccaagctgagagacagcagcgacagcgagctgctgagagacatcctgcagaagaccgtgagacaccccgtgtgcgtgaagcacccccccagcgtgaagtacgcctggtgcttcctgagcgagctgatcaagaagcacgaggccgtgcacaccgagcccctggacaagctgtacgaggtgctggccgagaccctgatggccaaggagagcacccagggccacagaagctacctgctgagcagcggcggcagcgtgaccctgagcaagagcaccgccatcatcagccacggcaccaccggcctggtgacctgggacgccgccctgtacctggccgagtgggccatcgagaaccccgccgccttcatcaacagaaccgtgctggagctgggcagcggcgccggcctgaccggcctggccatctgcaagatgtgcagacccagagcctacatcttcagcgacccccacagcagaatcctggagcagctgagaggcaacgtgctgctgaacggcctgagcctggaggccgacatcaccggcaacctggacagccccagagtgaccgtggcccagctggactgggacgtggccatggtgcaccagctgagcgccttccagcccgacgtggtgatcgccgccgacgtgctgtactgccccgaggccatcgtgagcctggtgggcgtgctgcagagactggccgcctgcagagagcacaagagagcccccgaggtgtacgtggccttcaccgtgagaaaccccgagacctgccagctgttcaccaccgagctgggcagagacggcatcagatgggaggccgaggcccaccacgaccagaagctgttcccctacggcgagcacctggagatggccatgctgaacctgaccctgtag

SEQ ID NO: 21295 - DNA, 462 bp, Artificial Sequence; identical to SEQ ID NO: 21290
  Description of Artificial Sequence: Synthetic coding sequence

SEQ ID NO: 21296 - DNA, 891 bp, Artificial Sequence
  Description of Artificial Sequence: Synthetic coding sequence
atggcccccgaggagaacgccggcaccgagctgctgctgcagggcttcgagagaagattcctggccgtgagaaccctgagaagcttcccctggcagagcctggaggccaagctgagagacagcagcgacagcgagctgctgagagacatcctgcagaagaccgtgagacaccccgtgtgcgtgaagcacccccccagcgtgaagtacgcctggtgcttcctgagcgagctgatcaagaagagcagcggcggcagcgtgaccctgagcaagagcaccgccatcatcagccacggcaccaccggcctggtgacctgggacgccgccctgtacctggccgagtgggccatcgagaaccccgccgccttcatcaacagaaccgtgctggagctgggcagcggcgccggcctgaccggcctggccatctgcaagatgtgcagacccagagcctacatcttcagcgacccccacagcagaatcctggagcagctgagaggcaacgtgctgctgaacggcctgagcctggaggccgacatcaccggcaacctggacagccccagagtgaccgtggcccagctggactgggacgtggccatggtgcaccagctgagcgccttccagcccgacgtggtgatcgccgccgacgtgctgtactgccccgaggccatcgtgagcctggtgggcgtgctgcagagactggccgcctgcagagagcacaagagagcccccgaggtgtacgtggccttcaccgtgagaaaccccgagacctgccagctgttcaccaccgagctgggcagagacggcatcagatgggaggccgaggcccaccacgaccagaagctgttcccctacggcgagcacctggagatggccatgctgaacctgaccctgtag

SEQ ID NO: 21297 - DNA, 390 bp, Artificial Sequence; identical to SEQ ID NO: 21289
  Description of Artificial Sequence: Synthetic coding sequence

SEQ ID NO: 21298 - DNA, 888 bp, Artificial Sequence
  Description of Artificial Sequence: Synthetic coding sequence
atggcccccgaggagaacgccggcaccgagctgctgctgcagggcttcgagagaagattcctggccgtgagaaccctgagaagcttcccctggcagagcctggaggccaagctgagagacagcagcgacagcgagctgctgagagacatcctgcagaagaccgtgagacaccccgtgtgcgtgaagcacccccccagcgtgaagtacgcctggtgcttcctgagcgagctgatcaagaagagcagcggcggcagcgtgaccctgagcaagagcaccgccatcatcagccacggcaccaccggcctggtgacctgggacgccgccctgtacctggccgagtgggccatcgagaaccccgccgccttcatcaacagaaccgtgctggagctgggcagcggcgccggcctgaccggcctggccatctgcaagatgtgcagacccagagcctacatcttcagcgacccccacagcagaatcctggagcagctgagaggcaacgtgctgctgaacggcctgagcctggaggccgacatcaccggcaacctggacagccccagagtgaccgtggcccagctggactgggacgtggccatggtgcaccagctgagcgccttccagcccgacgtggtgatcgccgccgacgtgctgtactgccccgaggccatcgtgagcctggtgggcgtgctgcagagactggccgcctgcagagagcacaagagagcccccgaggtgtacgtggccttcaccgtgagaaaccccgagacctgccagctgttcaccaccgagctgggcagagacggcatcagatgggaggccgaggcccaccacgaccagaagctgttcccctacggcgagcacctggagatggccatgctgaacctgacctag

SEQ ID NO: 21299 - DNA, 450 bp, Artificial Sequence
  Description of Artificial Sequence: Synthetic coding sequence
atggcccccgaggagaacgccggcaccgagctgctgctgcagggcttcgagagaagattcctggccgtgagaaccctgagaagcttcccctggcagagcctggaggccaagctgagagacagcagcgacagcgagctgctgagagacatcctgcagaagaccgtgagacaccccgtgtgcgtgaagcacccccccagcgtgaagtacgcctggtgcttcctgagcgagctgatcaagaagagcagcggcggcagcgtgaccctgagcaagagcaccgccatcatcagccacggcaccaccggcctggtgacctgggacgccgccctgtacctggccgagtgggccatcgagaaccccgccgccttcatcaacagaagagccgtgctgcccagaagccacagagtggccggcagaggccccgccgaggccggctgcctgcccggcgcctag

SEQ ID NO: 21300 - DNA, 396 bp, Artificial Sequence
  Description of Artificial Sequence: Synthetic coding sequence
atggcccccgaggagaacgccggcagcgagctgctgctgcagagcttcaagagaagattcctggccgccagagccctgagaagcttcagatggcagagcctggaggccaagctgagagacagcagcgacagcgagctgctgagagacatcctgcagaagacctgctgcatcgcccagaagcccagctgcagatggagcggcagctgcggcggctggctgcccgccggcagcaccagcggcctgctgaacagcacctggcccctgcccagcgccacccagagatgcgccagctgcagcccccccagctacgccggcctgggcagcgacggcaagagaaagctgatcatgaccagaaactgcttccccaccgagagcacctggagatggcagagctag

SEQ ID NO: 21301 - DNA, 498 bp, Artificial Sequence
  Description of Artificial Sequence: Synthetic coding sequence
atggcccccgaggagaacgccggcagcgagctgctgctgcagagcttcaagagaagattcctggccgccagagccctgagaagcttcagatggcagagcctggaggccaagctgagagacagcagcgacagcgagctgctgagagacatcctgcagaagcacgaggccgtgcacaccgagcccctggacgagctgtacgaggtgctggtggagaccctgatggccaaggagagcacccagggccacagaagctacctgctgacctgctgcatcgcccagaagcccagctgcagatggagcggcagctgcggcggctggctgcccgccggcagcaccagcggcctgctgaacagcacctggcccctgcccagcgccacccagagatgcgccagctgcagcccccccagctacgccggcctgggcagcgacggcaagagaaagctgatcatgaccagaaactgcttccccaccgagagcacctggagatggcagagctag

SEQ ID NO: 21302 - DNA, 477 bp, Artificial Sequence
  Description of Artificial Sequence: Synthetic coding sequence
atggcccccgaggagaacgccggcagcgagctgctgctgcagagcttcaagagaagattcctggccgccagagccctgagaagcttcagatggcagagcctggaggccaagctgagagacagcagcgacagcgagctgctgagagacatcctgcagaagaccgtgaagcaccccgtgtgcgtgaagcacccccccagcgtgaagtacgccagatgcttcctgagcgagctgatcaagaagacctgctgcatcgcccagaagcccagctgcagatggagcggcagctgcggcggctggctgcccgccggcagcaccagcggcctgctgaacagcacctggcccctgcccagcgccacccagagatgcgccagctgcagcccccccagctacgccggcctgggcagcgacggcaagagaaagctgatcatgaccagaaactgcttccccaccgagagcacctggagatggcagagctag

SEQ ID NO: 21303 - DNA, 555 bp, Artificial Sequence
  Description of Artificial Sequence: Synthetic coding sequence
atgagcggcgccagagccgcccccggcgccgccggcaacggcgccgtgagaggcctgagagtggacggcctgccccccctgcccaagagcctgagcggcctgctgcacagcgccagcggcggcggcgccagcggcggctggagacacctggagagactgtacgcccagaagagcagaatccaggacgagctgagcagaggcggccccggcggcggcggcgccagagccgccgccctgcccgccaagccccccaacctggacgccgccctggccctgctgagaaaggagatggtgggcctgagacagctggacatgagcctgctgtgccagctgtacagcctgtacgagagcatccaggagtacaagggcgcctgccaggccgccagcagccccgactgcacctacgccctggagaacggcttcttcgacgaggaggaggagtacttccaggagcagaacagcctgcacgacagaagagacagaggcccccccagagacctgagcctgcccgtgagcagcctgagcagcagcgactggatcctggagagcatctag

SEQ ID NO: 21304 - DNA, 531 bp, Artificial Sequence
  Description of Artificial Sequence: Synthetic coding sequence
atgaacggcctgcccagcgccgaggcccccggcggcgccggctgcgccctggccggcctgccccccctgcccagaggcctgagcggcctgctgaacgccagcggcggcagctggagagagctggagagagtgtacagccagagaagcagaatccacgacgagctgagcagagccgccagagcccccgacggccccagacacgccgccggcgccgccaacgccggccccgccgccggccccagaagacccgtgaacctggacagcgccctggccgccctgagaaaggagatgctgtggggcctgtacgagagcatccaggactacaagcacctgtgccaggacctgagcttctgccaggacctgagcagcagcctgcacagcgacagcagctacccccccgacgccggcctgagcgacgacgaggagccccccgacgccagcctgccccccgaccccccccccctgaccgtgccccagacccacaacgccagagaccagtggctgcaggacgccttccacatcagcctgtag

SEQ ID NO: 21305 - DNA, 489 bp, Artificial Sequence
  Description of Artificial Sequence: Synthetic coding sequence
atgaacggcctgcccagcgccgaggcccccggcggcgccggctgcgccctggccggcctgccccccctgcccagaggcctgagcggcctgctgaacgccagcggcggcagctggagagagctggagagagtgtacagccagagaagcagagtggtgctgagcaccagcacccagagatggcccagatgcgccagaagatgctgcctgcaggtgggcctgagacagctggacatgagcctgctgtgccagctgtggggcctgtacgagagcatccaggactacaagcacctgtgccaggacctgagcttctgccaggacctgagcagcagcctgcacagcgacagcagctacccccccgacgccggcctgagcgacgacgaggagccccccgacgccagcctgccccccgaccccccccccctgaccgtgccccagacccacaacgccagagaccagtggctgcaggacgccttccacatcagcctgtag

SEQ ID NO: 21306 - DNA, 465 bp, Artificial Sequence
  Description of Artificial Sequence: Synthetic coding sequence
atgaacggcctgcccagcgccgaggcccccggcggcgccggctgcgccctggccggcctgccccccctgcccagaggcctgagcggcctgctgaacgccagcggcggcagctggagagagctggagagagtgtacagccagagaagcagaatccacgacgagctgagcagagccgccagagcccccgacggccccagacacgccgccggcgccgccaacgccggccccgccgccggccccagaagacccgtgaacctggacagcgccctggccgccctgagaaaggagatgctgagcgccggcggcgccgccgccgtgggccacgtgctggtggtgcccgccgtgggccccgtgagagtgaaccccggcctgcagacccccgtgcccagacccgagctgctgcccggccccgtgatcctgccccccttcggccagctgctgcccaccggctgcggccccgtgtag

SEQ ID NO: 21307 - DNA, 570 bp, Artificial Sequence
  Description of Artificial Sequence: Synthetic coding sequence
atgaacggcctgcccagcgccgaggcccccggcggcgccggctgcgccctggccggcctgccccccctgcccagaggcctgagcggcctgctgaacgccagcggcggcagctggagagagctggagagagtgtacagccagagaagcagaatccacgacgagctgagcagagccgccagagcccccgacggccccagacacgccgccggcgccgccaacgccggccccgccgccggccccagaagacccgtgaacctggacagcgccctggccgccctgagaaaggagatggtgggcctgagacagctggacatgagcctgctgtgccagctgtggggcctgtacgagagcatccaggactacaagcacctgtgccaggacctgagcttctgccaggacctgagcagcagcctgcacagcgacagcagctacccccccgacgccggcctgagcgacgacgaggagccccccgacgccagcctgccccccgaccccccccccctgaccgtgccccagacccacaacgccagagaccagtggctgcaggacgccttccacatcagcctgtag

SEQ ID NO: 21308 - DNA, 2517 bp, Artificial Sequence
  Description of Artificial Sequence: Synthetic coding sequence
atgaacatcgacgtggagttccacatcagacacaactacccctggaacaagctgcccgccaacgtgagacagagcctgggcaacagccagagagagtacgagaagcaggtggtgctgtacagcatcagaaaccagctgagatacagaaacaacctggtgaagcacgtgaagaaggacgagagaagatactacgaggagctgctgaagtacagcagagaccacctgatgctgtacccctaccacctgagcgacatcatggtgaagggcctgagaatcacccccttcagctactacaccggcatcatggaggacatcatgaacagcgagaagagctacgacagcctgcccaacttcaccgccgccgactgcctgagactgctgggcatcggcagaaaccagtacatcgacctgatgaaccagtgcagaagcagcaagaagttcttcagaagaaagaccgccagagacctgctgcccatcaagcccgtggagatcgccatcgaggcctggtgggtggtgcaggccggctacatcaccgaggacgacatcaagatctgcaccctgcccgagaagtgcgccgtggacaagatcatcgacagcggcccccagctgagcggcagcctggactacaacgtggtgcacagcctgtacaacaagggcttcatctacctggacgtgcccatcagcgacgacagctgcatcgccgtgccccccctggagggcttcgtgatgaacagagtgcagggcgactacttcgagaccctgctgtacaagatcttcgtgagcatcgacgagcacaccaacgtggccgagctggccaacgtgctggagatcgacctgagcctggtgaagaacgccgtgagcatgtactgcagactgggcttcgcccacaagaagggccaggtgatcaacctggaccagctgcacagcagctggaagaacgtgcccagcgtgaacagactgaagagcaccctggacccccagaagatgctgctgagctgggacggcggcgagagcagaagccccgtgcaggaggccagcagcgccaccgacaccgacaccaacagccaggaggaccccgccgacaccgccagcgtgagcagcctgagcctgagcaccggccacaccaagagaatcgccttcctgttcgacagcaccctgaccgccttcctgatgatgggcaacctgagccccaacctgaagagccacgccgtgaccatgttcgaggtgggcaagctgagcgacgagagcctggacagcttcctgatcgagctggagaaggtgcagagcaccggcgagggcgaggcccagagatacttcgaccacgccctgaccctgagaaacaccatcctgttcctgagacacaacaaggacctggtggcccagaccgcccagcccgaccagcccaactacggcttccccctggacctgctgagatgcgagagcctgctgggcctggaccccgccacctgcagcagagtgctgaacaagaactacaccctgctggtgagcatggcccccctgaccaacgagatcagacccgtgagcagctgcaccccccagcacatcggccccgccatccccgaggtgagcagcgtgtggttcaagctgtacatctaccacgtgaccggccagggcccccccagcctgctgctgagcaagggcaccagactgagaaagctgcccgacatcttccagagctacgacagactgctgatcaccagctggggccacgaccccggcgtggtgcccaccagcaacgtgctgaccatgctgaacgacgccctgacccacagcgccgtgctgatccagggccacggcctgcacggcatcggcgagaccgtgcacgtgcccttccccttcgacgagaccgagctgcagggcgagttcaccagagtgaacatgggcgtgcacaaggccctgcagatcctgagaaacagagtggacctgcagcacctgtgcggctacgtgaccatgctgaacgccagcagccagctggccgacagaaagctgagcgacgccagcgacgagagaggcgagcccgacctggccagcggcagcgacgtgaacggcagcaccgagagcttcgagatggtgatcgaggaggccaccatcgacagcgccaccaagcagaccagcggcgccaccaccgaggccgactgggtgcccctggagctgtgcttcggcatccccctgttcagcagcgagctgaacagaaaggtgtgcagaaagatcgccgcccacggcctgtgcagaaaggagagcctgcagaacctgctgcacagcagcagaaagctgagcctgcaggtgctgaacttcgtgcacagcttccaggagggcgccagcatcctggacatccacaccgagcccagcttcagcagcctgctgagccagagcagctgcgccgacatgggcgtgcccctgcccgccaagaacctgatcttcaaggacggcgtgctgagcgagtggagcggcagaagccccagcagcctgctgatcgccaacctgcacctgcagtag

SEQ ID NO: 21309 - DNA, 276 bp, Artificial Sequence
  Description of Artificial Sequence: Synthetic coding sequence
atgaacatcgacgtggagttccacatcagacacaactacccctggaacaagctgcccgccaacgtgagacagagcctgggcaacagccagagagagtacgagaagcaggtggtgctgtacagcatcagaaaccagctgagatacagaaacaacctggtgaagcacgtgaagaaggacgagagaagatactacgaggagctgctgaagtacagcagagaccacctgatgctgtacccctaccacctgagcgacagcgtgtgctacgtgtgcctgtag

SEQ ID NO: 21310 - DNA, 819 bp, Artificial Sequence
  Description of Artificial Sequence: Synthetic coding sequence
atgatgagaagaaccctggagaacagaaacgcccagaccaagcagctgcagaccgccgtgagcaacgtggagaagcacttcggcgagctgtgccagatcttcgccgcctacgtgagaaagaccgccagactgagagacaaggccgacctgctggtgaacgagatcaacgcctacgccgccaccgagaccccccacctgaagctgggcctgatgaacttcgccgacgagttcgccaagctgcaggactacagacaggccgaggtggagagactggaggccaaggtggtggagcccctgaagacctacggcaccatcgtgaagatgaagagagacgacctgaaggccaccctgaccgccagaaacagagaggccaagcagctgacccagctggagagaaccagacagagaaaccccagcgacagacacgtgatcgcccaggccgagaccgagctgcagagagccgccatggacgccagcagaaccagcagacacctggaggagaccatcaacaacttcgagagacagaagatgaaggacatcaagaccatcttcagcgagttcatcaccatcgagatgctgttccacggcaaggccctggaggtgtacaccgccgcctaccagaacatccagaacatcgacgaggacgaggacctggaggtgttcagaaacagcctgtacgcccccgactacagcagcagactggacatcgtgagagccaacagcaagagccccctgcagagaagcctgagcgccaagtgcgtgagcggcaccggccagcaggaggccggctgggccgccacctgccagaccctgatctag

SEQ ID NO: 21311 - DNA, 756 bp, Artificial Sequence
  Description of Artificial Sequence: Synthetic coding sequence
atgatgagaagaaccctggagaacagaaacgcccagaccaagcagctgcagaccgccgtgagcaacgtggagaagcacttcggcgagctgtgccagatcttcgccgcctacgtgagaaagaccgccagactgagagacaaggccgacctgctggtgaacgagatcaacgcctacgccgccaccgagaccccccacctgaagctgggcctgatgaacttcgccgacgagttcgccaagctgcaggactacagacaggccgaggtggagagactggaggccaaggtggtggagcccctgaagacctacggcaccatcgtgaagatgaagagagacgacctgaaggccaccctgaccgccagaaacagagaggccaagcagctgacccagctggagagaaccagacagagaaaccccagcgacagacacgtgatcgcccaggccgagaccgagctgcagagagccgccatggacgccagcagaaccagcagacacctggaggagaccatcaacaacttcgagagacagaagatgaaggacatcaaggtgttcagaaacagcctgtacgcccccgactacagcagcagactggacatcgtgagagccaacagcaagagccccctgcagagaagcctgagcgccaagtgcgtgagcggcaccggccaggtgagcacctgcagactgagaaaggaccagcaggccgaggacgacgaggacgacgagctggacgtgaccgaggaggagaacttcctgaagtag

SEQ ID NO: 21312 - DNA, 870 bp, Artificial Sequence
  Description of Artificial Sequence: Synthetic coding sequence
atgatgagaagaaccctggagaacagaaacgcccagaccaagcagctgcagaccgccgtgagcaacgtggagaagcacttcggcgagctgtgccagatcttcgccgcctacgtgagaaagaccgccagactgagagacaaggccgacctgctggtgaacgagatcaacgcctacgccgccaccgagaccccccacctgaagctgggcctgatgaacttcgccgacgagttcgccaagctgcaggactacagacaggccgaggtggagagactggaggccaaggtggtggagcccctgaagacctacggcaccatcgtgaagatgaagagagacgacctgaaggccaccctgaccgccagaaacagagaggccaagcagctgacccagctggagagaaccagacagagaaaccccagcgacagacacgtgatcagccaggccgagaccgagctgcagagagccgccatggacgccagcagaaccagcagacacctggaggagaccatcaacaacttcgagagacagaagatgaaggacatcaagaccatcttcagcgagttcatcaccatcgagatgctgttccacggcaaggccctggaggtgtacaccgccgcctaccagaacatccagaacatcgacgaggacgaggacctggaggtgttcagaaacagcctgtacgcccccgactacagcagcagactggacatcgtgagagccaacagcaagagccccctgcagagaagcctgagcgccaagtgcgtgagcggcaccggccaggtgagcacctgcagactgagaaaggaccagcaggccgaggacgacgaggacgacgagctggacgtgaccgaggaggagaacttcctgaagtag

SEQ ID NO: 21313 - DNA, 789 bp, Artificial Sequence
  Description of Artificial Sequence: Synthetic coding sequence
atgatgagaagaaccctggagaacagaaacgcccagaccaagcagctgcagaccgccgtgagcaacgtggagaagcacttcggcgagctgtgccagatcttcgccgcctacgtgagaaagaccgccagactgagagacaaggccgacctgctggtgaacgagatcaacgcctacgccgccaccgagaccccccacctgaagctgggcctgatgaacttcgccgacgagttcgccaagctgcaggactacagacaggccgaggtggagagactggaggccaaggtggtggagcccctgaagacctacggcaccatcgtgaagatgaagagagacgacctgaaggccaccctgaccgccagaaacagagaggccaagcagctgacccagctggagagaaccagacagagaaaccccagcgacagacacgtgatcgcccaggccgagaccgagctgcagagagccgccatggacgccagcagaaccagcagacacctggaggagaccatcaacaacttcgagagacagaagatgaaggacatcaagaccatcttcagcgagttcatcaccatcgagatgctgttccacggcaaggccctggaggtgtacaccgccgcctaccagaacatccagaacatcgacgaggacgaggacctggagagatggagcttcgccatgctgcccagactggtgctgaacagctggggcagcagcgacccccccgccctggccagccagagcgtgagattcagcgagatcctgtgcatgcaccagatcatccacctggtgtag

SEQ ID NO: 21314 - DNA, 309 bp, Artificial Sequence
  Description of Artificial Sequence: Synthetic coding sequence
atgcagagagtgagcggcctgctgagctggaccctgagcagagtgctgtggctgagcggcctgagcgagcccggcgccgccagacagcccagaatcatggaggagaaggccctggaggtgtacgacctgatcagaaccatcagagaccccgagaagcccaacaccctggaggagctggaggtggtgagcgagagctgcgtggaggtgcaggagatcaacgaggaggagtacctggtgatcatcagattcacccccaccgtgccccactgcagcctggccaccctgatcgtgggcaacctgcacttctag

SEQ ID NO: 21315 - DNA, 483 bp, Artificial Sequence
  Description of Artificial Sequence: Synthetic coding sequence
atgcagagagtgagcggcctgctgagctggaccctgagcagagtgctgtggctgagcggcctgagcgagcccggcgccgccagacagcccagaatcatggaggagaaggccctggaggtgtacgacctgatcagaaccatcagagaccccgagaagcccaacaccctggaggagctggaggtggtgagcgagagctgcgtggaggtgcaggagatcaacgaggaggagtacctggtgatcatcagattcacccccaccgtgccccactgcagcctggccaccctgatcggcctgtgcctgagagtgaagctgcagagatgcctgcccttcaagcacaagctggagatctacatcagcgagggcacccacagcaccgaggaggacatcaacaagcagatcaacgacaaggagagagtggccgccgccatggagaaccccaacctgagagagatcgtggagcagtgcgtgctggagcccgactag

SEQ ID NO: 21316 - DNA, 309 bp, Artificial Sequence; identical to SEQ ID NO: 21314
  Description of Artificial Sequence: Synthetic coding sequence

SEQ ID NO: 21317 - DNA, 1557 bp, Artificial Sequence
  Description of Artificial Sequence: Synthetic coding sequence
atggagtgcgacctgatggagaccgacatcctggagagcctggaggacctgggctacaagggccccctgctggaggacggcgccctgagccaggccgtgagcgccggcgccagcagccccgagttcaccaagctgtgcgcctggctggtgagcgagctgagagtgctgtgcaagctggaggagaacgtgcaggccaccaacagccccagcgaggccgaggagttccagctggaggtgagcggcctgctgggcgagatgaactgcccctacctgagcctgaccagcggcgacgtgaccaagagactgctgatccagaagaactgcctgctgctgctgacctacctgatcagcgagctggaggccgccagaatgctgtgcgtgaacgccccccccaagaaggcccaggagggcggcggcagcgaggtgttccaggagctgaagggcatctgcatcgccctgggcatgagcaagccccccgccaacatcaccatgttccagttcttcagcggcatcgagaagaagctgaaggagaccctggccaaggtgccccccaaccacgtgggcaagcccctgctgaagaagcccatgggccccgcccactgggagaagatcgaggccatcaaccaggccatcgccaacgagtacgaggtgagaagaaagctgctgatcaagagactggacgtgaccgtgcagagcttcggctggagcgacagagccaagagccagaccgagaagctggccaaggtgtaccagcccaagagaagcgtgctgagccccaagaccaccatcagcgtggcccacctgctggccgccagacaggacctgagcaagatcctgagaaccagcagcggcagcatcagagagaagaccgcctgcgccatcaacaaggtgctgatgggcagagtgcccgacagaggcggcagacccaacgagatcgagccccccccccccgagatgcccccctggcagaagagacaggacggcccccagcagcagaccggcggcagaggcggcggcagaggcggctacgagcacagcagctacggcggcagaggcggccacgagcagggcggcggcagaggcggcagaggcggctacgaccacggcggcagaggcggcggcagaggcaacaagcaccagggcggctggaccgacggcggcagcggcggcggcggcggctaccaggacggcggctacagagacagcggcttccagcccggcggctaccacggcggccacagcagcggcggctaccagggcggcggctacggcggcttccagaccagcagcagctacaccggcagcggctaccagggcggcggctaccagcaggacaacagataccaggacggcggccaccacggcgacagaggcggcggcagaggcggcagaggcggcagaggcggcagaggcggcagagccggccagggcggcggctggggcggcagaggcagccagaactaccaccagggcggccagttcgagcagcacttccagcacggcggctaccagtacaaccacagcggcttcggccagggcagacactacaccagctag

SEQ ID NO: 21318 - DNA, 1560 bp, Artificial Sequence
  Description of Artificial Sequence: Synthetic coding sequence
atggagtgcgacctgatggagaccgacatcctggagagcctggaggacctgggctacaagggccccctgctggaggacggcgccctgagccaggccgtgagcgccggcgccagcagccccgagttcaccaagctgtgcgcctggctggtgagcgagctgagagtgctgtgcaagctggaggagaacgtgcaggccaccaacagccccagcgaggccgaggagttccagctggaggtgagcggcctgctgggcgagatgaactgcccctacctgagcctgaccagcggcgacgtgaccaagagactgctgatccagaagaactgcctgctgctgctgacctacctgatcagcgagctggaggccgccagaatgctgtgcgtgaacgccccccccaagaaggcccaggagggcggcggcagcgaggtgttccaggagctgaagggcatctgcatcgccctgggcatgagcaagccccccgccaacatcaccatgttccagttcttcagcggcatcgagaagaagaagctgaaggagaccctggccaaggtgccccccaaccacgtgggcaagcccctgctgaagaagcccatgggccccgcccactgggagaagatcgaggccatcaaccaggccatcgccaacgagtacgaggtgagaagaaagctgctgatcaagagactggacgtgaccgtgcagagcttcggctggagcgacagagccaagagccagaccgagaagctggccaaggtgtaccagcccaagagaagcgtgctgagccccaagaccaccatcagcgtggcccacctgctggccgccagacaggacctgagcaagatcctgagaaccagcagcggcagcatcagagagaagaccgcctgcgccatcaacaaggtgctgatgggcagagtgcccgacagaggcggcagacccaacgagatcgagccccccccccccgagatgcccccctggcagaagagacaggacggcccccagcagcagaccggcggcagaggcggcggcagaggcggctacgagcacagcagctacggcggcagaggcggccacgagcagggcggcggcagaggcggcagaggcggctacgaccacggcggcagaggcggcggcagaggcaacaagcaccagggcggctggaccgacggcggcagcggcggcggcggcggctaccaggacggcggctacagagacagcggcttccagcccggcggctaccacggcggccacagcagcggcggctaccagggcggcggctacggcggcttccagaccagcagcagctacaccggcagcggctaccagggcggcggctaccagcaggacaacagataccaggacggcggccaccacggcgacagaggcggcggcagaggcggcagaggcggcagaggcggcagaggcggcagagccggccagggcggcggctggggcggcagaggcagccagaactaccaccagggcggccagttcgagcagcacttccagcacggcggctaccagtacaaccacagcggcttcggccagggcagacactacaccagctag

SEQ ID NO: 21319 - DNA, 972 bp, Artificial Sequence
  Description of Artificial Sequence: Synthetic coding sequence
atgggccccgcccactgggagaagatcgaggccatcaaccaggccatcgccaacgagtacgaggtgagaagaaagctgctgatcaagagactggacgtgaccgtgcagagcttcggctggagcgacagagccaagagccagaccgagaagctggccaaggtgtaccagcccaagagaagcgtgctgagccccaagaccaccatcagcgtggcccacctgctggccgccagacaggacctgagcaagatcctgagaaccagcagcggcagcatcagagagaagaccgcctgcgccatcaacaaggtgctgatgggcagagtgcccgacagaggcggcagacccaacgagatcgagccccccccccccgagatgcccccctggcagaagagacaggacggcccccagcagcagaccggcggcagaggcggcggcagaggcggctacgagcacagcagctacggcggcagaggcggccacgagcagggcggcggcagaggcggcagaggcggctacgaccacggcggcagaggcggcggcagaggcaacaagcaccagggcggctggaccgacggcggcagcggcggcggcggcggctaccaggacggcggctacagagacagcggcttccagcccggcggctaccacggcggccacagcagcggcggctaccagggcggcggctacggcggcttccagaccagcagcagctacaccggcagcggctaccagggcggcggctaccagcaggacaacagataccaggacggcggccaccacggcgacagaggcggcggcagaggcggcagaggcggcagaggcggcagaggcggcagagccggccagggcggcggctggggcggcagaggcagccagaactaccaccagggcggccagttcgagcagcacttccagcacggcggctaccagtacaaccacagcggcttcggccagggcagacactacaccagctag

SEQ ID NO: 21320 - DNA, 1302 bp, Artificial Sequence
  Description of Artificial Sequence: Synthetic coding sequence
atgagaggccccgagcccggcccccagcccaccatggagggcgacgtgctggacaccctggaggccctgggctacaagggccccctgctggaggagcaggccctgaccaaggccgccgagggcggcctgagcagccccgagttcagcgagctgtgcatctggctgggcagccagatcaagagcctgtgcaacctggaggagagcatcaccagcgccggcagagacgacctggagagcttccagctggagatcagcggcttcctgaaggagatggcctgcccctacagcgtgctgatcagcggcgacatcaaggacagactgaagaagaaggaggactgcctgaagctgctgctgttcctgagcaccgagctgcaggccagccagatcctgcagaacaagaagcacaagaacagccagctggacaagaacagcgaggtgtaccaggaggtgcaggccatgttcgacaccctgggcatccccaagagcaccaccagcgacatcccccacatgctgaaccaggtggagagcaaggtgaaggacatcctgagcaaggtgcagaagaaccacgtgggcaagcccctgctgaagatggacctgaacagcgagcaggccgagcagctggagagaatcaacgacgccctgagctgcgagtacgagtgcagaagaagaatgctgatgaagagactggacgtgaccgtgcagagcttcggctggagcgacagagccaaggtgaagaccgacgacatcgccagaatctaccagcccaagagatacgccctgagccccaagaccaccatcaccatggcccacctgctggccgccagagaggacctgagcaagatcatcagaaccagcagcggcaccagcagagagaagaccgcctgcgccatcaacaaggtgctgatgggcagagtgcccgacagaggcggcagacccaacgagatcgagccccccccccccgagatgcccccctggcagaagagacaggagggcggcggcggcagaggcggctggggcggcggcggcggcggcggcggcagaggcggcggcggcggcggcggcggcagaggcggctggggcggcggcggcggcggctggggcggcggcggcggcggcggcggcggctggggcggcggcggcggcggcggcagaggcggcttccagggcagaggcgactacggcggcagaggcggctacggcggcagaggcggctacggcggcagaggctacggcgacccctacggcggcggcggcggcggcggcggcggcggcggcggcggcggcggctacagaagatactag

SEQ ID NO: 21321 - DNA, 993 bp, Artificial Sequence
  Description of Artificial Sequence: Synthetic coding sequence
atgagaggccccgagcccggcccccagcccaccatggagggcgacgtgctggacaccctggaggccctgggctacaagggccccctgctggaggagcaggccctgaccaaggccgccgagggcggcctgagcagccccgagttcagcgagctgtgcatctggctgggcagccagatcaagagcctgtgcaacctggaggagagcatcaccagcgccggcagagacgacctggagagcttccagctggagatcagcggcttcctgaaggagatggcctgcccctacagcgtgctgatcagcggcgacatcaaggacagactgaagaagaaggaggactgcctgaagctgctgctgttcctgagcaccgagctgcaggccagccagatcctgcagaacaagaagcacaagaacagccagctggacaagaacagcgaggtgtaccaggaggtgcaggccatgttcgacaccctgggcatccccaagagcaccaccagcgacatcccccacatgctgaaccaggtggagagcaaggtgaaggacatcctgagcaaggtgcagaagaaccacgtgggcaagcccctgctgaagatggacctgaacagcgagcaggccgagcagctggagagaatcaacgacgccctgagctgcgagtacgagtgcagaagaagaatgctgatgaagagactggacgtgaccgtgcagagcttcggctggagcgacagagccaaggtgaagaccgacgacatcgccagaatctaccagcccaagagatacgccctgagccccaagaccaccatcaccatggcccacctgctggccgccagagaggacctgagcaagatcatcagaaccagcagcggcaccagcagagagaagaccgcctgcgccatcaacaaggtgggcgtgagcttcagcaccgtggagaacgagctgatgatcagctacctgatgttcctgcagatcctggtgtacttcagcttcatgagctggtag

SEQ ID NO: 21322 - DNA, 549 bp, Artificial Sequence
  Description of Artificial Sequence: Synthetic coding sequence
atgatgcaggagagccccgaccccgaggacgacgagacccccacccagagcgacagactgagcatgctgagccaggagatccagaccctgaagagaagcagcaccggcagctacgaggagagagtgaagagactgagcgtgagcgagctgaacgagatcctggaggagatcgagaccgccatcaaggagtacagcgaggagctggtgcagcagctggccctgagagacgagctggagttcgagaaggaggtgaagaacagcttcatcagcgtgctgatcgaggtgcagaacaagcagaaggagcacaaggagaccgccaagaagaagaagaagctgaagaacggcagcagccagaacggcaagaacgagagaagccacatgcccggcacctacctgaccaccgtgatcccctacgagaagaagaacggcccccccagcgtggaggacctgcagatcctgaccaagatcctgagagccatgaaggaggacagcgagaaggtgcccagcctgctgaccgactacatcctgaaggtgctgtgccccacctag

SEQ ID NO: 21323 - DNA, 1062 bp, Artificial Sequence
  Description of Artificial Sequence: Synthetic coding sequence
atggccgccgacggcgactggcaggacttctacgagttccaggagcccgccagaagcctgctggaccaggagaactgcaacgccagccccgagcccggcgccgaggccggcgccgaggccggcggcggcgccgacggcttccccgcccccgcctgcagcctggaggagaagctgagcctgtgcttcagacccagcgaccccggcgccgagccccccagaaccgccgtgagacccatcaccgagagaagcctgctgcagggcgacgagatctggaacgccctgaccgacaactacggcaacgtgatgcccgtggactggaagagcagccacaccagaaccctgcacctgctgaccctgaacctgagcgagaagggcgtgagcgacagcctgctgttcgacaccagcgacgacgaggagctgagagagcagctggacatgcacagcatcatcgtgagctgcgtgaacgacgagcccctgttcaccgccgaccaggtgatcgaggagatcgaggagatgatgcaggagagccccgaccccgaggacgacgagacccccacccagagcgacagactgagcatgctgagccaggagatccagaccctgaagagaagcagcaccggcagctacgaggagagagtgaagagactgagcgtgagcgagctgaacgagatcctggaggagatcgagaccgccatcaaggagtacagcgaggagctggtgcagcagctggccctgagagacgagctggagttcgagaaggaggtgaagaacagcttcatcagcgtgctgatcgaggtgcagaacaagcagaaggagcacaaggagaccgccaagaagaagaagaagctgaagaacggcagcagccagaacggcaagaacgagagaagccacatgcccggcacctacctgaccaccgtgatcccctacgagaagaagaacggcccccccagcgtggaggacctgcagatcctgaccaagatcctgagagccatgaaggaggacagcgagaaggtgcccagcctgctgaccgactacatcctgaaggtgctgtgccccacctag

SEQ ID NO: 21324 - DNA, 1143 bp, Artificial Sequence
  Description of Artificial Sequence: Synthetic coding sequence
atggccgccgacggcgactggcaggacttctacgagttccaggagcccgccagaagcctgctggaccaggagaactgcaacgccagccccgagcccggcgccgaggccggcgccgaggccggcggcggcgccgacggcttccccgcccccgcctgcagcctggaggagaagctgagcctgtgcttcagacccagcgaccccggcgccgagccccccagaaccgccgtgagacccatcaccgagagaagcctgctgcagggcgacgagatctggaacgccctgaccgacaactacggcaacgtgatgcccgtggactggaagagcagccacaccagaaccctgcacctgctgaccctgaacctgagcgagaagggcgtgagcgacagcctgctgttcgacaccagcgacgacgaggagctgagagagcagctggacatgcacagcatcatcgtgagctgcgtgaacgacgagcccctgttcaccgccgaccaggtgatcgaggagatcgaggagatgatgcaggagagccccgaccccgaggacgacgagacccccacccagagcgacagactgagcatgctgagccaggagatccagaccctgaagagaagcagcaccggcagctacgaggagagagtgaagagactgagcgtgagcgagctgaacgagatcctggaggagatcgagaccgccatcaaggagtacagcgaggagctggtgcagcagctggccctgagagacgagctggagttcgagaaggaggtgaagaacagcttcatcagcgtgctgatcgaggtgcagaacaagcagaaggagcacaaggagaccgccaagaagaagaagaagctgaagaacggcagcagccagaacggcaagaacgagagaagccacatgcccggcaccagattcagcatggagggcatcagcaacgtgatccagaacggcctgagacacaccttcggcaacagcggcggcgagaagcagtacctgaccaccgtgatcccctacgagaagaagaacggcccccccagcgtggaggacctgcagatcctgaccaagatcctgagagccatgaaggaggacagcgagaaggtgcccagcctgctgaccgactacatcctgaaggtgctgtgccccacctag

SEQ ID NO: 21325 - DNA, 423 bp, Artificial Sequence
  Description of Artificial Sequence: Synthetic coding sequence
atgatcgaccagctgcagggcacctggaagagcatcagctgcgagaacagcgaggactacatgaaggagctgggcatcggcagagccagcagaaagctgggcagactggccaagcccaccgtgaccatcagcaccgacggcgacgtgatcaccatcaagaccaagagcatcttcaagaacaacgagatcagcttcaagctgggcgaggagttcgaggagatcacccccggcggccacaagaccaagagcaaggtgaccctggacaaggagagcctgatccaggtgcaggactgggacggcaaggagaccaccatcaccagaaagctggtggacggcaagatggtggtggagagcaccgtgaacagcgtgatctgcaccagaacctacgagaaggtgagcagcaacagcgtgagcaacagctag

SEQ ID NO: 21326 - DNA, 2208 bp, Artificial Sequence
  Description of Artificial Sequence: Synthetic coding sequence
atgacccccgagctgatgatcaaggcctgcagcttctacaccggccacctggtgaagacccacttctgcacctggagagacatcgccagaaccaacgagaacgtggtgctggccgagaagatgaacagagccgtgacctgctacaacttcagactgcagaagagcgtgttccaccactggcacagctacatggaggaccagaaggagaagctgaagaacatcctgctgagaatccagcagatcatctactgccacaagctgaccatcatcctgaccaagtggagaaacaccgccagacacaagagcaagaagaaggaggacgagctgatcctgaagcacgagctgcagctgaagaagtggaagaacagactgatcctgaagagagccgccgccgaggagagcaacttccccgagagaagcagcagcgaggtgttcctggtggacgagaccctgaagtgcgacatcagcctgctgcccgagagagccatcctgcagatcttcttctacctgagcctgaaggacgtgatcatctgcggccaggtgaaccacgcctggatgctgatgacccagctgaacagcctgtggaacgccatcgacttcagcagcgtgaagaacgtgatccccgacaagtacatcgtgagcaccctgcagagatggagactgaacgtgctgagactgaacttcagaggctgcctgctgagacccaagaccttcagaagcgtgagccactgcagaaacctgcaggagctgaacgtgagcgactgccccaccttcaccgacgagagcatgagacacatcagcgagggctgccccggcgtgctgtgcctgaacctgagcaacaccaccatcaccaacagaaccatgagactgctgcccagacacttccacaacctgcagaacctgagcctggcctactgcagaagattcaccgacaagggcctgcagtacctgaacctgggcaacggctgccacaagctgatctacctggacctgagcggctgcacccagatcagcgtgcagggcttcagatacatcgccaacagctgcaccggcatcatgcacctgaccatcaacgacatgcccaccctgaccgacaactgcgtgaaggccctggtggagaagtgcagcagaatcaccagcctggtgttcaccggcgccccccacatcagcgactgcaccttcagagccctgagcgcctgcaagctgagaaagatcagattcgagggcaacaagagagtgaccgacgccagcttcaagttcatcgacaagaactaccccaacctgagccacatctacatggccgactgcaagggcatcaccgacagcagcctgagaagcctgagccccctgaagcagctgaccgtgctgaacctggccaactgcgtgagaatcggcgacatgggcctgaagcagttcctggacggccccgccagcatgagaatcagagagctgaacctgagcaactgcgtgagactgagcgacgccagcgtgatgaagctgagcgagagatgccccaacctgaactacctgagcctgagaaactgcgagcacctgaccgcccagggcatcggctacatcgtgaacatcttcagcctggtgagcatcgacctgagcggcaccgacatcagcaacgagggcctgaacgtgctgagcagacacaagaagctgaaggagctgagcgtgagcgagtgctacagaatcaccgacgacggcatccaggccttctgcaagagcagcctgatcctggagcacctggacgtgagctactgcagccagctgagcgacatgatcatcaaggccctggccatctactgcatcaacctgaccagcctgagcatcgccggctgccccaagatcaccgacagcgccatggagatgctgagcgccaagtgccactacctgcacatcctggacatcagcggctgcgtgctgctgaccgaccagatcctggaggacctgcagatcggctgcaagcagctgagaatcctgaagatgcagtactgcaccaacatcagcaagaaggccgcccagagaatgagcagcaaggtgcagcagcaggagtacaacaccaacgacccccccagatggttcggctacgacagagagggcaaccccgtgaccgagctggacaacatcaccagcagcaagggcgccctggagctgaccgtgaagaagagcacctacagcagcgaggaccaggccgcctag

SEQ ID NO: 21327 - DNA, 1371 bp, Artificial Sequence
  Description of Artificial Sequence: Synthetic coding sequence
atcctgctgagaatccagcagatcatctactgccacaagctgaccatcatcctgaccaagtggagaaacaccgccagacacaagagcaagaagaaggaggacgagctgatcctgaagcacgagctgcagctgaagaagtggaagaacagactgatcctgaagagagccgccgccgaggagagcaacttccccgagagaagcagcagcgaggtgttcctggtggacgagaccctgaagtgcgacatcagcctgctgcccgagagagccatcctgcagatcttcttctacctgagcctgaaggacgtgatcatctgcggccaggtgaaccacgcctggatgctgatgacccagctgaacagcctgtggaacgccatcgacttcagcagcgtgaagaacgtgatccccgacaagtacatcgtgagcaccctgcagagatggagactgaacgtgctgagactgaacttcagaggctgcctgctgagacccaagaccttcagaagcctgagccccctgaagcagctgaccgtgctgaacctggccaactgcgtgagaatcggcgacatgggcctgaagcagttcctggacggccccgccagcatgagaatcagagagctgaacctgagcaactgcgtgagactgagcgacgccagcgtgatgaagctgagcgagagatgccccaacctgaactacctgagcctgagaaactgcgagcacctgaccgcccagggcatcggctacatcgtgaacatcttcagcctggtgagcatcgacctgagcggcaccgacatcagcaacgagggcctgaacgtgctgagcagacacaagaagctgaaggagctgagcgtgagcgagtgctacagaatcaccgacgacggcatccaggccttctgcaagagcagcctgatcctggagcacctggacgtgagctactgcagccagctgagcgacatgatcatcaaggccctggccatctactgcatcaacctgaccagcctgagcatcgccggctgccccaagatcaccgacagcgccatggagatgctgagcgccaagtgccactacctgcacatcctggacatcagcggctgcgtgctgctgaccgaccagatcctggaggacctgcagatcggctgcaagcagctgagaatcctgaagatgcagtactgcaccaacatcagcaagaaggccgcccagagaatgagcagcaaggtgcagcagcaggagtacaacaccaacgacccccccagatggttcggctacgacagagagggcaaccccgtgaccgagctggacaacatcaccagcagcaagggcgccctggagctgaccgtgaagaagagcacctacagcagcgaggaccaggccgcctag

SEQ ID NO: 21328 - DNA, 2124 bp, Artificial Sequence
  Description of Artificial Sequence: Synthetic coding sequence
atgacccccgagctgatgatcaaggcctgcagcttctacaccggccacctggtgaagacccacttctgcacctggagagacatcgccagaaccaacgagaacgtggtgctggccgagaagatgaacagagccgtgacctgctacaacttcagactgcagaagagcgtgttccaccactggcacagctacatggaggaccagaaggagaagctgaagaacatcctgctgagaatccagcagatcatctactgccacaagctgaccatcatcctgaccaagtggagaaacaccgccagacacaagagcaagaagaaggaggacgagctgatcctgaagcacgagctgcagctgaagaagtggaagaacagactgatcctgaagagagccgccgccgaggagagcaacttccccgagagaagcagcagcgaggtgttcctggtggacgagaccctgaagtgcgacatcagcctgctgcccgagagagccatcctgcagatcttcttctacctgagcctgaaggacgtgatcatctgcggccaggtgaaccacgcctggatgctgatgacccagctgaacagcctgtggaacgccatcgacttcagcagcgtgaagaacgtgatccccgacaagtacatcgtgagcaccctgcagagatggagactgaacgtgctgagactgaacttcagaggctgcctgctgagacccaagaccttcagaagcgtgagccactgcagaaacctgcaggagctgaacgtgagcgactgccccaccttcaccgacgagagcatgagacacatcagcgagggctgccccggcgtgctgtgcctgaacctgagcaacaccaccatcaccaacagaaccatgagactgctgcccagacacttccacaacctgcagaacctgagcctggcctactgcagaagattcaccgacaagggcctgcagtacctgaacctgggcaacggctgccacaagctgatctacctggacctgagcggctgcacccagatcagcgtgcagggcttcagatacatcgccaacagctgcaccggcatcatgcacctgaccatcaacgacatgcccaccctgaccgacaactgcgtgaaggccctggtggagaagtgcagcagaatcaccagcctggtgttcaccggcgccccccacatcagcgactgcaccttcagagccctgagcgcctgcaagctgagaaagatcagattcgagggcaacaagagagtgaccgacgccagcttcaagttcatcgacaagaactaccccaacctgagccacatctacatggccgactgcaagggcatcaccgacagcagcctgagaagcctgagccccctgaagcagctgaccgtgctgaacctggccaactgcgtgagaatcggcgacatgggcctgaagcagttcctggacggccccgccagcatgagaatcagagagctgaacctgagcaactgcgtgagactgagcgacgccagcgtgatgaagctgagcgagagatgccccaacctgaactacctgagcctgagaaactgcgagcacctgaccgcccagggcatcggctacatcgtgaacatcttcagcctggtgagcatcgacctgagcggcaccgacatcagcaacgaggccttctgcaagagcagcctgatcctggagcacctggacgtgagctactgcagccagctgagcgacatgatcatcaaggccctggccatctactgcatcaacctgaccagcctgagcatcgccggctgccccaagatcaccgacagcgccatggagatgctgagcgccaagtgccactacctgcacatcctggacatcagcggctgcgtgctgctgaccgaccagatcctggaggacctgcagatcggctgcaagcagctgagaatcctgaagatgcagtactgcaccaacatcagcaagaaggccgcccagagaatgagcagcaaggtgcagcagcaggagtacaacaccaacgacccccccagatggttcggctacgacagagagggcaaccccgtgaccgagctggacaacatcaccagcagcaagggcgccctggagctgaccgtgaagaagagcacctacagcagcgaggaccaggccgcctag

SEQ ID NO: 21329 - DNA, 1362 bp, Artificial Sequence
  Description of Artificial Sequence: Synthetic coding sequence
atgacccccgagctgatgatcaaggcctgcagcttctacaccggccacctggtgaagacccacttctgcacctggagagacatcgccagaaccaacgagaacgtggtgctggccgagaagatgaacagagccgtgacctgctacaacttcagactgcagaagagcgtgttccaccactggcacagctacatggaggaccagaaggagaagctgaagaacatcctgctgagaatccagcagatcatctactgccacaagctgaccatcatcctgaccaagtggagaaacaccgccagacacaagagcaagaagaaggaggacgagctgatcctgaagcacgagctgcagctgaagaagtggaagaacagactgatcctgaagagagccgccgccgaggagagcaacttccccgagagaagcagcagcgaggtgttcctggtggacgagaccctgaagtgcgacatcagcctgctgcccgagagagccatcctgcagatcttcttctacctgagcctgaaggacgtgatcatctgcggccaggtgaaccacgcctggatgctgatgacccagctgaacagcctgtggaacgccatcgacttcagcagcgtgaagaacgtgatccccgacaagtacatcgtgagcaccctgcagagatggagactgaacgtgctgagactgaacttcagaggctgcctgctgagacccaagaccttcagaagcgtgagccactgcagaaacctgcaggagctgaacgtgagcgactgccccaccttcaccgacgagagcatgagacacatcagcgagggctgccccggcgtgctgtgcctgaacctgagcaacaccaccatcaccaacagaaccatgagactgctgcccagacacttccacaacctgcagaacctgagcctggcctactgcagaagattcaccgacaagggcctgcagtacctgaacctgggcaacggctgccacaagctgatctacctggacctgagcggctgcacccagatcaccgacagcgccatggagatgctgagcgccaagtgccactacctgcacatcctggacatcagcggctgcgtgctgctgaccgaccagatcctggaggacctgcagatcggctgcaagcagctgagaatcctgaagatgcagtactgcaccaacatcagcaagaaggccgcccagagaatgagcagcaaggtgcagcagcaggagtacaacaccaacgacccccccagatggttcggctacgacagagagggcaaccccgtgaccgagctggacaacatcaccagcagcaagggcgccctggagctgaccgtgaagaagagcacctacagcagcgaggaccaggccgcctag

SEQ ID NO: 21330 - DNA, 2073 bp, Artificial Sequence
  Description of Artificial Sequence: Synthetic coding sequence
atgacccccgagctgatgatcaaggcctgcagcttctacaccggccacctggtgaagacccacttctgcacctggagagacatcgccagaaccaacgagaacgtggtgctggccgagaagatgaacagagccgtgacctgctacaacttcagactgcagaagagcgtgttccaccactggcacagctacatggaggaccagaaggagaagctgaagaacatcctgctgagaatccagcagatcatctactgccacaagctgaccatcatcctgaccaagtggagaaacaccgccagacacaagagcaagaagaaggaggacgagctgatcctgaagcacgagctgcagctgaagaagtggaagaacagactgatcctgaagagagccgccgccgaggagagcaacttccccgagagaagcagcagcgaggtgttcctggtggacgagaccctgaagtgcgacatcagcctgctgcccgagagagccatcctgcagatcttcttctacctgagcctgaaggacgtgatcatctgcggccaggtgaaccacgcctggatgctgatgacccagctgaacagcctgtggaacgccatcgacttcagcagcgtgaagaacgtgatccccgacaagtacatcgtgagcaccctgcagagatggagactgaacgtgctgagactgaacttcagaggctgcctgctgagacccaagaccttcagaagcgtgagccactgcagaaacctgcaggagctgaacgtgagcgactgccccaccttcaccgacgagagcatgagacacatcagcgagggctgccccggcgtgctgtgcctgaacctgagcaacaccaccatcaccaacagaaccatgagactgctgcccagacacttccacaacctgcagaacctgagcctggcctactgcagaagattcaccgacaagggcctgcagtacctgaacctgggcaacggctgccacaagctgatctacctggacctgagcggctgcacccagatcagcgtgcagggcttcagatacatcgccaacagctgcaccggcatcatgcacctgaccatcaacgacatgcccaccctgaccgacaactgcgtgaaggccctggtggagaagtgcagcagaatcaccagcctggtgttcaccggcgccccccacatcagcgactgcaccttcagagccctgagcgcctgcaagctgagaaagatcagattcgagggcaacaagagagtgaccgacgccagcttcaagttcatcgacaagaactaccccaacctgagccacatctacatggccgactgcaagggcatcaccgacagcagcctgagaagcctgagccccctgaagcagctgaccgtgctgaacctggccaactgcgtgagaatcggcgacatgggcctgaagcagttcctggacggccccgccagcatgagaatcagagagctgaacctgagcaactgcgtgagactgagcgacgccagcgtgatgaagctgagcgagagatgccccaacctgaactacctgagcctgagaaactgcgagcacctgaccgcccagggcatcggctacatcgtgaacatcttcagcctggtgagcatcgacctgagcggcaccgacatcagcaacgagggcctgaacgtgctgagcagacacaagaagctgaaggagctgagcgtgagcgagtgctacagaatcaccgacgacggcatccagatcaccgacagcgccatggagatgctgagcgccaagtgccactacctgcacatcctggacatcagcggctgcgtgctgctgaccgaccagatcctggaggacctgcagatcggctgcaagcagctgagaatcctgaagatgcagtactgcaccaacatcagcaagaaggccgcccagagaatgagcagcaaggtgcagcagcaggagtacaacaccaacgacccccccagatggttcggctacgacagagagggcaaccccgtgaccgagctggacaacatcaccagcagcaagggcgccctggagctgaccgtgaagaagagcacctacagcagcgaggaccaggccgcctag

SEQ ID NO: 21331 - DNA, 2124 bp, Artificial Sequence; identical to SEQ ID NO: 21328
  Description of Artificial Sequence: Synthetic coding sequence

SEQ ID NO: 21332 - DNA, 2208 bp, Artificial Sequence; identical to SEQ ID NO: 21326
  Description of Artificial Sequence: Synthetic coding sequence

SEQ ID NO: 21333 - DNA, 2073 bp, Artificial Sequence; identical to SEQ ID NO: 21330
  Description of Artificial Sequence: Synthetic coding sequence

SEQ ID NO: 21334 - DNA, 1362 bp, Artificial Sequence; identical to SEQ ID NO: 21329
  Description of Artificial Sequence: Synthetic coding sequence

SEQ ID NO: 21335 - DNA, 1440 bp, Artificial Sequence
  Description of Artificial Sequence: Synthetic coding sequence
atgagcagccccggcatcgacggcgaccccaagcccccctgcctgcccagaaacggcctggtgaagctgcccggccagcccaacggcctgggcgccgccagcatcaccaagggcacccccgccaccaagaacagaccctgccagcccccccccccccccaccctgcccccccccagcctggccgcccccctgagcagagccgccctggccggcggcccctgcacccccgccggcggccccgccagcgccctggcccccggccaccccgccgagagaccccccctggccaccgacgagaagatcctgaacggcctgttctggtacttcagcgcctgcgagaagtgcgtgctggcccaggtgtgcaaggcctggagaagagtgctgtaccagcccaagttctgggccggcctgacccccgtgctgcacgccaaggagctgtacaacgtgctgcccggcggcgagaaggagttcgtgaacctgcagggcttcgccgccagaggcttcgagggcttctgcctggtgggcgtgagcgacctggacatctgcgagttcatcgacaactacgccctgagcaagaagggcgtgaaggccatgagcctgaagagaagcaccatcaccgacgccggcctggaggtgatgctggagcagatgcagggcgtggtgagactggagctgagcggctgcaacgacttcaccgaggccggcctgtggagcagcctgagcgccagaatcaccagcctgagcgtgagcgactgcatcaacgtggccgacgacgccatcgccgccatcagccagctgctgcccaacctggccgagctgagcctgcaggcctaccacgtgaccgacaccgccctggcctacttcaccgccagacagggccacagcacccacaccctgagactgctgagctgctgggagatcaccaaccacggcgtggtgaacgtggtgcacagcctgcccaacctgaccgccctgagcctgagcggctgcagcaaggtgaccgacgacggcgtggagctggtggccgagaacctgagaaagctgagaagcctggacctgagctggtgccccagaatcaccgacatggccctggagtacgtggcctgcgacctgcacagactggaggagctggtgctggacagatgcgtgagaatcaccgacaccggcctgagctacctgagcaccatgagcagcctgagaagcctgtacctgagatggtgctgccaggtgcaggacttcggcctgaagcacctgctggccctgggcagcctgagactgctgagcctggccggctgccccctgctgaccaccaccggcctgagcggcctggtgcagctgcaggagctggaggagctggagctgaccaactgccccggcgccacccccgagctgttcaagtacttcagccagcacctgcccagatgcctggtgatcgagtag

SEQ ID NO: 21336 - DNA, 1440 bp, Artificial Sequence; identical to SEQ ID NO: 21335
  Description of Artificial Sequence: Synthetic coding sequence

SEQ ID NO: 21337 - DNA, 780 bp, Artificial Sequence
  Description of Artificial Sequence: Synthetic coding sequence
atgcacgccgtgcccagaggcttcggcaagaaggtgagagtgggcgtgcagagctgcccccccctgctgggccccggcgtgccccccgccctgctgagagtgctggtgagcgccgaggagcccgccctgcccggcacccccagagccgactgggtgcagctgctgctgagacacgccccccagagagccagacacccccagctggcccccaccctgcagcccagaaccgagtgcagaggcctgggcggcggcagacacagacccgccggcctgcccgccgcccccgacgccagaaccgccgcccagagaccctacggcctgagagccggccagtacagacccgccgtgcccgccgtggccgtgcccgtggccggccagcccggccacgacggcgagggcggcgtgcacgccagagccctgagacacgtggaggccctgcaggccgccgagggcccccaggccggcgccgccctgctgcagagacagagacccgtgctgcccggcgccgagcccgtgcccctggccgccgcccccgtgcccggcctgagccagagacacccccccgccagatgcagagccggcctgcacggcagcctgcccgccggctgccacgtgccccccgtgcacagaggcgtgcccagacacctgcaggagcccgccgccgtggccagcccccagctgcccggcagagccgccagagtgaagagaagacacctgcccagcgcccccagaggccccgacagaagacaccccggcagaccccccggcgcccccggctag

SEQ ID NO: 21338 - DNA, 2418 bp, Artificial Sequence
  Description of Artificial Sequence: Synthetic coding sequence
atggccagcagcggcgaggacatcagcaacgacgacgacgacatgcaccccgccgccgccggcatggccgacggcgtgcacctgctgggcttcagcgacgagatcctgctgcacatcctgagccacgtgcccagcaccgacctgatcctgaacgtgagaagaacctgcagaaagctggccgccctgtgcctggacaagagcctgatccacaccgtgctgctgcagaaggactaccaggccagcgaggacaaggtgagacagctggtgaaggagatcggcagagagatccagcagctgagcatggccggctgctactggctgcccggcagcaccgtggagcacgtggccagatgcagaagcctggtgaaggtgaacctgagcggctgccacctgaccagcctgagactgagcaagatgctgagcgccctgcagcacctgagaagcctggccatcgacgtgagccccggcttcgacgccagccagctgagcagcgagtgcaaggccaccctgagcagagtgagagagctgaagcagaccctgttcacccccagctacggcgtggtgccctgctgcaccagcctggagaagctgctgctgtacttcgagatcctggacagaaccagagagggcgccatcctgagcggccagctgatggtgggccagagcaacgtgccccactaccagaacctgagagtgttctacgccagactggcccccggctacatcaaccaggaggtggtgagactgtacctggccgtgctgagcgacagaaccccccagaacctgcacgccttcctgatcagcgtgcccggcagcttcgccgagagcggcgccaccaagaacctgctggacagcatggccagaaacgtggtgctggacgccctgcagctgcccaagagctggctgaacggcagcagcctgctgcagcacatgaagttcaacaaccccttctacttcagcttcagcagatgcaccctgagcggcggccacctgatccagcaggtgatcaacggcggcaaggacctgagaagcctggccagcctgaacctgagcggctgcgtgcactgcctgagccccgacagcctgctgagaaaggccgaggacgacatcgacagcagcatcctggagaccctggtggccagctgctgcaacctgagacacctgaacctgagcgccgcccaccaccacagcagcgagggcctgggcagacacctgtgccagctgctggccagactgagacacctgagaagcctgagcctgcccgtgtgcagcgtggccgacagcgcccccagagccgacagagcccccgcccagcccgccatgcacgccgtgcccagaggcttcggcaagaaggtgagagtgggcgtgcagagctgccccagccccttcagcggccaggcctgcccccagcccagcagcgtgttctggagcctgctgaagaacctgcccttcctggagcacctggagctgatcggcagcaacttcagcagcgccatgcccagaaacgagcccgccatcagaaacagcctgcccccctgcagcagagcccagagcgtgggcgacagcgaggtggccgccatcggccagctggccttcctgagacacctgaccctggcccagctgcccagcgtgctgaccggcagcggcctggtgaacatcggcctgcagtgccagcagctgagaagcctgagcctggccaacctgggcatgatgggcaaggtggtgtacatgcccgccctgagcgacatgctgaagcactgcaagagactgagagacctgagactggagcagccctacttcagcgccaacgcccagttcttccaggccctgagccagtgccccagcctgcagagactgtgcctggtgagcagaagcggcaccctgcagcccgacgccgtgctggccttcatggccagatgcctgcaggtggtgatgtgccacctgttcaccggcgagagcctggccacctgcaagagcctgcagcagagcctgctgagaagatggggcgaggtgaccggcagaagaccccagctgttcaccgagctgagagaggagcccagcgccagaaccagcagagccaccggcagaagacagccctgcctgcccgacagcggcgtggtgtgctgcccctgcggcagacccctggccgtgagcggcatcatcctggtgggcgtgagccccagcctggtggtgaagaccacctgcgtgtacagagtgctgttcaagaacctggactacgccagcatcttcttcctggtgtgcctgttcgagaccgagagccacagcgtggtgcaggccggcgtgcagtggagagacctgagcagcctgcagcccctgctgagcggcctgcagccccagccccccgagcagctggagaacgagctggagatcggcttcagctactgcttcgtgatctag

SEQ ID NO: 21339 - DNA, 2157 bp, Artificial Sequence
  Description of Artificial Sequence: Synthetic coding sequence
atggccagcagcggcgaggacatcagcaacgacgacgacgacatgcaccccgccgccgccggcatggccgacggcgtgcacctgctgggcttcagcgacgagatcctgctgcacatcctgagccacgtgcccagcaccgacctgatcctgaacgtgagaagaacctgcagaaagctggccgccctgtgcctggacaagagcctgatccacaccgtgctgctgcagaaggactaccaggccagcgaggacaaggtgagacagctggtgaaggagatcggcagagagatccagcagctgagcatggccggctgctactggctgcccggcagcaccgtggagcacgtggccagatgcagaagcctggtgaaggtgaacctgagcggctgccacctgaccagcctgagactgagcaagatgctgagcgccctgcagcacctgagaagcctggccatcgacgtgagccccggcttcgacgccagccagctgagcagcgagtgcaaggccaccctgagcagagtgagagagctgaagcagaccctgttcacccccagctacggcgtggtgccctgctgcaccagcctggagaagctgctgctgtacttcgagatcctggacagaaccagagagggcgccatcctgagcggccagctgatggtgggccagagcaacgtgccccactaccagaacctgagagtgttctacgccagactggcccccggctacatcaaccaggaggtggtgagactgtacctggccgtgctgagcgacagaaccccccagaacctgcacgccttcctgatcagcgtgcccggcagcttcgccgagagcggcgccaccaagaacctgctggacagcatggccagaaacgtggtgctggacgccctgcagctgcccaagagctggctgaacggcagcagcctgctgcagcacatgaagttcaacaaccccttctacttcagcttcagcagatgcaccctgagcggcggccacctgatccagcaggtgatcaacggcggcaaggacctgagaagcctggccagcctgaacctgagcggctgcgtgcactgcctgagccccgacagcctgctgagaaaggccgaggacgacatcgacagcagcatcctggagaccctggtggccagctgctgcaacctgagacacctgaacctgagcgccgcccaccaccacagcagcgagggcctgggcagacacctgtgccagctgctggccagactgagacacctgagaagcctgagcctgcccgtgtgcagcgtggccgacagcgcccccagagccgacagagcccccgcccagcccgccatgcacgccgtgcccagaggcttcggcaagaaggtgagagtgggcgtgcagagctgccccagccccttcagcggccaggcctgcccccagcccagcagcgtgttctggagcctgctgaagaacctgcccttcctggagcacctggagctgatcggcagcaacttcagcagcgccatgcccagaaacgagcccgccatcagaaacagcctgcccccctgcagcagagcccagagcgtgggcgacagcgaggtggccgccatcggccagctggccttcctgagacacctgaccctggcccagctgcccagcgtgctgaccggcagcggcctggtgaacatcggcctgcagtgccagcagctgagaagcctgagcctggccaacctgggcatgatgggcaaggtggtgtacatgcccgccctgagcgacatgctgaagcactgcaagagactgagagacctgagactggagcagccctacttcagcgccaacgcccagttcttccaggccctgagccagtgccccagcctgcagagactgtgcctggtgagcagaagcggcaccctgcagcccgacgccgtgctggccttcatggccagatgcctgcaggtggtgatgtgccacctgttcaccggcgagagcctggccacctgcaagagcctgcagcagagcctgctgagaagcttccaggccgagagacccgccctgaacgtggtgatcttccccctgctgcacgagggcctgaccgacgtgatcagagacgtgcccctggtgcacctggacgagatcaccctgttcaagagcagagtggccgaggagccccccaacctgtggtggtag

SEQ ID NO: 21340 - DNA, 2406 bp, Artificial Sequence
  Description of Artificial Sequence: Synthetic coding sequence
atggccagcagcggcgaggacatcagcaacgacgacgacgacatgcaccccgccgccgccggcatggccgacggcgtgcacctgctgggcttcagcgacgagatcctgctgcacatcctgagccacgtgcccagcaccgacctgatcctgaacgtgagaagaacctgcagaaagctggccgccctgtgcctggacaagagcctgatccacaccgtgctgctgcagaaggactaccaggccagcgaggacaaggtgagacagctggtgaaggagatcggcagagagatccagcagctgagcatggccggctgctactggctgcccggcagcaccgtggagcacgtggccagatgcagaagcctggtgaaggtgaacctgagcggctgccacctgaccagcctgagactgagcaagatgctgagcgccctgcagcacctgagaagcctggccatcgacgtgagccccggcttcgacgccagccagctgagcagcgagtgcaaggccaccctgagcagagtgagagagctgaagcagaccctgttcacccccagctacggcgtggtgccctgctgcaccagcctggagaagctgctgctgtacttcgagatcctggacagaaccagagagggcgccatcctgagcggccagctgatggtgggccagagcaacgtgccccactaccagaacctgagagtgttctacgccagactggcccccggctacatcaaccaggaggtggtgagactgtacctggccgtgctgagcgacagaaccccccagaacctgcacgccttcctgatcagcgtgcccggcagcttcgccgagagcggcgccaccaagaacctgctggacagcatggccagaaacgtggtgctggacgccctgcagctgcccaagagctggctgaacggcagcagcctgctgcagcacatgaagttcaacaaccccttctacttcagcttcagcagatgcaccctgagcggcggccacctgatccagcaggtgatcaacggcggcaaggacctgagaagcctggccagcctgaacctgagcggctgcgtgcactgcctgagccccgacagcctgctgagaaaggccgaggacgacatcgacagcagcatcctggagaccctggtggccagctgctgcaacctgagacacctgaacctgagcgccgcccaccaccacagcagcgagggcctgggcagacacctgtgccagctgctggccagactgagacacctgagaagcctgagcctgcccgtgtgcagcgtggccgacagcgcccccagagccgacagagcccccgcccagcccgccatgcacgccgtgcccagaggcttcggcaagaaggtgagagtgggcgtgcagagctgccccagccccttcagcggccaggcctgcccccagcccagcagcgtgttctggagcctgctgaagaacctgcccttcctggagcacctggagctgatcggcagcaacttcagcagcgccatgcccagaaacgagcccgccatcagaaacagcctgcccccctgcagcagagcccagagcgtgggcgacagcgaggtggccgccatcggccagctggccttcctgagacacctgaccctggcccagctgcccagcgtgctgaccggcagcggcctggtgaacatcggcctgcagtgccagcagctgagaagcctgagcctggccaacctgggcatgatgggcaaggtggtgtacatgcccgccctgagcgacatgctgaagcactgcaagagactgagagacctgagactggagcagccctacttcagcgccaacgcccagttcttccaggccctgagccagtgccccagcctgcagagactgtgcctggtgagcagaagcggcaccctgcagcccgacgccgtgctggccttcatggccagatgcctgcaggtggtgatgtgccacctgttcaccggcgagagcctggccacctgcaagagcctgcagcagagcctgctgagaagatggggcgaggtgaccggcagaagaccccagctgttcaccgagctgagagaggagcccagcgccagaaccagcagagccaccggcagaagacagccctgcctgcccgacagcggcgtggtgtgctgcccctgcggcagacccctggccgtgagcggcatcatcctggtgggcgtgagccccagcctggtggtgaagaccacctgcgtgtacagagtgctgttcaagaacctggactacgccagcatcttcttcctggtgtgcctgttcgagaccgagagccacagcgtggtgcaggccggcgtgcagtggagagacctgagcagcctgcagcccctgctgagcggcctgcagccccagccccccgagcagctgggcctgcaggtgtgcaccaccatccccggctag

SEQ ID NO: 21341 - DNA, 726 bp, Artificial Sequence
  Description of Artificial Sequence: Synthetic coding sequence
atgcacatcacccagctgaacagagagtgcctgctgcacctgttcagcttcctggacaaggacagcagaaagagcctggccagaacctgcagccagctgcacgacgtgttcgaggaccccgccctgtggagcctgctgcacttcagaagcctgaccgagctgcagaaggacaacttcctgctgggccccgccctgagaagcctgagcatctgctggcacagcagcagagtgcaggtgtgcagcatcgaggactggctgaagagcgccttccagagaagcatctgcagcagacacgagagcctggtgaacgacttcctgctgagagtgtgcgacagactgagcgccgtgagaagccccagaagaagagaggcccccgcccccagcagcggcacccccatcgccgtgggccccaagagccccagatggggcggccccgaccacagcgagttcgccgacctgagaagcggcgtgaccggcgccagagccgccgccagaagaggcctgggcagcctgagagccgagagacccagcgagaccccccccgcccccggcgtgagctggggcccccccccccccggcgcccccgtggtgatcagcgtgaagcaggaggagggcaagcagggcagaaccggcagaagaagccacagagccgcccccccctgcggcttcgccagaaccagagtgtgcccccccaccttccccggcgccgacgccttcccccagtag

SEQ ID NO: 21342 - DNA, 1620 bp, Artificial Sequence
  Description of Artificial Sequence: Synthetic coding sequence
atggccgcccccgccagcagacaggtgagaagaagagccagagccgcccccagacccagaagcgccgaggactggtggtgggacagactggcccccagaggcagcggctaccacctgctgcagagcgacagcatgctgctggtgctgagcgagcccggccccgccagacccagagcccagagaagagccagcagaagaacccccagacagccccccagaggccccagcgccgccgccaagcccaaggccggcctgagaagcgaggccgccgccgcccccgcccccgcccccgcccccacccccacccccgaggagggccccgacgccggctggggcgacagaatccccctggagatcctggtgcagatcttcggcctgctggtggccgccgacggccccatgcccttcctgggcagagccgccagagtgtgcagaagatggcaggaggccgccagccagcccgccctgtggcacaccgtgaccctgagcagccccctggtgggcagacccgccaagggcggcgtgaaggccgagaagaagctgctggccagcctggagtggctgatgcccaacagattcagccagctgcagagactgaccctgatccactggaagagccaggtgcaccccgtgctgaagctggtgggcgagtgctgccccagactgaccttcctgaagctgagcggctgccacggcgtgaccgccgacgccctggtgatgctggccaaggcctgctgccagctgcacagcctggacctgcagcacagcatggtggagagcaccgccgtggtgagcttcctggaggaggccggcagcagaatgagaaagctgtggctgacctacagcagccagaccaccgccatcctgggcgccctgctgggcagctgctgcccccagctgcaggtgctggaggtgagcaccggcatcaacagaaacagcatccccctgcagctgcccgtggaggccctgcagaagggctgcccccagctgcaggtgctgagactgctgaacctgatgtggctgcccaagccccccggcagaggcgtggcccccggccccggcttccccagcctggaggagctgtgcctggccagcagcacctgcaacttcgtgagcaacgaggtgctgggcagactgctgcacggcagccccaacctgagactgctggacctgagaggctgcgccagaatcacccccgccggcctgcaggacctgccctgcagagagctggagcagctgcacctgggcctgtacggcaccagcgacagactgaccctggccaaggagggcagccccttcctgacccagaagtggtgccacaccctgagagagctggacctgagcggccagggcttcagcgagaaggacctggagcaggccctggccgccttcctgagcacccccggcggcagccaccccgccctgtgcagcctgaacctgagaggcaccagagtgacccccagcaccgtgagcagcgtgatcagcagctgccccggcctgctgtacctgaacctggagagctgcagatgcctgcccagaggcctgaagagagcctacagaggcctggaggaggtgcagtggtgcctggagcagctgctgaccagccccagccccagctag

SEQ ID NO: 21343 - DNA, 1602 bp, Artificial Sequence
  Description of Artificial Sequence: Synthetic coding sequence
atggccgcccccgccagcagacaggtgagaagaagagccagagccgcccccagacccagaagcgccgaggactggtggtgggacagactggcccccagaggcagcggctaccacctgctgcagagcgacagcatgctgctggtgctgagcgagcccggccccgccagacccagagcccagagaagagccagcagaagaacccccagacagccccccagaggccccagcgccgccgccaagcccaaggccggcctgagaagcgaggccgccgccgcccccgcccccgcccccgcccccacccccacccccgaggagggccccgacgccggctggggcgacagaatccccctggagatcctggtgcagatcttcggcctgctggtggccgccgacggccccatgcccttcctgggcagagccgccagagtgtgcagaagatggcaggaggccgccagccagcccgccctgtggcacaccgtgaccctgagcagccccctggtgggcagacccgccaagggcggcgtgaaggccgagaagaagctgctggccagcctggagtggctgatgcccaacagattcagccagctgcagagactgaccctgatccactggaagagccagctggtgggcgagtgctgccccagactgaccttcctgaagctgagcggctgccacggcgtgaccgccgacgccctggtgatgctggccaaggcctgctgccagctgcacagcctggacctgcagcacagcatggtggagagcaccgccgtggtgagcttcctggaggaggccggcagcagaatgagaaagctgtggctgacctacagcagccagaccaccgccatcctgggcgccctgctgggcagctgctgcccccagctgcaggtgctggaggtgagcaccggcatcaacagaaacagcatccccctgcagctgcccgtggaggccctgcagaagggctgcccccagctgcaggtgctgagactgctgaacctgatgtggctgcccaagccccccggcagaggcgtggcccccggccccggcttccccagcctggaggagctgtgcctggccagcagcacctgcaacttcgtgagcaacgaggtgctgggcagactgctgcacggcagccccaacctgagactgctggacctgagaggctgcgccagaatcacccccgccggcctgcaggacctgccctgcagagagctggagcagctgcacctgggcctgtacggcaccagcgacagactgaccctggccaaggagggcagccccttcctgacccagaagtggtgccacaccctgagagagctggacctgagcggccagggcttcagcgagaaggacctggagcaggccctggccgccttcctgagcacccccggcggcagccaccccgccctgtgcagcctgaacctgagaggcaccagagtgacccccagcaccgtgagcagcgtgatcagcagctgccccggcctgctgtacctgaacctggagagctgcagatgcctgcccagaggcctgaagagagcctacagaggcctggaggaggtgcagtggtgcctggagcagctgctgaccagccccagccccagctag

SEQ ID NO: 21344 - DNA, 1125 bp, Artificial Sequence
  Description of Artificial Sequence: Synthetic coding sequence
atggccgagcccggcgagggcctgcccgaggaggtgctggccctgatcttcagacacctgagcctgagagacagagccgccgccgccagagtgtgcagagcctgggccgccgccgccacctgcagcgccgtgtggcacgacaccaagatcagctgcgagtgcgagctggagggcatgctgcccccctacctgagcgcctgcctggaccacatccacaacctgagactggagttcgagcccagcagaaagcccagcagaagagccgccatcgagctgctgatggtgctggccggcagagcccccggcctgagaggcctgagactggagtgcagaggcgagaagcccctgttcgacgccggcagagacgtgctggaggccgtgcacgccgtgtgcggcgccgccagccagctgagacacctggacctgagaagactgagcttcaccctggacgacgccctggtgctgcaggccgccagaagctgccccgagctgcacagcctgttcctggacaacagcaccctggtgggcagcgtgggccccggcagcgtgctggagctgctggaggcctgccccagactgagagccctgggcctgcacctggccagcctgagccacgccatcctggaggccctggccgcccccgacagagcccccttcgccctgctggccctgagatgcgcctgccccgaggacgccagagccagccccctgcccaacgaggcctgggtggccctgagaagaagacaccccggcctggccgtggagctggagctggagcccgccctgcccgccgagagcgtgaccagagtgctgcagcccgccgtgcccgtggccgccctgagactgaacctgagcggcgacaccgtgggccccgtgagattcgccgcccaccactacgccgccaccctgtgcgccctggaggtgagagccgccgccagcgccgagctgaacgccgccctggaggagctggccgccagatgcgccgccctgagagaggtgcactgcttctgcgtggtgagccacagcgtgctggacgccttcagagcccactgccccagactgagaacctacaccctgaagctgaccagagagccccacccctggagacccaccctggtggcctag

SEQ ID NO: 21345 - DNA, 492 bp, Artificial Sequence
  Description of Artificial Sequence: Synthetic coding sequence
atggccgagcccggcgagggcctgcccgaggaggtgctggccctgatcttcagacacctgagcctgagagacagagccgccgccgccagagtgtgcagagcctgggccgccgccgccacctgcagcgccgtgtggcacgacaccaagatcagctgcgagtgcgagctggagggcatgctgcccccctacctgagcgcctgcctggaccacatccacaacctgagactggagttcgagcccagcagaaagcccagcagaagagccgccatcgagctgctgatggtgctggccggcagagcccccggcctgagaggcctgagactggagtgcagaggcgagaagcccctgttcgacgccggcagagacgtgctggaggccgtgcacgccgtgtgcggcgccgccagccagctgagacacctggacctgagaagactgagcttcaccctggacgacgccctggtgctgcaggccgccagaagctgccccgagtag

SEQ ID NO: 21346 - DNA, 1125 bp, Artificial Sequence; identical to SEQ ID NO: 21344
  Description of Artificial Sequence: Synthetic coding sequence

SEQ ID NO: 21347 - DNA, 390 bp, Artificial Sequence
  Description of Artificial Sequence: Synthetic coding sequence
atggccgagcccggcgagggcctgcccgaggaggtgctggccctgatcttcagacacctgagcctgagagacagagccgccgccgccagagtgtgcagagcctgggccgccgccgccacctgcagcgccgtgtggcacgacaccaagatcagctgcgagtgcgagctggagggcatgctgcccccctacctgagcgcctgcctggaccacatccacaacctgagactggagttcgagcccagcagaaagcccagcagaagagccgccatcgagctgctgatggtgctggccggcagagcccccggcctgagaggcctgagactggagtgcagaggcgagaagcccctgttcgacgccggcagagacgtgctggaggccgtgcacgcctag

SEQ ID NO: 21348 - DNA, 1701 bp, Artificial Sequence
  Description of Artificial Sequence: Synthetic coding sequence
atggacgagggcggcacccccctgctgcccgacagcctggtgtaccagatcttcctgagcctgggccccgccgacgtgctggccgccggcctggtgtgcagacagtggcaggccgtgagcagagacgagttcctgtggagagagcagttctacagatactaccaggtggccagagacgtgcccagacaccccgccgccatgagctggtacgaggagttccagagactgtacgacaccgtgccctgcgtggaggtgcagaccctgagagagcacaccgaccaggtgctgcacctgagcttcagccacagcggctaccagttcgccagctgcagcaaggactgcaccgtgaagatctggagcaacgacctgaccatcagcctgctgcacagcgccgacatgagaccctacaactggagctacacccagttcagccagttcaacaaggacgacagcctgctgctggccagcggcgtgttcctgggcccccacaacagcagcagcggcgagatcgccgtgatcagcctggacagcttcgccctgctgagcagagtgagaaacaagccctacgacgtgttcggctgctggctgaccgagaccagcctgatcagcggcaacctgcacagaatcggcgacatcaccagctgcagcgtgctgtggctgaacaacgccttccaggacgtggagagcgagaacgtgaacgtggtgaagagactgttcaagatccagaacctgaacgccagcaccgtgagaaccgtgatggtggccgactgcagcagattcgacagccccgacctgctgctggaggccggcgaccccgccaccagcccctgcagaatcttcgacctgggcagcgacaacgaggaggtggtggccggccccgcccccgcccacgccaaggagggcctgagacacttcctggacagagtgctggagggcagagcccagccccagctgagcgagagaatgctggagaccaaggtggccgagctgctggcccagggccacaccaagccccccgagagaagcgccaccggcgccaagagcaagtacctgatcttcaccaccggctgcctgacctacagcccccaccagatcggcatcaagcagatcctgccccaccagatgaccaccgccggccccgtgctgggcgagggcagaggcagcgacgccttcttcgacgccctggaccacgtgatcgacatccacggccacatcatcggcatgggcctgagccccgacaacagatacctgtacgtgaacagcagagcctggcccaacggcgccgtggtggccgaccccatgcagcccccccccatcgccgaggagatcgacctgctggtgttcgacctgaagaccatgagagaggtgagaagagccctgagagcccacagagcctacacccccaacgacgagtgcttcttcatcttcctggacgtgagcagagacttcgtggccagcggcgccgaggacagacacggctacatctgggacagacactacaacatctgcctggccagactgagacacgaggacgtggtgaacagcgtggtgttcagcccccaggagcaggagctgctgctgaccgccagcgacgacgccaccatcaaggcctggagaagccccagaaccatgagagtgctgcaggcccccagacccagacccagaaccttcttcagctggctggccagccagagaagatag

SEQ ID NO: 21349 - DNA, 603 bp, Artificial Sequence
  Description of Artificial Sequence: Synthetic coding sequence
atggacgagggcggcacccccctgctgcccgacagcctggtgtaccagatcttcctgagcctgggccccgccgacgtgctggccgccggcctggtgtgcagacagtggcaggccgtgagcagagacgagttcctgtggagagagcagttctacagatactaccaggtggccagagacgtgcccagacaccccgccgccatgagctggtacgaggagttccagagactgtacgacaccgtgccctgcgtggaggtgcagaccctgagagagcacaccgaccaggtgctgcacctgagcttcagccacagcggctaccagttcgccagctgcagcaaggactgcaccgtgaaggccatcaccaccgccgcccccgccgagcagatctggagcaacgacctgaccatcagcctgctgcacagcgccgacatgagaccctacaactggagctacacccagttcagccagttcaacaaggacgacagcctgctgctggccagcggcgtgttcctgggcccccacaacagcagcagcggcgagatcgccgtgatcagcctggacagcttcgccctgctgagcagagtgagaaacaagccctacgactag

SEQ ID NO: 21350 - DNA, 804 bp, Artificial Sequence
  Description of Artificial Sequence: Synthetic coding sequence
gacagcctgagcagccccggcctgcccaccgacagcttcgccctgctgagcagagtgagaaacaagccctacgacgtgttcggctgctggctgaccgagaccagcctgatcagcggcaacctgcacagaatcggcgacatcaccagctgcagcgtgctgtggctgaacaacgccttccaggacgtggagagcgagaacgtgaacgtggtgaagagactgttcaagatccagaacctgaacgccagcaccgtgagaaccgtgatggtggccgactgcagcagattcgacagccccgacctgctgctggaggccggcgaccccgccaccagcccctgcagaatcttcgacctgggcagcgacaacgaggaggtggtggccggccccgcccccgcccacgccaaggagggcctgagacacttcctggacagagtgctggagggcagagcccagccccagctgagcgagagaatgctggagaccaaggtggccgagctgctggcccagggccacaccaagccccccgagagaagcgccaccggcgccaagagcaagtacctgatcttcaccaccggctgcctgacctacagcccccaccagatcggcatcaagcagatcctgccccaccagatgaccaccgccggccccgtgctgggcgagggcagaggcagcgacgccttcttcgacgccctggaccacgtgatcgacatccacggccacatcatcggcatgggcctgagccccgacaacagatacctgtacgtgaacagcagagcctggcccaacggcgccgtggtggccgactag

SEQ ID NO: 21351 - DNA, 390 bp, Artificial Sequence
  Description of Artificial Sequence: Synthetic coding sequence
atggacgagggcggcacccccctgctgcccgacagcctggtgtaccagatcttcctgagcctgggccccgccgacgtgctggccgccggcctggtgtgcagacagtggcaggccgtgagcagagacgagttcctgtggagagagcagttctacagatactaccaggtggccagagacgtgcccagacaccccgccgccatgagctggtacgaggagttccagagactgtacgacaccgtgccctgcgtggaggtgcagaccctgagagagcacaccgaccaggtgctgcacctgagcttcagccacagcggctaccagttcgccagctgcagcaaggactgcaccgtgaagatctggagcaacgacctgaccatcagcctgctgcactag

SEQ ID NO: 21352 - DNA, 1467 bp, Artificial Sequence
  Description of Artificial Sequence: Synthetic coding sequence
atggagctgcccctgggcagatgcgacgacagcagaacctgggacgacgacagcgaccccgagagcgagaccgaccccgacgcccaggccaaggcctacgtggccagagtgctgagcccccccaagagcggcctggccttcagcagacccagccagctgagcacccccgccgccagccccagcgccagcgagcccagagccgccagcagagtgagcgccgtgagcgagcccggcctgctgagcctgccccccgagctgctgctggagatctgcagctacctggacgccagactggtgctgcacgtgctgagcagagtgtgccacgccctgagagacctggtgagcgaccacgtgacctggagactgagagccctgagaagagtgagagccccctaccccgtggtggaggagaagaacttcgactggcccgccgcctgcatcgccctggagcagcacctgagcagatgggccgaggacggcagatgggtggagtacttctgcctggccgagggccacgtggccagcgtggacagcgtgctgctgctgcagggcggcagcctgtgcctgagcggcagcagagacagaaacgtgaacctgtgggacctgagacagctgggcaccgagagcaaccaggtgctgatcaagaccctgggcaccaagagaaacagcacccacgagggctgggtgtggagcctggccgcccaggaccacagagtgtgcagcggcagctgggacagcaccgtgaagctgtgggacatggccgccgacggccagcagttcggcgagatcaaggccagcagcgccgtgctgtgcctgagctacctgcccgacatcctggtgaccggcacctacgacaagaaggtgaccatctacgaccccagagacagaatggagaccagagacgccctgatgggctggggcggccccagcagaggcagcgacatccccccccacagacccatcacccacgaggccggccccgccctgctgaagcaccagcagctgcacagcagacccgtgctgaccctgctggccgacgacagacacatcatcagcggcagcgaggaccacaccctggtggtggtggacagaagagccaacagcgtgctgcagagactgcagctggacagctacctgctgtgcatgagctaccaggagccccagctgtgggccggcgacaaccagggcctgctgcacgtgttcgccaacagaaacggctgcttccagctgatcagaagcttcgacgtgggccacagcttccccatcaccggcatccagtacagcgtgggcgccctgtacaccaccagcaccgacaagaccatcagagtgcacgtgcccaccgacccccccagaaccatctgcaccagaagacacgacaacggcctgaacagagtgtgcgccgagggcaacctggtggtggccggcagcggcgacctgagcctggaggtgtggagactgcaggcctag

SEQ ID NO: 21353 - DNA, 1377 bp, Artificial Sequence
  Description of Artificial Sequence: Synthetic coding sequence
atggagctgcccctgggcagatgcgacgacagcagaacctgggacgacgacagcgaccccgagagcgagaccgaccccgacgcccaggccaaggcctacgtggccagagtgctgagcccccccaagagcggcctggccttcagcagacccagccagctgagcacccccgccgccagccccagcgccagcgagcccagagccgccagcagagtgagcgccgtgagcgagcccggcctgctgagcctgccccccgagctgctgctggagatctgcagctacctggacgccagactggtgctgcacgtgctgagcagagtgtgccacgccctgagagacctggtgagcgaccacgtgacctggagactgagagccctgagaagagtgagagccccctaccccgtggtggaggagaagaacttcgactggcccgccgcctgcatcgccctggagcagcacctgagcagatgggccgaggacggcagatgggtggagtacttctgcctggccgagggccacgtggccagcgtggacagcgtgctgctgctgcagggcggcagcctgtgcctgagcggcagcagagacagaaacgtgaacctgtgggacctgagacagctgggcaccgagagcaaccaggtgctgatcaagaccctgggcaccaagagaaacagcacccacgagggctgggtgtggagcctggccgcccaggaccacagagtgtgcagcggcagctgggacagcaccgtgaagctgtgggacatggccgccgacggccagcagttcggcgagatcaaggccagcagcgccgtgctgtgcctgagctacctgcccgacatcctggtgaccggcacctacgacaagaaggtgaccatctacgaccccagagccggccccgccctgctgaagcaccagcagctgcacagcagacccgtgctgaccctgctggccgacgacagacacatcatcagcggcagcgaggaccacaccctggtggtggtggacagaagagccaacagcgtgctgcagagactgcagctggacagctacctgctgtgcatgagctaccaggagccccagctgtgggccggcgacaaccagggcctgctgcacgtgttcgccaacagaaacggctgcttccagctgatcagaagcttcgacgtgggccacagcttccccatcaccggcatccagtacagcgtgggcgccctgtacaccaccagcaccgacaagaccatcagagtgcacgtgcccaccgacccccccagaaccatctgcaccagaagacacgacaacggcctgaacagagtgtgcgccgagggcaacctggtggtggccggcagcggcgacctgagcctggaggtgtggagactgcaggcctag

SEQ ID NO: 21354 - DNA, 591 bp, Artificial Sequence
  Description of Artificial Sequence: Synthetic coding sequence
atgagagccagcagcgccgtgctgtgcctgagctacctgcccgacatcctggtgaccggcacctacgacaagaaggtgaccatctacgaccccagagccggccccgccctgctgaagcaccagcagctgcacagcagacccgtgctgaccctgctggccgacgacagacacatcatcagcggcagcgaggaccacaccctggtggtggtggacagaagagccaacagcgtgctgcagagactgcagctggacagctacctgctgtgcatgagctaccaggagccccagctgtgggccggcgacaaccagggcctgctgcacgtgttcgccaacagaaacggctgcttccagctgatcagaagcttcgacgtgggccacagcttccccatcaccggcatccagtacagcgtgggcgccctgtacaccaccagcaccgacaagaccatcagagtgcacgtgcccaccgacccccccagaaccatctgcaccagaagacacgacaacggcctgaacagagtgtgcgccgagggcaacctggtggtggccggcagcggcgacctgagcctggaggtgtggagactgcaggcctag

SEQ ID NO: 21355 - DNA, 468 bp, Artificial Sequence
  Description of Artificial Sequence: Synthetic coding sequence
atgcacaagaacagcaagagaaacaacaacctgagagtgagccacaccgaggccaacagcgtggacgccgagaaggagaagaacgagagccagaacaacttcttcgagctgctgcccgccgagatcaccttcaagatcttcagccagctggacatcagaagcctgtgcagagccagcctgacctgcagaagctggaacgacaccatcagaaacagcgacagcctgtggaagccccactgcatgaccgtgagagccgtgtgcagaagagagatcgacgacgacctggagagcggctacagctggagagtgatcctgctgagaaactaccagaagagcaaggtgaagcacgagtggctgagcggcagatacagcaacatctgcagccccatcagcctgcccgagaagatcatgtaccccatggacgccgacacctggggcgagatcctggaggccgagctggagagatag

SEQ ID NO: 21356 - DNA, 744 bp, Artificial Sequence
  Description of Artificial Sequence: Synthetic coding sequence
atgtggcccctgctgaccatgcacatcacccagctgaacagagagtgcctgctgcacctgttcagcttcctggacaaggacagcagaaagagcctggccagaacctgcagccagctgcacgacgtgttcgaggaccccgccctgtggagcctgctgcacttcagaagcctgaccgagctgcagaaggacaacttcctgctgggccccgccctgagaagcctgagcatctgctggcacagcagcagagtgcaggtgtgcagcatcgaggactggctgaagagcgccttccagagaagcatctgcagcagacacgagagcctggtgaacgacttcctgctgagagtgtgcgacagactgagcgccgtgagaagccccagaagaagagaggcccccgcccccagcagcggcacccccatcgccgtgggccccaagagccccagatggggcggccccgaccacagcgagttcgccgacctgagaagcggcgtgaccggcgccagagccgccgccagaagaggcctgggcagcctgagagccgagagacccagcgagaccccccccgcccccggcgtgagctggggcccccccccccccggcgcccccgtggtgatcagcgtgaagcaggaggagggcaagcagggcagaaccggcagaagaagccacagagccgcccccccctgcggcttcgccagaaccagagtgtgcccccccaccttccccggcgccgacgccttcccccagtag

SEQ ID NO: 21357 - DNA, 177 bp, Artificial Sequence
  Description of Artificial Sequence: Synthetic coding sequence
aacagcaccgaccccgtgaaggccgcccagttcgagatgagcaaccccagccacctgctgttcttcctgccctgccccttcagccccgtgagcagcctgttcgccttcgtgaacgccaagctgaagtggagactgggcctgaagacccccgagcagaccaagccccccggcccctag

SEQ ID NO: 21358 - DNA, 2073 bp, Artificial Sequence
  Description of Artificial Sequence: Synthetic coding sequence
atgcagcccccccccagaaaggtgaagcccgcccaggaggtgaagctgagattcctggagcagctgagcatcctgcagacctggcagcagagagaggccgacctgctggaggacatcagaagctacagcaagcagagagccgccatcgagagagagtacggccaggccctgcagaagctggccggccccttcctgaagagagagggccacagaagcggcgagatggacagcagaggcagaaccgtgttcggcgcctggagatgcctgctggacgccaccgtggccggcggccagaccagactgcaggccagcgacagatacagagacctggccggcggcaccggcagaagcgccaaggagcaggtgctgagaaagggcaccgagaacctgcagagagcccaggccgaggtgctgcagagcgtgagagagctgagcagaagcagaaagctgtacggccagagagagagagtgtgggccctggcccaggagaaggccgccgacgtgcaggccagactgaacagaagcgaccacggcatcttccacagcagaaccagcctgcagaagctgagcaccaagctgagcgcccagagcgcccagtacagccagcagctgcaggccgccagaaacgagtacctgctgaacctggtggccaccaacgcccacctggaccactactaccaggaggagctgcccgccctgctgaaggccctggtgagcgagctgagcgagcacctgagagaccccctgaccagcctgagccacaccgagctggaggccgccgaggtgatcctggagcacgcccacagaggcgagcagaccaccagccaggtgagctgggagcaggacctgaagctgttcctgcaggagcccggcgtgttcagccccacccccccccagcagttccagcccgccggcaccgaccaggtgtgcgtgctggagtggggcgccgagggcgtggccggcaagagcggcctggagaaggaggtgcagagactgaccagcagagccgccagagactacaagatccagaaccacggccacagagtgctgcagagactggagcagagaagacagcaggccagcgagagagaggcccccagcatcgagcagagactgcaggaggtgagagagagcatcagaagagcccaggtgagccaggtgaagggcgccgccagactggccctgctgcagggcgccggcctggacgtggagagatggctgaagcccgccatgacccaggcccaggacgaggtggagcaggagagaagactgagcgaggccagactgagccagagagacctgagccccaccgccgaggacgccgagctgagcgacttcgaggagtgcgaggagaccggcgagctgttcgaggagcccgccccccaggccctggccaccagagccctgccctgccccgcccacgtggtgttcagataccaggccggcagagaggacgagctgaccatcaccgagggcgagtggctggaggtgatcgaggagggcgacgccgacgagtgggtgaaggccagaaaccagcacggcgaggtgggcttcgtgcccgagagatacctgaacttccccgacctgagcctgcccgagagcagccaggacagcgacaacccctgcggcgccgagcccaccgccttcctggcccaggccctgtacagctacaccggccagagcgccgaggagctgagcttccccgagggcgccctgatcagactgctgcccagagcccaggacggcgtggacgacggcttctggagaggcgagttcggcggcagagtgggcgtgttccccagcctgctggtggaggagctgctgggcccccccggcccccccgagctgagcgaccccgagcagatgctgcccagccccagcccccccagcttcagcccccccgcccccaccagcgtgctggacggcccccccgcccccgtgctgcccggcgacaaggccctggacttccccggcttcctggacatgatggcccccagactgagacccatgagaccccccccccccccccccgccaaggcccccgaccccggccaccccgaccccctgacctag

SEQ ID NO: 21359 - DNA, 2055 bp, Artificial Sequence
  Description of Artificial Sequence: Synthetic coding sequence
atgcagaagctggccagccagtacctgaagagagactggcccggcgtgaaggccgacgacagaaacgactacagaagcatgtaccccgtgtggaagagcttcctggagggcaccatgcaggtggcccagagcagaatgaacatctgcgagaactacaagaacttcatcagcgagcccgccagaaccgtgagaagcctgaaggagcagcagctgaagagatgcgtggaccagctgaccaagatccagaccgagctgcaggagaccgtgaaggacctggccaagggcaagaagaagtacttcgagaccgagcagatggcccacgccgtgagagagaaggccgacatcgaggccaagagcaagctgagcctgttccagagcagaatcagcctgcagaaggccagcgtgaagctgaaggccagaagaagcgagtgcaacagcaaggccacccacgccagaaacgactacctgctgaccctggccgccgccaacgcccaccaggacagatactaccagaccgacctggtgaacatcatgaaggccctggacggcaacgtgtacgaccacctgaaggactacctgatcgccttcagcagaaccgagctggagacctgccaggccgtgcagaacaccttccagttcctgctggagaacagcagcaaggtggtgagagactacaacctgcagctgttcctgcaggagaacgccgtgttccacaagccccagcccttccagttccagccctgcgacagcgacaccagcagacagctggagagcgagaccggcaccaccgaggagcacagcctgaacaaggaggccagaaagtgggccaccagagtggccagagagcacaagaacatcgtgcaccagcagagagtgctgaacgacctggagtgccacggcgccgccgtgagcgagcagagcagagccgagctggagcagaagatcgacgaggccagagagaacatcagaaaggccgagatcatcaagctgaaggccgaggccagactggacctgctgaagcagatcggcgtgagcgtggacacctggctgaagagcgccatgaaccaggtgatggaggagctggagaacgagagatgggccagaccccccgccgtgaccagcaacggcaccctgcacagcctgaacgccgacaccgagagagaggagggcgaggagttcgaggacaacatggacgtgttcgacgacagcagcagcagccccagcggcaccctgagaaactaccccctgacctgcaaggtggtgtacagctacaaggccagccagcccgacgagctgaccatcgaggagcacgaggtgctggaggtgatcgaggacggcgacatggaggactgggtgaaggccagaaacaaggtgggccaggtgggctacgtgcccgagaagtacctgcagttccccaccagcaacagcctgctgagcatgctgcagagcctggccgccctggacagcagaagccacaccagcagcaacagcaccgaggccgagctggtgagcggcagcctgaacggcgacgccagcgtgtgcttcgtgaaggccctgtacgactacgagggccagaccgacgacgagctgagcttccccgagggcgccatcatcagaatcctgaacaaggagaaccaggacgacgacggcttctgggagggcgagttcaacggcagaatcggcgtgttccccagcgtgctggtggaggagctgagcgccagcgagaacggcgacaccccctggatgagagagatccagatcagccccagccccaagccccacgccagcctgccccccctgcccctgtacgaccagccccccagcagcccctaccccagccccgacaagagaagcagcctgtacttccccagaagccccagcgccaacgagaagagcctgcacgccgagagccccggcttcagccaggccagcagacacacccccgagaccagctacggcaagctgagacccgtgagagccgccccccccccccccacccagaaccacagaagacccgccgagaagatcgaggacgtggagatcaccctggtgtag

SEQ ID NO: 21360 - DNA, 2223 bp, Artificial Sequence
  Description of Artificial Sequence: Synthetic coding sequence
atgcagcccccccccagaaaggtgaaggtgacccaggagctgaagaacatccaggtggagcagatgaccaagctgcaggccaagcaccaggccgagtgcgacctgctggaggacatgagaaccttcagccagaagaaggccgccatcgagagagagtacgcccagggcatgcagaagctggccagccagtacctgaagagagactggcccggcgtgaaggccgacgacagaaacgactacagaagcatgtaccccgtgtggaagagcttcctggagggcaccatgcaggtggcccagagcagaatgaacatctgcgagaactacaagaacttcatcagcgagcccgccagaaccgtgagaagcctgaaggagcagcagctgaagagatgcgtggaccagctgaccaagatccagaccgagctgcaggagaccgtgaaggacctggccaagggcaagaagaagtacttcgagaccgagcagatggcccacgccgtgagagagaaggccgacatcgaggccaagagcaagctgagcctgttccagagcagaatcagcctgcagaaggccagcgtgaagctgaaggccagaagaagcgagtgcaacagcaaggccacccacgccagaaacgactacctgctgaccctggccgccgccaacgcccaccaggacagatactaccagaccgacctggtgaacatcatgaaggccctggacggcaacgtgtacgaccacctgaaggactacctgatcgccttcagcagaaccgagctggagacctgccaggccgtgcagaacaccttccagttcctgctggagaacagcagcaaggtggtgagagactacaacctgcagctgttcctgcaggagaacgccgtgttccacaagccccagcccttccagttccagccctgcgacagcgacaccagcagacagctggagagcgagaccggcaccaccgaggagcacagcctgaacaaggaggccagaaagtgggccaccagagtggccagagagcacaagaacatcgtgcaccagcagagagtgctgaacgacctggagtgccacggcgccgccgtgagcgagcagagcagagccgagctggagcagaagatcgacgaggccagagagaacatcagaaaggccgagatcatcaagctgaaggccgaggccagactggacctgctgaagcagatcggcgtgagcgtggacacctggctgaagagcgccatgaaccaggtgatggaggagctggagaacgagagatgggccagaccccccgccgtgaccagcaacggcaccctgcacagcctgaacgccgacaccgagagagaggagggcgaggagttcgaggacaacatggacgtgttcgacgacagcagcagcagccccagcggcaccctgagaaactaccccctgacctgcaaggtggtgtacagctacaaggccagccagcccgacgagctgaccatcgaggagcacgaggtgctggaggtgatcgaggacggcgacatggaggactgggtgaaggccagaaacaaggtgggccaggtgggctacgtgcccgagaagtacctgcagttccccaccagcaacagcctgctgagcatgctgcagagcctggccgccctggacagcagaagccacaccagcagcaacagcaccgaggccgagctggtgagcggcagcctgaacggcgacgccagcgtgtgcttcgtgaaggccctgtacgactacgagggccagaccgacgacgagctgagcttccccgagggcgccatcatcagaatcctgaacaaggagaaccaggacgacgacggcttctgggagggcgagttcaacggcagaatcggcgtgttccccagcgtgctggtggaggagctgagcgccagcgagaacggcgacaccccctggatgagagagatccagatcagccccagccccaagccccacgccagcctgccccccctgcccctgtacgaccagccccccagcagcccctaccccagccccgacaagagaagcagcctgtacttccccagaagccccagcgccaacgagaagagcctgcacgccgagagccccggcttcagccaggccagcagacacacccccgagaccagctacggcaagctgagacccgtgagagccgccccccccccccccacccagaaccacagaagacccgccgagaagatcgaggacgtggagatcaccctggtgtag

SEQ ID NO: 21361 - DNA, 1548 bp, Artificial Sequence
  Description of Artificial Sequence: Synthetic coding sequence
atgcagaagctggccagccagtacctgaagagagactggcccggcgtgaaggccgacgacagaaacgactacagaagcatgtaccccgtgtggaagagcttcctggagggcaccatgcaggtggcccagagcagaatgaacatctgcgagaactacaagaacttcatcagcgagcccgccagaaccgtgagaagcctgaaggagcagcagctgaagagatgcgtggaccagctgaccaagatccagaccgagctgcaggagaccgtgaaggacctggccaagggcaagaagaagtacttcgagaccgagcagatggcccacgccgtgagagagaaggccgacatcgaggccaagagcaagctgagcctgttccagagcagaatcagcctgcagaaggccagcgtgaagctgaaggccagaagaagcgagtgcaacagcaaggccacccacgccagaaacgactacctgctgaccctggccgccgccaacgcccaccaggacagatactaccagaccgacctggtgaacatcatgaaggccctggacggcaacgtgtacgaccacctgaaggactacctgatcgccttcagcagaaccgagctggagacctgccaggccgtgcagaacaccttccagttcctgctggagaacagcagcaaggtggtgagagactacaacctgcagctgttcctgcaggagaacgccgtgttccacaagccccagcccttccagttccagccctgcgacagcgacaccagcagacagctggagagcgagaccggcaccaccgaggagcacagcctgaacaaggaggccagaaagtgggccaccagagtggccagagagcacaagaacatcgtgcaccagcagagagtgctgaacgacctggagtgccacggcgccgccgtgagcgagcagagcagagccgagctggagcagaagatcgacgaggccagagagaacatcagaaaggccgagatcatcaagctgaaggccgaggccagactggacctgctgaagcagatcggcgtgagcgtggacacctggctgaagagcgccatgaaccaggtgatggaggagctggagaacgagagatgggccagaccccccgccgtgaccagcaacggcaccctgcacagcctgaacgccgacaccgagagagaggagggcgaggagttcgaggacaacatggacgtgttcgacgacagcagcagcagccccagcggcaccctgagaaactaccccctgacctgcaaggtggtgtacagctacaaggccagccagcccgacgagctgaccatcgaggagcacgaggtgctggaggtgatcgaggacggcgacatggaggactgggtgaaggccagaaacaaggtgggccaggtgggctacgtgcccgagaagtacctgcagttccccaccagcaacagcctgctgagcatgctgcagagcctggccgccctggacagcagaagccacaccagcagcaacagcaccgaggccgagctggtgagcggcagcctgaacggcgacgccagcggcaaggactag

SEQ ID NO: 21362 - DNA, 1854 bp, Artificial Sequence
  Description of Artificial Sequence: Synthetic coding sequence
atggacctgaagaccgccgtgttcaacgccgccagagacggcaagctgagactgctgaccaagctgctggccagcaagagcaaggaggaggtgagcagcctgatcagcgagaagaccaacggcgccacccccctgctgatggccgccagatacggccacctggacatggtggagttcctgctggagcagtgcagcgccagcatcgaggtgggcggcagcgtgaacttcgacggcgagaccatcgagggcgccccccccctgtgggccgccagcgccgccggccacctgaaggtggtgcagagcctgctgaaccacggcgccagcgtgaacaacaccaccctgaccaacagcacccccctgagagccgcctgcttcgacggccacctggagatcgtgaagtacctggtggagcacaaggccgacctggaggtgagcaacagacacggccacacctgcctgatgatcagctgctacaagggccacaaggagatcgcccagtacctgctggagaagggcgccgacgtgaacagaaagagcgtgaagggcaacaccgccctgcacgactgcgccgagagcggcagcctggacatcatgaagatgctgctgatgtactgcgccaagatggagaaggacggctacggcatgacccccctgctgagcgccagcgtgaccggccacaccaacatcgtggacttcctgacccaccacgcccagaccagcaagaccgagagaatcaacgccctggagctgctgggcgccaccttcgtggacaagaagagagacctgctgggcgccctgaagtactggaagaaggccatgaacatgagatacagcgacagaaccaacatcatcagcaagcccgtgccccagaccctgatcatggcctacgactacgccaaggaggtgaacagcgccgaggagctggagggcctgatcgccgaccccgacgagatgagaatgcaggccctgctgatcagagagagaatcctgggccccagccaccccgacaccagctactacatcagatacagaggcgccgtgtacgccgacagcggcaacttcaagagatgcatcaacctgtggaagtacgccctggacatgcagcagagcaacctggaccccctgagccccatgaccgccagcagcctgctgagcttcgccgagctgttcagcttcatgctgcaggacagagccaagggcctgctgggcaccaccgtgaccttcgacgacctgatgggcatcctgtgcaagagcgtgctggagatcgagagagccatcaagcagacccagtgccccgccgaccccctgcagctgaacaaggccctgagcatcatcctgcacctgatctgcctgctggagaaggtgccctgcaccctggagcaggaccacttcaagaagcagaccatctacagattcctgaagctgcaccccagaggcaagaacaacttcagccccctgcacctggccgtggacaagaacaccacctgcgtgggcagataccccgtgtgcaagttccccagcctgcaggtgaccgccatcctgatcgagtgcggcgccgacgtgaacgtgagagacagcgacgacaacagccccctgcacatcgccgccctgaacaaccaccccgacatcatgaacctgctgatcaagagcggcgcccacttcgacgccaccaacctgcacaagcagaccgccagcgacctgctggacgagaaggagatcgccaagaacctgatccagcccatcaaccacaccaccctgcagtgcctggccgccagagtgatcgtgaaccacagaatctactacaagggccacatccccgagaagctggagaccttcgtgagcctgcacagatag

SEQ ID NO: 21363 - DNA, 5433 bp, Artificial Sequence
  Description of Artificial Sequence: Synthetic coding sequence
atggagaccctggacagccagagagtgcaggacagactgctggccgcccccggctgcagcagccccagcggccagcaggagctgttcagcagccacgtgatgcaggaggagagcgccaacgacatggagtgcgagcagctgcccgccgagatcctgagacaggtgaccgtgcacagagaccccatctacggcttcggcttcgtggccggcagcgagagacccgtggtggtgagaagcgtgagacccggcggccccagcgagaacaagctgctggccggcgaccagatcgtggccatcaacgaggaggacgtgagcgaggcccccagagagagactgatcgagctgatcagaagcgccaaggagttcatcgtgctgaccgtgctgcacacccaccagagccccaagagcgccttcatcagcgccgccaagaaggccaagctgagaagcaaccccgtgaaggtgagattcagcgagcaggtggccgtgggcgagaccgacgccaagatgatgaagaaggaggccctgctgctgatccccaacgtgctgaaggtgttcctggagaacggccagatcaagagcttcaccttcgacggcagaaccaccgtgaaggacgtgatgctgaccctgcaggacagactgagcctgagattcatcgagcacttcgccctggtgctggagtacgccggccccgagcagaaccacaagttcctgctgctgcaggacaagcagcccctggcctacgtggtgcagagaacccactaccacggcatgaagtgcctgttcagaatcagcttcttccccaaggaccccgtggagctgctgagaagagaccccgccgccttcgagtacctgtacatccagagcagaaacgacgtgatcagagagagattcggcatggaccccaagcccgagatgctgctgggcctggccgccctgcacatctacatcaccgtgagcgccaccagacccagccagaagatcagcctgaagaacgtggagaaggagtggggcctggagcccttcctgccccccagcctgctgcaggtgatcaaggagaagaacctgagaaagagcctgagccagcagctgaaggcccaccagacccaccccagctgcggcaccaagggcagcgccatccaggccaagctgcagtacctgagaatcctgaacgagctgcccaccttcaccggcgtgctgttcaacaccgtgggcctggacgagaagcagagcgccaccaccctgctggtgggccccagacacggcatcagccacgtgatcgacctgaagaccaacctgaccaccgtgctgagcgagttcagcaagatcagcaagatccagctgttcagagagaaccagggcgtggccagagtggagaccagcatcatggacgccaagcccctggtgctgctgatggagtggcccgaggccaccaacttcgcctgcctgatcgccggctactgcagactgctgctggacagcagaaagatggtgttcagcagacccgccagccagcccctgcccccccccatgatcaaggccgactacatgcacagcgcccacagacccgtgaccggcggccacctgggcaagaaggagagcagctacgtgggcagcgtgggcaccagccccagaaagagcagcagatgcacccccccccccgccgacagcgagctggtgagcttctgctacctgcacatgagagagcagagaaaggagcaggagagcagaaccgacgtgaacgagaacctgatcttcttcgaggagaccagacccagaaccaagagcgaccccaccagcaagagcagcggccagggctacgaggtggtgcccgacgacttcgacgccgccagcctggaccacgagccctgcgccagcagagccagaagctacaccctggacaacagcctgggcgccgaggccctgaacttctactgcgacagctgcaaggccaagctgcaggagcagctgggccccagaaagggcggcaagcccggcagcagcagagacaacatcgtggacctgatgagcctgcccccccccggcagcgaggaggaggaggaggaggaggacgagaccaccagcctgctgcccgccatcgccgcccccccccccggcttcagagacaacagcagcgacgaggacgaccccaagagaagagccgtgcagagccaggagcagggcagacacctgagaggcctgctgtacgacgagatccccgtgaccctgatcgacagcgtgcagaccagaaccgtgagagaccacgcccaggagctggacgacgccctggtgagcaccctgcaggccctggaggccctggccgccagcgaggacggcccccaccccccccccccccagaccgccggcctgatcgtgctggccaccatcacccccgagagcagcctggacagcggccacgagaccaacagcagcgagctgaccgacatgagcgagatgatgagcgccatgaagcagcaccagaacaccacctacttcctggcccagcacctgaacaaggacagcctgctggccagaaaggacctgcccttcagaatccagagctgcgccgcccaggccgtgctgaccgccccctacagcctgggcagacccgaccccaaccccagcctgcagcccatcgccaccggccagagccccggcccccccggcgccagaagaaagctgccccagagcgagggccaggtgcagggcgagagaacctacagcctggccgtgcaccccgccctgagcccccagctgagcgagcagaagaacctgagcctgctgagccccgtgcccgaggacaagggccccggccacaccagagccggcctggagatgagcctgagagccgccaccagcagcctgagcgaggagcaggtgagcgagctgagagacaacctgcccaaggaggtgagactgagccccaagctgatcctggaccccaagagcagcgtgacccccgccatcatcagcgccgccctgcagcaggtggtgcacaacaagagcctggtgaccgccggcggcgccctgggcaacccccccagcagaggcgagagaagactggaggccagcatgggcagacccgaggtgagcatgatgagcagcagcgccagcaagaacctgaagttcaagatcagccccagcgcccccgagaccagctggaacagccagcaccagctgggcgccgaggtgagcagcagccccagagcccccaccggcagcagagccgacagcctgcacctgagccagcaggaggacagcctgcccgtgcagaacttcccccccaagagctacctgctgagaaccagcagagagagcgtgggcaagcaggccaccggcgaggtggccggcaagggcggccccgtgggcggcaagcccaccctgcagaagcagggcaccatcagcagccagggcgagaaggcccagctggagagcacccccaagagaagcaagctggaggagaccagcctggtgcccagagccacctaccccatggccctgcagagccccagctgccagagcagaagccacagccccagctgccagccccacggccacagccccagcagccagagcagaggccagagccccagctgccagcccagaggccagagccccctgagaagccaggccgccagcagacaggtgagcaccatgcccagcagaaagctggagaccaccctgaacggcgcccacagcaccagcgagggccccgccaagcccaagagcagcagaggccccttcagactgagaaacctgttcagcgccaccttccccaccagacagaagaaggagaccgacgagagacaggcccagctgcagaaggtgaagcagtacgagctggagttcctggaggagctgctgaagccccccagccagggcgagctgcccggcaccgagtacctgcagccccccgcccccggcagatgcagctgccagctgagaagcagccccgtgcagcagggccccggcatgagcagagagcagagaagaagctgcgactgcaagagaatctgcagaggcggcagaccccaggccacccagacccccgtgcccagcctgagaggcagagagagagacagagtgctgcccagccagagacagcccgaggccggccccggcgtgagcctgagcagccccatcaacgtgcagagaatcagaagcaccagcctggagagcagagagtgcagaagcgaccccgagagcggcgtgagctgcctgaccacctgcgccagcggcggcgagtgcctgggcgcccccaactacagaaagctgatgagaagatacagcatcagcgagctggaccagggcgacagagccagcctgaccagcgacgtgtacccccacccccccctgggcatgctgcccagagaggccaaggaggtggaggccagcctgcccatcgccctgggccccaagagcagaagcctggagagccccaccctgggcgaccccagctacgtgcaggtggcccccgagaccaagggccccagacagatggccgtgttcagcctgcccgaggaggtgtacagaaagcccgccgagctggacgaggacagcgagagcagcaagtgctgcagcatcagatactgcttctactacagaaagtgcgacatggccgacgacgccagcgacggcaaggacgagctgagctacagcatccccatgaagatcctgcccggcatgaagctggacgagcaggtggtgcccgtggtgagcagaaccctgcaggtgctggacgccgccacctgcagcagcagcagccccgaggccagcagaacccaggagatcgacctgagagtgagcaccttcgagggcagcctggccaagatcaacgccctgagagcccacgcctacggcctgcccgacggcttcctggccgccagactggacaccaacgagctgctgaccgtgctgagacagtgcgtggccagccccgaggccagagcccccaagccctacgtgagccagatcagcgagtacaagctggagctggccctgaagttcaaggagctgagagccagctgcagaagagtggccaacgtggacaagagccccacccacatgctggccgccatcaccggcagcttccaggtgctgagcagcctgatcgagaccttcgtgagactggtgttcatcgtgagaagcgaggcccagagacaggagctgctggccaaggtggaggaggtggtgagaaactacaccttcctgctgagagccgccgaggagagcaccgccagaaacctgaaccagcagcagcagcagcagcagcagcagcagcagcagcagcagcagcagcagcagcagcagcagcagcagcagcagcagcaggtggccgccgccgccggcgccgccaccgagcacccccccggcagccccaccagcgccaccgtgatgagcaccttcacccacagcctgaagaccctgatcaagtag

SEQ ID NO: 21364 - DNA, 1650 bp, Artificial Sequence
  Description of Artificial Sequence: Synthetic coding sequence
atggccgtgccccccagaggcagaggcatcgaccccgccagaaccaaccccgacaccttcccccccagcggcgccagatgcatggagcccagccccgagagacccgcctgcagccagcaggagcccaccctgggcatggacgccatggccagcgagcacagagacgtgctggtgctgctgcccagcagagagcagctgagactggccgtgggcgtgaaggccaccggcagagagctgttccagcaggtgtgcaacgtggccagcatcagagacgcccagttcttcggcctgtgcgtggtgagaaacaacgagtacatcttcatggacctggagcagaagctgagcaagtacttcagcaaggactggaagaaggagagaaacgagggcaacgagaagcccagagcccccttcgtggccttcctgagagtgcagcactacgtggagaacggcagagtgatcagcgaccacagagccagacacctgtactactgccacctgaaggagagagtgctgagaagccagtgcgcccacagagaggaggcctacttcctgctggccgcctgcgccctgcaggccgacctgggcgagcacagagagagcgcccacgccggcagatacttcgagccccacagctacttcccccagtggatcatcaccaagagaggcatcgactacatcctgagacacatgcccaccctgcacagagagagacagggcctgagccccaaggaggccatgctgtgcttcatccaggaggcctgcagactggaggacgtgcccgtgcacttcttcagactgcacaaggacaagaaggagggcagacccaccgtgatcctgggcctggccctgagaggcgtgcacatctaccagggcaagaagctggagatccagctggacggcctgcccgccgcccagaagctggtgtactacaccggctgcacctggagaagcagacacctgctgcacctgctgagagccagccaccagctgcacctgagagtgagacccaccctgcagcagctgagacagagagaggaggccgaggagaagcagcactacagagagagctacatcagcgacgagctggagctggacctggccagcagaagcttccccggcagcggcgtgagcagccagcactgcccccactgcctgagcagacacagcgccgacagccacggcagcagctacaccagcggcatcaaggccaacagctggctgagagagagcagagagatgagcgtggacgtgcccctggaggtgcacggcctgcacgagaaggagcccagcagcagccccagaaccagcagaagccaccccagcaccagaggcgacagccaggccaccagacaggagccctgcacccaggtgagaaccagaggccagagcgccgaggccgtgcaccagatccaggagatgaccgccggcgtgagcgaggagcagcacagccacggcctggacgacatgcagctgcaccagctggccctgcaccccgcccccaccagcctgagccacaccttccacagagccctggactgcagactggccggcccctgcgagaccagagccaccctgcccagcaagagaagcagcaactgcctggccctggacctgttcggcgaggcccccccccaggagttcgtggtgtag

SEQ ID NO: 21365 - DNA, 1446 bp, Artificial Sequence
  Description of Artificial Sequence: Synthetic coding sequence
atggacgacgtgaaggccaccggcagagagctgttccagcaggtgtgcaacgtggccagcatcagagacgcccagttcttcggcctgtgcgtggtgagaaacaacgagtacatcttcatggacctggagcagaagctgagcaagtacttcagcaaggactggaagaaggagagaaacgagggcaacgagaagcccagagcccccttcgtggccttcctgagagtgcagcactacgtggagaacggcagagtgatcagcgaccacagagccagacacctgtactactgccacctgaaggagagagtgctgagaagccagtgcgcccacagagaggaggcctacttcctgctggccgcctgcgccctgcaggccgacctgggcgagcacagagagagcgcccacgccggcagatacttcgagccccacagctacttcccccagtggatcatcaccaagagaggcatcgactacatcctgagacacatgcccaccctgcacagagagagacagggcctgagccccaaggaggccatgctgtgcttcatccaggaggcctgcagactggaggacgtgcccgtgcacttcttcagactgcacaaggacaagaaggagggcagacccaccgtgatcctgggcctggccctgagaggcgtgcacatctaccagggcaagaagctggagatccagctggacggcctgcccgccgcccagaagctggtgtactacaccggctgcacctggagaagcagacacctgctgcacctgctgagagccagccaccagctgcacctgagagtgagacccaccctgcagcagctgagacagagagaggaggccgaggagaagcagcactacagagagagctacatcagcgacgagctggagctggacctggccagcagaagcttccccggcagcggcgtgagcagccagcactgcccccactgcctgagcagacacagcgccgacagccacggcagcagctacaccagcggcatcaaggccaacagctggctgagagagagcagagagatgagcgtggacgtgcccctggaggtgcacggcctgcacgagaaggagcccagcagcagccccagaaccagcagaagccaccccagcaccagaggcgacagccaggccaccagacaggagccctgcacccaggtgagaaccagaggccagagcgccgaggccgtgcaccagatccaggagatgaccgccggcgtgagcgaggagcagcacagccacggcctggacgacatgcagctgcaccagctggccctgcaccccgcccccaccagcctgagccacaccttccacagagccctggactgcagactggccggcccctgcgagaccagagccaccctgcccagcaagagaagcagcaactgcctggccctggacctgttcggcgaggcccccccccaggagttcgtggtgtag

SEQ ID NO: 21366 - DNA, 963 bp, Artificial Sequence
  Description of Artificial Sequence: Synthetic coding sequence
atgcccaccctgcacagagagagacagggcctgagccccaaggaggccatgctgtgcttcatccaggaggcctgcagactggaggacgtgcccgtgcacttcttcagactgcacaaggacaagaaggagggcagacccaccgtgatcctgggcctggccctgagaggcgtgcacatctaccagggcaagaagctggagatccagctggacggcctgcccgccgcccagaagctggtgtactacaccggctgcacctggagaagcagacacctgctgcacctgctgagagccagccaccagctgcacctgagagtgagacccaccctgcagcagctgagacagagagaggaggccgaggagaagcagcactacagagagagctacatcagcgacgagctggagctggacctggccagcagaagcttccccggcagcggcgtgagcagccagcactgcccccactgcctgagcagacacagcgccgacagccacggcagcagctacaccagcggcatcaaggccaacagctggctgagagagagcagagagatgagcgtggacgtgcccctggaggtgcacggcctgcacgagaaggagcccagcagcagccccagaaccagcagaagccaccccagcaccagaggcgacagccaggccaccagacaggagccctgcacccaggtgagaaccagaggccagagcgccgaggccgtgcaccagatccaggagatgaccgccggcgtgagcgaggagcagcacagccacggcctggacgacatgcagctgcaccagctggccctgcaccccgcccccaccagcctgagccacaccttccacagagccctggactgcagactggccggcccctgcgagaccagagccaccctgcccagcaagagaagcagcaactgcctggccctggacctgttcggcgaggcccccccccaggagttcgtggtgtag

SEQ ID NO: 21367 - DNA, 1395 bp, Artificial Sequence
  Description of Artificial Sequence: Synthetic coding sequence
atggacggcaccgagggcagcgccggccagcccggccccgccgagagaagccacagaagcagcgtgagcagcgtgggcgccagagccgccgacgtgctggtgtacctggccgacgacaccgtggtgcccctggccgtggagaacctgcccagcctgagcgcccacgagctgcacagagccgtgagagaggtgctgcagctgcccgacatcgccctggacgtgttcgccctgtggctggtgagccccctgctggaggtgcagctgaagcccaagcaccagccctacaagctgggcagacagtggcccgagctgctgctgagattcaccagcgcccccgacgacgacgtggccatggacgagcccttcctgcagttcagaagaaacgtgttcttccccaagagaagagagctgcagatccacgacgaggaggtgctgagactgctgtacgaggaggccaagggcaacgtgctggccgccagatacccctgcgacgtggaggactgcgaggccctgggcgccctggtgtgcagagtgcagctgggcccctaccagcccggcagacccgccgcctgcgacctgagagagaagctggacagcttcctgcccgcccacctgtgcaagagaggccagagcctgttcgccgccctgagaggcagaggcgccagagccggccccggcgagcagggcctgctgaacgcctacagacaggtgcaggaggtgagcagcgacggcggctgcgaggccgccctgggcacccactacagagcctacctgctgaagtgccacgagctgcccttctacggctgcgccttcttccacggcgaggtggacaagcccgcccagggcttcctgcacagaggcggcagaaagcccgtgagcgtggccatcagcctggagggcgtgcacgtgatcgacagcagagagaagcacgtgctgctgggcctgagattccaggagctgagctgggaccacaccagccccgaggaggaggagcccatcctgtggctggagttcgacggcgacagcgagggcacccccgtgaacaagctgctgaagatctacagcaagcaggccgagctgatgagcagcctgatcgagtactgcatcgagctgagccaggccgccgagcccgccggcccccaggacagcgccaccggcagccccagcgaccccagcagcagcctggcccccgtgcagagacccaagctgagaagacagggcagcgtggtgagcagcagaatccagcacctgagcaccatcgactacgtggaggacggcaagggcatcagaagagtgaagcccaagagaaccaccagcttcttcagcagacagctgagcctgggccagggcagctacaccgtggtgcagcccggcgacagcctggagcagggctag

SEQ ID NO: 21368 - DNA, 1293 bp, Artificial Sequence
  Description of Artificial Sequence: Synthetic coding sequence
atggacggcaccgagggcagcgccggccagcccggccccgccgagagaagccacagaagcagcgtgagcagcgtgggcgccagagccgccgacgtgctggtgtacctggccgacgacaccgtggtgcccctggccgtggagaacctgcccagcctgagcgcccacgagctgcacagagccgtgagagaggtgctgcagctgcccgacatcgccctggacgtgttcgccctgtggctggtgagccccctgctggacgagcccttcctgcagttcagaagaaacgtgttcttccccaagagaagagagctgcagatccacgacgaggaggtgctgagactgctgtacgaggaggccaagggcaacgtgctggccgccagatacccctgcgacgtggaggactgcgaggccctgggcgccctggtgtgcagagtgcagctgggcccctaccagcccggcagacccgccgcctgcgacctgagagagaagctggacagcttcctgcccgcccacctgtgcaagagaggccagagcctgttcgccgccctgagaggcagaggcgccagagccggccccggcgagcagggcctgctgaacgcctacagacaggtgcaggaggtgagcagcgacggcggctgcgaggccgccctgggcacccactacagagcctacctgctgaagtgccacgagctgcccttctacggctgcgccttcttccacggcgaggtggacaagcccgcccagggcttcctgcacagaggcggcagaaagcccgtgagcgtggccatcagcctggagggcgtgcacgtgatcgacagcagagagaagcacgtgctgctgggcctgagattccaggagctgagctgggaccacaccagccccgaggaggaggagcccatcctgtggctggagttcgacggcgacagcgagggcacccccgtgaacaagctgctgaagatctacagcaagcaggccgagctgatgagcagcctgatcgagtactgcatcgagctgagccaggccgccgagcccgccggcccccaggacagcgccaccggcagccccagcgaccccagcagcagcctggcccccgtgcagagacccaagctgagaagacagggcagcgtggtgagcagcagaatccagcacctgagcaccatcgactacgtggaggacggcaagggcatcagaagagtgaagcccaagagaaccaccagcttcttcagcagacagctgagcctgggccagggcagctacaccgtggtgcagcccggcgacagcctggagcagggctag

SEQ ID NO: 21369 - DNA, 273 bp, Artificial Sequence
  Description of Artificial Sequence: Synthetic coding sequence
atggacggcaccgagggcagcgccggccagcccggccccgccgagagaagccacagaagcagcgtgagcagcgtgggcgccagagccgccgacgtgctggtgtacctggccgacgacaccgtggtgcccctggccgtggagaacctgcccagcctgagcgcccacgagctgcacagagccgtgagagaggtgctgcagctgcccgacatcgccctggacgtgttcgccctgtggctggtgagccccctgctggaggtgcagctgaagccctag

SEQ ID NO: 21370 - DNA, 1875 bp, Artificial Sequence
  Description of Artificial Sequence: Synthetic coding sequence
atggcccccagaagactgctgctggtgggcgagggcaacttcagcttcgccgccgccctgagcgagaccctggaccagagcacccagctgaccgccacctgcctgcagagacccgccgagctggccagagaccccctggcctgggagaacctgcagtgcctgagagagagaggcatcgacgtgagattcggcgtggactgcacccagctggccgacgtgttcgagctgcacgagagagagttcgaccagatctacttcatcttcccccactgcggcagaaaggccggcgtggccaagaacagagagctgctggccaagttcttccagagctgcgccgacgtgctggccgaggagggcgaggtgcacgtggccctgtgcagaggccagggcggcacccccgccgacaagccccagagagagtggcacaacagctggcaggtggtggccatggccgccctgggcggcctgatcctgagcgacgtgtaccccttcagctgcaaggccgtggccggctacaagtgcaccggctacagaagccaggacaagagcttccacgtggagggcgccctgaaccacatcttcaccagaagcctgcccttcgagggcagccagcccagaatcttcagaatcaagctgggcaaccagtggttcagcttccccgagcccgaggccctggtgggcaagctgaacagaggcttcctggaggcccccagctgccaccccatcaagaccatcaacgagaagctgatcgccgagctgggcaaggtgttccccctgaagagactgaagtgcagctaccccctgctgccccaggagggcaccagcgtgctgcccttctggaactgcgacttcctgagcgccgccttctggatcagcctgcacgaggacaacagcaacagcgagagcctgaccggcggcaccagccaggacgtggaggacttcctggtgagcttcagcgagctgagcctgctgaagaaccccggcagagacggcaaggaggaggcctgcgagggcacctgcggccaggccaagatctgcctgagacccagcctgctggtgcacgtgcaggacgtgatcgaggtgcccgacttcctgagcggcagcctgcacatcctgagcggccccgtgttccagaagtgccacatcctgcccttcaccatgcccgccttccacgagaccctgttcatcctgggcgtgaaccagaacctgaaggacggctgcctgcagagcctgctggaccacctgaagggcatcctggacagcctgctgacccagaccctgcccgagagcagcaagctgagcagcctggtgaagttcgtgctgcagagcaacggcaaggactacatgatcagagtgaagacccacaacttcagccccgactgcaccgaggacctgatcatcggcagcgtgatcaccagcgccaccagcgtgatccacaaggaccagtgcttcgtgttcgtgagcatgaacctggacctgctggccatgctggtgtggtgcatcagcgactggagaatgctgtggaccttcgacaacagattcctgaagaacttcgtgcccggcaagatcgagcccttcaagagccacagcctgtaccccccctgctacgtgcacgacgtgagcttctggatcgaccagaagaagggcttcgacgagctggagttccacaccgtggccagagccgtgagccaggacaccatcatcagcatccagttcctgagcagattccagcaccccaagacccagcaggtgagcctgtgctacagactgacctaccagacctgcgacaaggccctgacccagcagcaggtggccagcatgcagagccagttcagaaaggagatccagcagcacctgtacgtgatccccagatag

SEQ ID NO: 21371 - DNA, 1428 bp, Artificial Sequence
  Description of Artificial Sequence: Synthetic coding sequence
atggccgccctgggcggcctgatcctgagcgacgtgtaccccttcagctgcaaggccgtggccggctacaagtgcaccggctacagaagccaggacaagagcttccacgtggagggcgccctgaaccacatcttcaccagaagcctgcccttcgagggcagccagcccagaatcttcagaatcaagctgggcaaccagtggttcagcttccccgagcccgaggccctggtgggcaagctgaacagaggcttcctggaggcccccagctgccaccccatcaagaccatcaacgagaagctgatcgccgagctgggcaaggtgttccccctgaagagactgaagtgcagctaccccctgctgccccaggagggcaccagcgtgctgcccttctggaactgcgacttcctgagcgccgccttctggatcagcctgcacgaggacaacagcaacagcgagagcctgaccggcggcaccagccaggacgtggaggacttcctggtgagcttcagcgagctgagcctgctgaagaaccccggcagagacggcaaggaggaggcctgcgagggcacctgcggccaggccaagatctgcctgagacccagcctgctggtgcacgtgcaggacgtgatcgaggtgcccgacttcctgagcggcagcctgcacatcctgagcggccccgtgttccagaagtgccacatcctgcccttcaccatgcccgccttccacgagaccctgttcatcctgggcgtgaaccagaacctgaaggacggctgcctgcagagcctgctggaccacctgaagggcatcctggacagcctgctgacccagaccctgcccgagagcagcaagctgagcagcctggtgaagttcgtgctgcagagcaacggcaaggactacatgatcagagtgaagacccacaacttcagccccgactgcaccgaggacctgatcatcggcagcgtgatcaccagcgccaccagcgtgatccacaaggaccagtgcttcgtgttcgtgagcatgaacctggacctgctggccatgctggtgtggtgcatcagcgactggagaatgctgtggaccttcgacaacagattcctgaagaacttcgtgcccggcaagatcgagcccttcaagagccacagcctgtaccccccctgctacgtgcacgacgtgagcttctggatcgaccagaagaagggcttcgacgagctggagttccacaccgtggccagagccgtgagccaggacaccatcatcagcatccagttcctgagcagattccagcaccccaagacccagcaggtgagcctgtgctacagactgacctaccagacctgcgacaaggccctgacccagcagcaggtggccagcatgcagagccagttcagaaaggagatccagcagcacctgtacgtgatccccagatag

SEQ ID NO: 21372 - DNA, 1656 bp, Artificial Sequence
  Description of Artificial Sequence: Synthetic coding sequence
atgagcggcggcgagcagaagcccgagagatactacgtgggcgtggacgtgggcaccggcagcgtgagagccgccctggtggaccagagcggcgtgctgctggccttcgccgaccagcccatcaagaactgggagccccagttcaaccaccacgagcagagcagcgaggacatctgggccgcctgctgcgtggtgaccaagaaggtggtgcagggcatcgacctgaaccagatcagaggcctgggcttcgacgccacctgcagcctggtggtgctggacaagcagttccaccccctgcccgtgaaccaggagggcgacagccacagaaacgtgatcatgtggctggaccacagagccgtgagccaggtgaacagaatcaacgagaccaagcacagcgtgctgcagtacgtgggcggcgtgatgagcgtggagatgcaggcccccaagctgctgtggctgaaggagaacctgagagagatctgctgggacaaggccggccacttcttcgacctgcccgacttcctgagctggaaggccaccggcgtgaccgccagaagcctgtgcagcctggtgtgcaagtggacctacagcgccgagaagggctgggacgacagcttctggaagatgatcggcctggaggacttcgtggccgacaactacagcaagatcggcaaccaggtgctgccccccggcgccagcctgggcaacggcctgacccccgaggccgccagagacctgggcctgctgcccggcatcgccgtggccgccagcctgatcgacgcccacgccggcggcctgggcgtgatcggcgccgacgtgagaggccacggcctgatctgcgagggccagcccgtgaccagcagactggccgtgatctgcggcaccagcagctgccacatgggcatcagcaaggaccccatcttcgtgcccggcgtgtggggcccctacttcagcgccatggtgcccggcttctggctgaacgagggcggccagagcgtgaccggcaagctgatcgaccacatggtgcagggccacgccgccttccccgagctgcaggtgaaggccaccgccagatgccagagcatctacgcctacctgaacagccacctggacctgatcaagaaggcccagcccgtgggcttcctgaccgtggacctgcacgtgtggcccgacttccacggcaacagaagccccctggccgacctgaccctgaagggcatggtgaccggcctgaagctgagccaggacctggacgacctggccatcctgtacctggccaccgtgcaggccatcgccctgggcaccagattcatcatcgaggccatggaggccgccggccacagcatcagcaccctgttcctgtgcggcggcctgagcaagaaccccctgttcgtgcagatgcacgccgacatcaccggcatgcccgtggtgctgagccaggaggtggagagcgtgctggtgggcgccgccgtgctgggcgcctgcgccagcggcgacttcgccagcgtgcaggaggccatggccaagatgagcaaggtgggcaaggtggtgttccccagactgcaggacaagaagtactacgacaagaagtaccaggtgttcctgaagctggtggagcaccagaaggagtacctggccatcatgaacgacgactag

SEQ ID NO: 21373 - DNA, 558 bp, Artificial Sequence
  Description of Artificial Sequence: Synthetic coding sequence
atgagcggcggcgagcagaagcccgagagatactacgtgggcgtggacgtgggcaccggcagcgtgagagccgccctggtggaccagagcggcgtgctgctggccttcgccgaccagcccatcaagaactgggagccccagttcaaccaccacgagcagagcagcgaggacatctgggccgcctgctgcgtggtgaccaagaaggtggtgcagggcatcgacctgaaccagatcagaggcctgggcttcgacgccacctgcagcctggtggtgctggacaagcagttccaccccctgcccgtgaaccaggagggcgacagccacagaaacgtgatcatgtggctggaccacagagccgtgagccaggtgaacagaatcaacgagaccaagcacagcgtgctgcagtacgtgggcggcgtgatgagcgtggagatgcaggcccccaagctgctgtggctgaaggagaacctgagagagatctgctgggacaaggccggccacttcttcgacctgcccgacttcctgagctggaaggccaccggcgtgaccgccagatag

SEQ ID NO: 21374 - DNA, 1392 bp, Artificial Sequence
  Description of Artificial Sequence: Synthetic coding sequence
atgagcggcggcgagcagaagcccgagagatactacgtgggcgtggacgtgggcaccggcagcgtgagagccgccctggtggaccagagcggcgtgctgctggccttcgccgaccagcccatcaagaactgggagccccagttcaaccaccacgagcagagcagcgaggacatctgggccgcctgctgcgtggtgaccaagaacctgagagagatctgctgggacaaggccggccacttcttcgacctgcccgacttcctgagctggaaggccaccggcgtgaccgccagaagcctgtgcagcctggtgtgcaagtggacctacagcgccgagaagggctgggacgacagcttctggaagatgatcggcctggaggacttcgtggccgacaactacagcaagatcggcaaccaggtgctgccccccggcgccagcctgggcaacggcctgacccccgaggccgccagagacctgggcctgctgcccggcatcgccgtggccgccagcctgatcgacgcccacgccggcggcctgggcgtgatcggcgccgacgtgagaggccacggcctgatctgcgagggccagcccgtgaccagcagactggccgtgatctgcggcaccagcagctgccacatgggcatcagcaaggaccccatcttcgtgcccggcgtgtggggcccctacttcagcgccatggtgcccggcttctggctgaacgagggcggccagagcgtgaccggcaagctgatcgaccacatggtgcagggccacgccgccttccccgagctgcaggtgaaggccaccgccagatgccagagcatctacgcctacctgaacagccacctggacctgatcaagaaggcccagcccgtgggcttcctgaccgtggacctgcacgtgtggcccgacttccacggcaacagaagccccctggccgacctgaccctgaagggcatggtgaccggcctgaagctgagccaggacctggacgacctggccatcctgtacctggccaccgtgcaggccatcgccctgggcaccagattcatcatcgaggccatggaggccgccggccacagcatcagcaccctgttcctgtgcggcggcctgagcaagaaccccctgttcgtgcagatgcacgccgacatcaccggcatgcccgtggtgctgagccaggaggtggagagcgtgctggtgggcgccgccgtgctgggcgcctgcgccagcggcgacttcgccagcgtgcaggaggccatggccaagatgagcaaggtgggcaaggtggtgttccccagactgcaggacaagaagtactacgacaagaagtaccaggtgttcctgaagctggtggagcaccagaaggagtacctggccatcatgaacgacgactag

SEQ ID NO: 21375 - DNA, 1728 bp, Artificial Sequence
  Description of Artificial Sequence: Synthetic coding sequence
atgagcggcggcgagcagaagcccgagagatactacgtgggcgtggacgtgggcaccggcagcgtgagagccgccctggtggaccagagcggcgtgctgctggccttcgccgaccagcccatcaagaactgggagccccagttcaaccaccacgagcagagcagcgaggacatctgggccgcctgctgcgtggtgaccaagaaggtggtgcagggcatcgacctgaaccagatcagaggcctgggcttcgacgccacctgcagcctggtggtgctggacaagcagttccaccccctgcccgtgaaccaggagggcgacagccacagaaacgtgatcatgtggctggaccacagagccgtgagccaggtgaacagaatcaacgagaccaagcacagcgtgctgcagtacgtgggcggcgtgatgagcgtggagatgcaggcccccaagctgctgtggctgaaggagaacctgagagagatctgctgggacaaggccggccacttcttcgacctgcccgacttcctgagctggaaggccaccggcgtgaccgccagaagcctgtgcagcctggtgtgcaagtggacctacagcgccgagaagggctgggacgacagcttctggaagatgatcggcctggaggacttcgtggccgacaactacagcaagatcggcaaccaggtgctgccccccggcgccagcctgggcaacggcctgacccccgaggccgccagagacctgggcctgctgcccggcatcgccgtggccgccagcctgatcgacgcccacgccggcggcctgggcgtgatcggcgccgacgtgagaggccacggcctgatctgcgagggccagcccgtgaccagcagactggccgtgatctgcggcaccagcagctgccacatgggcatcagcaaggaccccatcttcgtgcccggcgtgtggggcccctacttcagcgccatggtgcccggcttctggctgaacgagggcggccagagcgtgaccggcaagctgatcgaccacatggtgcagggccacgccgccttccccgagctgcaggtgaaggccaccgccagatgccagagcatctacgcctacctgaacagccacctggacctgatcaagaaggcccagcccgtgggcttcctgaccgtggacctgcacgtgtggcccgacttccacggcaacagaagccccctggccgacctgaccctgaagggcatgagaaccaccggctacctgtacatccccgccctggccgccctgcacagccccagcagcctgctgagcccccaggtgaccggcctgaagctgagccaggacctggacgacctggccatcctgtacctggccaccgtgcaggccatcgccctgggcaccagattcatcatcgaggccatggaggccgccggccacagcatcagcaccctgttcctgtgcggcggcctgagcaagaaccccctgttcgtgcagatgcacgccgacatcaccggcatgcccgtggtgctgagccaggaggtggagagcgtgctggtgggcgccgccgtgctgggcgcctgcgccagcggcgacttcgccagcgtgcaggaggccatggccaagatgagcaaggtgggcaaggtggtgttccccagactgcaggacaagaagtactacgacaagaagtaccaggtgttcctgaagctggtggagcaccagaaggagtacctggccatcatgaacgacgactag

SEQ ID NO: 21376 - DNA, 3432 bp, Artificial Sequence
  Description of Artificial Sequence: Synthetic coding sequence
atgcacgtgatgaactgcgtgagcctggtgagcgacaaggagaacggcaacatcgccaccgcccccggcttcatgatcggccagacccccccccccgccccccccccccccccccccccccccccccccagccccccctgcagctgcagcagagaggagtgccccagcagcccccccccccccccccccccccccctgcccggcgagccccccatccccccccccccccccggcctgccccccaccacccacatgaacggctacagccacctgggcaagaagaagagaatgagaagcttcttctggaagaccatccccgaggagcaggtgagaggcaagaccaacatctggaccctggccgccagacaggagcaccactaccagatcgacaccaagaccatcgaggagctgttcggccagcaggaggacaccaccaagagcagcctgcccagaagaggcagaaccctgaacagcagcttcagagaggccagagaggagatcaccatcctggacgccaagagaagcatgaacatcggcatcttcctgaagcagttcaagaagagccccagaagcatcgtggaggacatccaccagggcaagagcgagcactacggcagcgagaccctgagagagttcctgaagttcctgcccgagagcgaggaggtgaagaagctgaaggccttcagcggcgacgtgagcaagctgagcctggccgacagcttcctgtacggcctgatccaggtgcccaactacagcctgagaatcgaggccatggtgctgaagaaggagttcctgcccagctgcagcagcctgtacaccgacatcaccgtgctgagaaccgccatcaaggagctgatgagctgcgaggagctgcacagcatcctgcacctggtgctgcaggccggcaacatcatgaacgccggcggctacgccggcaacgccgtgggcttcaagctgagcagcctgctgaagctggccgacaccaaggccaacaagcccggcatgaacctgctgcacttcgtggcccaggaggcccagaagaaggacaccatcctgctgaacttcagcgagaagctgcaccacgtgcagaagaccgccagactgagcctggagaacaccgaggccgagctgcacctgctgttcgtgagaaccaagagcctgaaggagaacatccagagagacggcgagctgtgccagcagatggaggacttcctgcagttcgccatcgagaagctgagagagctggagtgctggaagcaggagctgcaggacgaggcctacaccctgatcgacttcttctgcgaggacaagaagaccatgaagctggacgagtgcttccagatcttcagagacttctgcaccaagttcaacaaggccgtgaaggacaaccacgacagagaggcccaggagctgagacagctgcagagactgaaggagcaggagcagaagcagagaagctgggccaccggcgagctgggcgccttcggcagaagcagcagcgagaacgacgtggagctgctgaccaagaagggcgccgagggcctgctgcccttcctgcaccccagacccatcagccccagcagccccagctacagaccccccaacaccagaagaagcagactgagcctgggccccagcgccgacagagagctgctgaccttcctggagagcagcaccggcagccccgaggagcccaacaagttccacagcctgcccagaagcagccccagacaggccagacccaccatcgcctgcctggagcccgccgaggtgagacaccaggacagcagcttcgcccacaagccccaggccagcggcggccaggaggaggcccccaacccccccagcgcccaggcccaccagctggccgccgcccagcccgagaaccacgccagcgccttccccagagccagaagacagggcgtgagcgtgctgagaaagagatacagcgagcccgtgagcctgggcagcgcccagagcccccccctgagccccctggccctgggcatcaaggagcacgagctggtgaccggcctggcccagttcaacctgcagggcagccagggcatggaggagaccagccagctgaccctgagcgacttcagccccatggagctggagagcgtgggccacagaggcccccagagcctgagcgccagcagcagcagcctgacccccatgggcagagacgccctgggcagcctgagccccgccctggaggacggcaaggccgcccccgacgagcccggcagcgccgccctgggcagcgtgggcagcagcgaccccgagaacaaggaccccagacccctgttctgcatcagcgacaccaccgactgcagcctgaccctggactgcagcgagggcaccgacagcagacccagaggcggcgaccccgaggagggcggcgagggcgacggcagcatgagcagcggcgtgggcgagatgggcgacagccaggtgagcagcaaccccaccagcagcccccccggcgaggcccccgcccccgtgagcgtggacagcgagcccagctgcaagggcggcctgcccagagacaagcccaccaagagaaaggacgtggtggcccccaagagaggcagcctgaaggaggccagccccggcgccagcaagcccggcagcgccagaagaagccagggcgccgtggccaagagcgtgagaaccctgaccgccagcgagaacgagagcatgagaaaggtgatgcccatcaccaagagcagcagaggcgccggctggagaagacccgagctgagcagcagaggccccagccagaacccccccagcagcaccgacaccgtgtggagcagacagaacagcgtgagaagagccagcaccggcgccgaggagcagagactgcccagaggcagcagcggcagcagcagcaccagacccggcagagacgtgcccctgcagcccagaggcagcttcaagaagcccagcgccaagcccctgagaaacctgcccagacagaagcccgaggagaacaagacctgcagagcccacagcgagggccccgagagccccaaggaggagcccaagacccccagcgtgcccagcgtgccccacgagctgcccagagtgcccagcttcgccagaaacaccgtggccagcagcagcagaagcatgagaaccgacctgccccccgtggccaaggcccccggcatcaccagaaccgtgagccagagacagctgagagtgaagggcgaccccgaggacgccgcccccaaggacagcagcaccctgagaagagccagcagcgccagagcccccaagaagagacccgagagcgccgagggccccagcgccaacaccgaggcccccctgaaggccagaggcgccggcgagagagccagcctgagaagaaaggacagcagcagaaccaccctgggcagaatcctgaaccccctgagaaagtag

SEQ ID NO: 21377 - DNA, 3432 bp, Artificial Sequence; identical to SEQ ID NO: 21376
  Description of Artificial Sequence: Synthetic coding sequence

SEQ ID NO: 21378 - DNA, 2250 bp, Artificial Sequence
  Description of Artificial Sequence: Synthetic coding sequence
atggaggaggagagcggcgaggagctgggcctggacagaagcacccccaaggacttccacttctaccacatggacctgtacgacagcgaggacagactgcacctgttccccgaggagaacaccagaatgagaaaggtggtgcaggccgagatggccaacgagagcagaggcgccggcgacggcaaggcccagagagacctgcaggaggaggtggacgagctggtgcacctgtacggcctggaggacgaccacgagctgggcgacgagttcgtggacgagaacatccccagaaccggcgtgagcgagtaccccccctacatgatgaagagaagagaccccgccagagagcagagagactggagactgagcggcgaggccgccgaggccgaggacctgggcttcggcggctggggcagcgccggccagtgccaggacctgagagaggcctacagatacacccacggcagagccagcgaggagtacgagtgctacgtgatccccgaggaggaggacgaggaggaggccgccgacgtgttctgcgtgacctgcaagacccccatcagagccttccagaaggtgttcgacgagcacaaggagcacgaggtgatccccctgaacgaggccctggagagcgccaaggacgagatccacaagaacatgtacaagctggagaagcagatcatcgagatggagaacttcgccaaccacctggaggaggtgttcatcaccgtggaggagaacttcggcaagcaggagcagaacttcgagagccactacaacgagatcctggagaccctggcccagaagtacgaggagaagatccaggccctgggcgagaagaagaaggagaagctggaggccctgtacggccagctggtgagctgcggcgagaacctggacacctgcaaggagctgatggagaccatcgaggagatgtgccacgaggagaaggtggacttcatcaaggacgccgtggccatggccgacagactgggcaagttcctgaagaccaagaccgacgtggagatcagcgcccagcccgagttcgaggaccagaccctggacttcagcgacgtggagcagctgatgggcagcatcaacaccatccccgcccccagcgcccccgtgatcaacccccaggtgcccaacagcgccaccggcagcagcgtgagagtgtgctggagcctgtacagcgacgacaccgtggagagctaccagctgagctacagacccgtgcaggacagcagccccggcaccgaccaggccgagttcaccgtgaccgtgaaggagacctactgcagcgtgaccaacctggtgcccaacacccagtacgagttctgggtgaccgcccacaacagagccggccccagccccagcagcgagagagccgtgtacatgaccgcccccagcccccccatcatcaagaccaaggagatcagaagctgcgaggaggccgtgctgatctgctgggagagcggcaacctgaaccccgtggacagctacaccgtggagctgacccaggccgagagccccgaggccagcggcgtgaccgagagcgtggtgggcatccccacctgcgagagcgtggtgcagctgcagcccggcagaagctacatcatctacgtgagagccctgaacatgggcggccccagcgtgagaagcgagcccgccaccgtgcacaccatcggcagctacttcagactgaacaaggacacctgccacccctggctgaccatcagcgaggacggcctgaccgccgtgagaagcgagagaagaacccccgccagagagctgagccccagcgacacccacttcaccagatgcgtggccgtgatgggcaacctgatccccgtgagaggccaccactactgggaggtggaggtggacgagcacctggactacagagtgggcgtggccttcgccgacgtgagaaagcaggaggacctgggcgccaactgcctgagctggtgcatgagacacaccttcgccagcagcagacacaagtacgagttcctgcacaacagaaccacccccgacatcagaatcaccgtgccccccaagaagatcggcatcctgctggactacgagcacagcaagctgagcttcttcaacgtggacctgagccagcacctgtacaccttcagctgccagctgcacgagttcgtgcacccctgcttcagcctggagaagcccggctgcctgaaggtgcacaacggcatcagcatgcccaagcacgtgaccttctactag

SEQ ID NO: 21379 - DNA, 306 bp, Artificial Sequence
  Description of Artificial Sequence: Synthetic coding sequence
atggaggaggagagcggcgaggagctgggcctggacagaagcacccccaaggacttccacttctaccacatggacctgtacgacagcgaggacagactgcacctgttccccgaggagaacaccagaatgagaaaggtggtgcaggccgagatggccaacgagagcagaggcgccggcgacggcaaggcccagagagacctgcaggaggaggtggacgagctggtgcacctgtacggcctggaggacgaccacgagctgggcgacgagttcgtggacgagaacatccccagaaccggcgtgagctag

SEQ ID NO: 21380 - DNA, 975 bp, Artificial Sequence
  Description of Artificial Sequence: Synthetic coding sequence
atggccagcgaggccctgcaccaggtgggcgacggcgaggaggccgtgctgaagaaggagaacttcaacatgatgaacgccctggaccagctgcccaagcccttcagcaaccccaagagcatgaacagaaccgtgaccaccaagggcctgcccctggccagcaagggcaacctggtgaacttcctggaggacgacaccatcaacctgctgaagcccctgcccgtggaggacagcgactgcagcagcgacgagaccagcatcagcgccttcagcagcaccctgctgaaccccatcaagctggccgtgacccagcccaacagcagcttcttcgccggcatgctggagggcgagctgaacaagctgagcttcagccccatggccaagaacgccgagaacgaggacctggccctgggcccctgcccctgccccagcaagagccagatggccaccagaggcctgctggacctggacaaccccgagctggagaccgagaccagcagcacccacagcgagagcagcgtggtggtggacctgcccgacacccccttcatcttcgagcacaccgtgaacaacagcaccgccgtgatcagctggacctacgccctgggcaagcagcccgtgagcttctaccagctgctgctgcaggaggtggccaagacccaggagaacgagctgcccgaggccaagaacagaccctggatcttcaacaagatcctgggcaccaccgtgaagctgatggagctgaagcccaacacctgctactgcctgagcgtgagagccgccaacaccgccggcgtgggcaagtggtgcaagccctacaagttcgccaccctggccaccgacttcagcagcttccccgagaactaccccatccagatcaccgtgagaagaaaggagcccagacagaagatcgtgagcatcggccccgaggagatgagaagactggaggacctggagtacctgttcccctgctag

SEQ ID NO: 21381 - DNA, 1383 bp, Artificial Sequence
  Description of Artificial Sequence: Synthetic coding sequence
atgttcgagaagtaccccggcaagatggagggcctgttcagacacaacccctacaccgccttcccccccgccgtgcccggcctgccccccggcctgccccccgccgtgagcttcggcagcctgcagggcgccttccagcccaagagcaccaaccccgagctgccccccagactgggccccgtgcccagcggcctgagccagaagggcacccagatccccgaccacttcagaccccccctgagaaagcccggcaagtggtgcgccatgcacgtgagagtggcctacatgatcctgagacaccaggagaagatgaagggcgacagccacaagctggacttcagaaacgacctgctgccctgcctgcccggcccctacggcgccctgccccccggccaggagctgagccaccccgccagcctgttcaccgccaccggcgccgtgcacgccgccgccaaccccttcaccgccgcccccggcgcccacggccccttcctgagccccagcacccacatcgaccccttcggcagacccaccagcttcgccagcctggccgccctgagcaacggcgccttcggcggcctgggcagccccaccttcaacagcggcgccgtgttcgcccagaaggagagccccggcgccccccccgccttcgccagcccccccgacccctggggcagactgcacagaagccccctgaccttccccgcctgggtgagaccccccgaggccgccagaacccccggcagcgacaaggagagacccgtggagagaagagagcccagcatcaccaaggaggagaaggacagagacctgcccttcagcagaccccagctgagagtgagccccgccacccccaaggccagagccggcgaggagggccccagacccaccaaggagagcgtgagagtgaaggaggagagaaaggaggaggccgccgccgccgccgccgccgccgccgccgccgccgccgccgccgccgccgccgccaccggcccccagggcctgcacctgctgttcgagagacccagacccccccccttcctgggccccagcccccccgacagatgcgccggcttcctggagcccacctggctggccgccccccccagactggccagaccccccagattctacgaggccggcgaggagctgaccggccccggcgccgtggccgccgccagactgtacggcctggagcccgcccaccccctgctgtacagcagactggcccccccccccccccccgccgccgcccccggcaccccccacctgctgagcaagaccccccccggcgccctgctgggcgcccccccccccctggtgcccgcccccagacccagcagcccccccagaggccccggccccgccagagccgacagatag

SEQ ID NO: 21382 - DNA, 1200 bp, Artificial Sequence
  Description of Artificial Sequence: Synthetic coding sequence
atgcacgtgagagtggcctacatgatcctgagacaccaggagaagatgaagggcgacagccacaagctggacttcagaaacgacctgctgccctgcctgcccggcccctacggcgccctgccccccggccaggagctgagccaccccgccagcctgttcaccgccaccggcgccgtgcacgccgccgccaaccccttcaccgccgcccccggcgcccacggccccttcctgagccccagcacccacatcgaccccttcggcagacccaccagcttcgccagcctggccgccctgagcaacggcgccttcggcggcctgggcagccccaccttcaacagcggcgccgtgttcgcccagaaggagagccccggcgccccccccgccttcgccagcccccccgacccctggggcagactgcacagaagccccctgaccttccccgcctgggtgagaccccccgaggccgccagaacccccggcagcgacaaggagagacccgtggagagaagagagcccagcatcaccaaggaggagaaggacagagacctgcccttcagcagaccccagctgagagtgagccccgccacccccaaggccagagccggcgaggagggccccagacccaccaaggagagcgtgagagtgaaggaggagagaaaggaggaggccgccgccgccgccgccgccgccgccgccgccgccgccgccgccgccgccgccgccaccggcccccagggcctgcacctgctgttcgagagacccagacccccccccttcctgggccccagcccccccgacagatgcgccggcttcctggagcccacctggctggccgccccccccagactggccagaccccccagattctacgaggccggcgaggagctgaccggccccggcgccgtggccgccgccagactgtacggcctggagcccgcccaccccctgctgtacagcagactggcccccccccccccccccgccgccgcccccggcaccccccacctgctgagcaagaccttctgcaccttcctgcagggctgccccagccagcagttccccagctggctgatcaagcccagcgactggtgctgcgtgcccagcctgtggcccctgtgcggcgagagaggcctgcagggcgaggagcccggcagagacagccaggccagcccctgggagggcggcgccagcagaagatag

SEQ ID NO: 21383 - DNA, 2919 bp, Artificial Sequence
  Description of Artificial Sequence: Synthetic coding sequence
atggaggccaaggaggaggaggtgatcgacggcttcgccatcgccagcttcagcaccctggaggccctggagaaggacatggccctgaagccccacgagagaaaggagaagtgggagagaagactgatcaagaagcccagagagagcgagacctgcccccccgccgagcccagcgagaacagaagacccctggaggccggcagccccggccaggacctggagcccgcctgcgacggcgccagaaaggtgcccctgcagcccagcaagcagatgaaggtgaccgtgagcaagggcggcgacagagacagcgacgacgacagcgtgctggaggccaccagcagcagagaccccctgagcgacagcagcgcccacgccgtgagcggcagaggctacagctgcgacagcgagagcggccccgacgacaaggccagcgtgggcagcgagaagctgttcgcccccggcaccgacaagggccccgccctggagaagagcgaggccaaggccggccccgtgcccaaggtgagcggcctggagagaagcagagagctgagcgccgagagcttcctgcccaccgccagccccgccccccacgccgccccctgccccggccccccccccggcagcagagccaaccccctggtgaagaaggagccccccgccccccacagacacaccccccagcccccccccccccagcccagaggcctgctgcccacccacgtgcccgccagcctgggcgccttcgccggccacagccaggccgccgccaacggcctgcacggcctgagcagaagcagcagcgcccccctgggcctgggcaagcacgtgagcctgagcccccacggccccggcccccacctgagcaccagccacctggccctgagaagccaggcccagcaccagctgcacgccgccatgttcgccgccccccccaccctgccccccccccccgccctgcccgccagcagcctggtgctgcccggccaccccgccgaccacgagctgctgagacaggagctgaacaccagattcctggtgcagagcgccgagagacccggcgccagcctgggccccggcgccctgctgagagccgagttccaccagcaccagcacacccaccagcacacccaccagcacacccaccagcaccagcacaccttcgcccccttccccgccggcctgccccccaccccccccgccgcccccccccccttcgacaagtacgcccccaagctggacagcccctacttcagacacagcagcgtgagcttcttccccagcttcccccccgccatccccggcctgcccaccctgctgccccaccccggccccttcggcagcctgcagggcgccttccagcccaaggtgagcgacccctacagagccgtggtgaaggtgagcacctgctgggagggcccctggcagggcagaaccctggtgccccccggcagacccagaggcgccagagacagcagaagcctgcagaagacctgggtgggcgtggcccccgcccccctgagcgccagcatcctgagccagaagcccggcagatggtgcgccgtgcacgtgcagatcgcctggcagatctacagacaccagcagaagatcaaggagatgcagctggacccccacaagctggaggtgggcgccaagctggacctgttcggcagaccccccgcccccggcgtgttcgccggcttccactacccccaggacctggccagacccctgttccccagcaccggcgccgcccaccccgccagcaaccccttcggccccagcgcccaccccggcagcttcctgcccaccggccccctgaccgaccccttcagcagacccagcaccttcggcggcctgggcagcctgagcagccacgccttcggcggcctgggcagccacgccctggcccccggcggcagcatcttcgcccccaaggagggcagcagcgtgcacggcctgcccagcccccacgaggcctggaacagactgcacagagccccccccagcttccccgccccccccccctggcccaagagcgtggacgccgagagagtgagcgccctgaccaaccacgacagagagcccgacaacggcaaggaggagcaggagagagacctgctggagaagaccagactgctgagcagagccagccccgccacccccgccggccaccccgtgagcggcctgctgctgagagcccagagcgagctgggcagaagcggcgcccccgccgagagagaggccgagcccagagtgaaggagagcagaagccccgccaaggaggaggccgccaagatgcccgccagagccagccccccccacagcaaggccgcccccggcgacgtgaaggtgaaggaggagagaggcgaggacgaggccagcgagccccccgccggcggcctgcaccccgcccccctgcagctgggcctgggcagagagagactgggcgcccccggcttcgcctgggagcccttcagaggcctggagctgcccagaagagccttccccgccgccgcccccgcccccggcagcgccgccctgctggagccccccgagagaccctacagagacagagagccccacggctacagccccgagagactgagaggcgagctggagagagccagagccccccacctgccccccgccgcccccgccctggacggcgccctgctgcccagcctgggcgccctgcacttccccagactgagccccgccgccctgcacaacggcctgctggccagaaccccccccgccgccgccgccctgggcgcccccccccccctggtgaccgccgccggcccccccaccccccccggcccccccagaagcagaaccacccccctgggcggcctgggccccggcgaggccagagactacagccccagcagaaacccccccgaggtggaggccagatag

SEQ ID NO: 21384 - DNA, 3138 bp, Artificial Sequence
  Description of Artificial Sequence: Synthetic coding sequence
atggaggccaaggtgagacccagcagaagaagcagagcccagagagacagaggcagaagaagagaggccgccagagacgccagagcccagagccccagcagcggcgacgagcccgagcccagccccggcaaggagaacgccggcctgagaggcgccccccccagaggcgccgcccccgcccccagaaccgccagaccccccagaagaagaagaagagagagcagcagccaggaggaggaggtgatcgacggcttcgccatcgccagcttcagcaccctggaggccctggagaaggacatggccctgaagccccacgagagaaaggagaagtgggagagaagactgatcaagaagcccagagagagcgagacctgcccccccgccgagcccagcgagaacagaagacccctggaggccggcagccccggccaggacctggagcccgcctgcgacggcgccagaaaggtgcccctgcagcccagcaagcagatgaaggtgaccgtgagcaagggcggcgacagagacagcgacgacgacagcgtgctggaggccaccagcagcagagaccccctgagcgacagcagcgcccacgccgtgagcggcagaggctacagctgcgacagcgagagcggccccgacgacaaggccagcgtgggcagcgagaagctgttcgcccccggcaccgacaagggccccgccctggagaagagcgaggccaaggccggccccgtgcccaaggtgagcggcctggagagaagcagagagctgagcgccgagagcttcctgcccaccgccagccccgccccccacgccgccccctgccccggccccccccccggcagcagagccaaccccctggtgaagaaggagccccccgccccccacagacacaccccccagcccccccccccccagcccagaggcctgctgcccacccacgtgcccgccagcctgggcgccttcgccggccacagccaggccgccgccaacggcctgcacggcctgagcagaagcagcagcgcccccctgggcctgggcaagcacgtgagcctgagcccccacggccccggcccccacctgagcaccagccacctggccctgagaagccaggcccagcaccagctgcacgccgccatgttcgccgccccccccaccctgccccccccccccgccctgcccgccagcagcctggtgctgcccggccaccccgccgaccacgagctgctgagacaggagctgaacaccagattcctggtgcagagcgccgagagacccggcgccagcctgggccccggcgccctgctgagagccgagttccaccagcaccagcacacccaccagcacacccaccagcacacccaccagcaccagcacaccttcgcccccttccccgccggcctgccccccaccccccccgccgcccccccccccttcgacaagtacgcccccaagctggacagcccctacttcagacacagcagcgtgagcttcttccccagcttcccccccgccatccccggcctgcccaccctgctgccccaccccggccccttcggcagcctgcagggcgccttccagcccaaggtgagcgacccctacagagccgtggtgaaggtgagcacctgctgggagggcccctggcagggcagaaccctggtgccccccggcagacccagaggcgccagagacagcagaagcctgcagaagacctgggtgggcgtggcccccgcccccctgagcgccagcatcctgagccagaagcccggcagatggtgcgccgtgcacgtgcagatcgcctggcagatctacagacaccagcagaagatcaaggagatgcagctggacccccacaagctggaggtgggcgccaagctggacctgttcggcagaccccccgcccccggcgtgttcgccggcttccactacccccaggacctggccagacccctgttccccagcaccggcgccgcccaccccgccagcaaccccttcggccccagcgcccaccccggcagcttcctgcccaccggccccctgaccgaccccttcagcagacccagcaccttcggcggcctgggcagcctgagcagccacgccttcggcggcctgggcagccacgccctggcccccggcggcagcatcttcgcccccaaggagggcagcagcgtgcacggcctgcccagcccccacgaggcctggaacagactgcacagagccccccccagcttccccgccccccccccctggcccaagagcgtggacgccgagagagtgagcgccctgaccaaccacgacagagagcccgacaacggcaaggaggagcaggagagagacctgctggagaagaccagactgctgagcagagccagccccgccacccccgccggccaccccgtgagcggcctgctgctgagagcccagagcgagctgggcagaagcggcgcccccgccgagagagaggccgagcccagagtgaaggagagcagaagccccgccaaggaggaggccgccaagatgcccgccagagccagccccccccacagcaaggccgcccccggcgacgtgaaggtgaaggaggagagaggcgaggacgaggccagcgagccccccgccggcggcctgcaccccgcccccctgcagctgggcctgggcagagagagactgggcgcccccggcttcgcctgggagcccttcagaggcctggagctgcccagaagagccttccccgccgccgcccccgcccccggcagcgccgccctgctggagccccccgagagaccctacagagacagagagccccacggctacagccccgagagactgagaggcgagctggagagagccagagccccccacctgccccccgccgcccccgccctggacggcgccctgctgcccagcctgggcgccctgcacttccccagactgagccccgccgccctgcacaacggcctgctggccagaaccccccccgccgccgccgccctgggcgcccccccccccctggtgaccgccgccggcccccccaccccccccggcccccccagaagcagaaccacccccctgggcggcctgggccccggcgaggccagagactacagccccagcagaaacccccccgaggtggaggccagatag

SEQ ID NO: 21385 - DNA, 1746 bp, Artificial Sequence
  Description of Artificial Sequence: Synthetic coding sequence
atggacatcatcaagggcaacctggacggcatcagcaagcccgccagcaacagcagaatcagacccggcagcagaagcagcaacgccagcctggaggtgctgagcaccgagcccggcagcttcaaggtggacaccgccagcaacctgaacagcggcaaggaggaccacagcgagagcagcaacaccgagaacagaagaaccagcaacgacgacaagcaggagagctgcagcgagaagatcaagctggccgaggagggcagcgacgaggacctggacctggtgcagcaccagatcatcagcgagtgcagcgacgagcccaagctgaaggagctggacagccagctgcaggacgccatccagaagatgaagaagctggacaagatcctggccaagaagcagagaagagagaaggagatcaagaagcagggcctggagatgagaatcaagctgtgggaggagatcaagagcgccaagtacagcgaggcctggcagagcaaggaggagatggagaacaccaagaagttcctgagcctgaccgccgtgagcgaggagaccgtgggccccagccacgaggaggaggacaccttcagcagcgtgttccacacccagatcccccccgaggagtacgagatgcagatgcagaagctgaacaaggacttcacctgcgacgtggagagaaacgagagcctgatcaagagcggcaagaagcccttcagcaacaccgagaagatcgagctgagaggcaagcacaaccaggacttcatcaagagaaacatcgagctggccaaggagagcagaaaccccgtggtgatggtggacagagagaagaagagactggtggagctgctgaaggacctggacgagaaggacagcggcctgagcagcagcgagggcgaccagagcggctgggtggtgcccgtgaagggctacgagctggccgtgacccagcaccagcagctggccgagatcgacatcaagctgcaggagctgagcgccgccagccccaccatcagcagcttcagccccagactggagaacagaaacaaccagaagcccgacagagacggcgagagaaacatggaggtgacccccggcgagaagatcctgagaaacaccaaggagcagagagacctgcacaacagactgagagagatcgacgagaagctgaagatgatgaaggagaacgtgctggagagcaccagctgcctgagcgaggagcagctgaagtgcctgctggacgagtgcatcctgaagcagaagagcatcatcaagctgagcagcgagagaaagaaggaggacatcgaggacgtgacccccgtgttcccccagctgagcagaagcatcatcagcaagctgctgaacgagagcgagaccaaggtgcagaagaccgaggtggaggacgccgacatgctggagagcgaggagtgcgaggccagcaagggctactacctgaccaaggccctgaccggccacaacatgagcgaggccctggtgaccgaggccgagaacatgaagtgcctgcagttcagcaaggacgtgatcatcagcgacaccaaggactacttcatgagcaagaccctgggcatcggcagactgaagagacccagcttcctggacgaccccctgtacggcatcagcgtgagcctgagcagcgaggaccagcacctgaagctgagcagccccgagaacaccatcgccgacgagcaggagaccaaggacgccgccgaggagtgcaaggagccctag

SEQ ID NO: 21386 - DNA, 48 bp, Artificial Sequence
  Description of Artificial Sequence: Synthetic coding sequence
tgagagcaggagaccaaggacgccgccgaggagtgcaaggagccctag

SEQ ID NO: 21387 - DNA, 7920 bp, Artificial Sequence
  Description of Artificial Sequence: Synthetic coding sequence
atgagcagcagccacagcagagccggccagagcgccgccggcgccgcccccggcggcggcgtggacaccagagacgccgagatgcccgccaccgagaaggacctggccgaggacgccccctggaagaagatccagcagaacaccttcaccagatggtgcaacgagcacctgaagtgcgtgagcaagagaatcgccaacctgcagaccgacctgagcgacggcctgagactgatcgccctgctggaggtgctgagccagaagaagatgcacagaaagcacaaccagagacccaccttcagacagatgcagctggagaacgtgagcgtggccctggagttcctggacagagagagcatcaagctggtgagcatcgacagcaaggccatcgtggacggcaacctgaagctgatcctgggcctgatctggaccctgatcctgcactacagcatcagcatgcccatgtgggacgaggaggaggacgaggaggccaagaagcagacccccaagcagagactgctgggctggatccagaacaagctgccccagctgcccatcaccaacttcagcagagactggcagagcggcagagccctgggcgccctggtggacagctgcgcccccggcctgtgccccgactgggacagctgggacgccagcaagcccgtgaccaacgccagagaggccatgcagcaggccgacgactggctgggcatcccccaggtgatcacccccgaggagatcgtggaccccaacgtggacgagcacagcgtgatgacctacctgagccagttccccaaggccaagctgaagcccggcgcccccctgagacccaagctgaaccccaagaaggccagagcctacggccccggcatcgagcccaccggcaacatggtgaagaagagagccgagttcaccgtggagaccagaagcgccggccagggcgaggtgctggtgtacgtggaggaccccgccggccaccaggaggaggccaaggtgaccgccaacaacgacaagaacagaaccttcagcgtgtggtacgtgcccgaggtgaccggcacccacaaggtgaccgtgctgttcgccggccagcacatcgccaagagccccttcgaggtgtacgtggacaagagccagggcgacgccagcaaggtgaccgcccagggccccggcctggagcccagcggcaacatcgccaacaagaccacctacttcgagatcttcaccgccggcgccggcaccggcgaggtggaggtggtgatccaggaccccatgggccagaagggcaccgtggagccccagctggaggccagaggcgacagcacctacagatgcagctaccagcccaccatggagggcgtgcacaccgtgcacgtgaccttcgccggcgtgcccatccccagaagcccctacaccgtgaccgtgggccaggcctgcaaccccagcgcctgcagagccgtgggcagaggcctgcagcccaagggcgtgagagtgaaggagaccgccgacttcaaggtgtacaccaagggcgccggcagcggcgagctgaaggtgaccgtgaagggccccaagggcgaggagagagtgaagcagaaggacctgggcgacggcgtgtacggcttcgagtactaccccatggtgcccggcacctacatcgtgaccatcacctggggcggccagaacatcggcagaagccccttcgaggtgaaggtgggcaccgagtgcggcaaccagaaggtgagagcctggggccccggcctggagggcggcgtggtgggcaagagcgccgacttcgtggtggaggccatcggcgacgacgtgggcaccctgggcttcagcgtggagggccccagccaggccaagatcgagtgcgacgacaagggcgacggcagctgcgacgtgagatactggccccaggaggccggcgagtacgccgtgcacgtgctgtgcaacagcgaggacatcagactgagccccttcatggccgacatcagagacgccccccaggacttccaccccgacagagtgaaggccagaggccccggcctggagaagaccggcgtggccgtgaacaagcccgccgagttcaccgtggacgccaagcacggcggcaaggcccccctgagagtgcaggtgcaggacaacgagggctgccccgtggaggccctggtgaaggacaacggcaacggcacctacagctgcagctacgtgcccagaaagcccgtgaagcacaccgccatggtgagctggggcggcgtgagcatccccaacagccccttcagagtgaacgtgggcgccggcagccaccccaacaaggtgaaggtgtacggccccggcgtggccaagaccggcctgaaggcccacgagcccacctacttcaccgtggactgcgccgaggccggccagggcgacgtgagcatcggcatcaagtgcgcccccggcgtggtgggccccgccgaggccgacatcgacttcgacatcatcagaaacgacaacgacaccttcaccgtgaagtacacccccagaggcgccggcagctacaccatcatggtgctgttcgccgaccaggccacccccaccagccccatcagagtgaaggtggagcccagccacgacgccagcaaggtgaaggccgagggccccggcctgagcagaaccggcgtggagctgggcaagcccacccacttcaccgtgaacgccaaggccgccggcaagggcaagctggacgtgcagttcagcggcctgaccaagggcgacgccgtgagagacgtggacatcatcgaccaccacgacaacacctacaccgtgaagtacacccccgtgcagcagggccccgtgggcgtgaacgtgacctacggcggcgaccccatccccaagagccccttcagcgtggccgtgagccccagcctggacctgagcaagatcaaggtgagcggcctgggcgagaaggtggacgtgggcaaggaccaggagttcaccgtgaagagcaagggcgccggcggccagggcaaggtggccagcaagatcgtgggccccagcggcgccgccgtgccctgcaaggtggagcccggcctgggcgccgacaacagcgtggtgagattcctgcccagagaggagggcccctacgaggtggaggtgacctacgacggcgtgcccgtgcccggcagccccttccccctggaggccgtggcccccaccaagcccagcaaggtgaaggccttcggccccggcctgcagggcggcagcgccggcagccccgccagattcaccatcgacaccaagggcgccggcaccggcggcctgggcctgaccgtggagggcccctgcgaggcccagctggagtgcctggacaacggcgacggcacctgcagcgtgagctacgtgcccaccgagcccggcgactacaacatcaacatcctgttcgccgacacccacatccccggcagccccttcaaggcccacgtggtgccctgcttcgacgccagcaaggtgaagtgcagcggccccggcctggagagagccaccgccggcgaggtgggccagttccaggtggactgcagcagcgccggcagcgccgagctgaccatcgagatctgcagcgaggccggcctgcccgccgaggtgtacatccaggaccacggcgacggcacccacaccatcacctacatccccctgtgccccggcgcctacaccgtgaccatcaagtacggcggccagcccgtgcccaacttccccagcaagctgcaggtggagcccgccgtggacaccagcggcgtgcagtgctacggccccggcatcgagggccagggcgtgttcagagaggccaccaccgagttcagcgtggacgccagagccctgacccagaccggcggcccccacgtgaaggccagagtggccaaccccagcggcaacctgaccgagacctacgtgcaggacagaggcgacggcatgtacaaggtggagtacaccccctacgaggagggcctgcacagcgtggacgtgacctacgacggcagccccgtgcccagcagccccttccaggtgcccgtgaccgagggctgcgaccccagcagagtgagagtgcacggccccggcatccagagcggcaccaccaacaagcccaacaagttcaccgtggagaccagaggcgccggcaccggcggcctgggcctggccgtggagggccccagcgaggccaagatgagctgcatggacaacaaggacggcagctgcagcgtggagtacatcccctacgaggccggcacctacagcctgaacgtgacctacggcggccaccaggtgcccggcagccccttcaaggtgcccgtgcacgacgtgaccgacgccagcaaggtgaagtgcagcggccccggcctgagccccggcatggtgagagccaacctgccccagagcttccaggtggacaccagcaaggccggcgtggcccccctgcaggtgaaggtgcagggccccaagggcctggtggagcccgtggacgtggtggacaacgccgacggcacccagaccgtgaactacgtgcccagcagagagggcccctacagcatcagcgtgctgtacggcgacgaggaggtgcccagaagccccttcaaggtgaaggtgctgcccacccacgacgccagcaaggtgaaggccagcggccccggcctgaacaccaccggcgtgcccgccagcctgcccgtggagttcaccatcgacgccaaggacgccggcgagggcctgctggccgtgcagatcaccgaccccgagggcaagcccaagaagacccacatccaggacaaccacgacggcacctacaccgtggcctacgtgcccgacgtgaccggcagatacaccatcctgatcaagtacggcggcgacgagatccccttcagcccctacagagtgagagccgtgcccaccggcgacgccagcaagtgcaccgtgaccggcgccggcatcggccccaccatccagatcggcgaggagaccgtgatcaccgtggacaccaaggccgccggcaagggcaaggtgacctgcaccgtgtgcacccccgacggcagcgaggtggacgtggacgtggtggagaacgaggacggcaccttcgacatcttctacaccgccccccagcccggcaagtacgtgatctgcgtgagattcggcggcgagcacgtgcccaacagccccttccaggtgaccgccctggccggcgaccagcccagcgtgcagccccccctgagaagccagcagctggccccccagtacacctacgcccagggcggccagcagacctgggcccccgagagacccctggtgggcgtgaacggcctggacgtgaccagcctgagacccttcgacctggtgatccccttcaccatcaagaagggcgagatcaccggcgaggtgagaatgcccagcggcaaggtggcccagcccaccatcaccgacaacaaggacggcaccgtgaccgtgagatacgcccccagcgaggccggcctgcacgagatggacatcagatacgacaacatgcacatccccggcagccccctgcagttctacgtggactacgtgaactgcggccacgtgaccgcctacggccccggcctgacccacggcgtggtgaacaagcccgccaccttcaccgtgaacaccaaggacgccggcgagggcggcctgagcctggccatcgagggccccagcaaggccgagatcagctgcaccgacaaccaggacggcacctgcagcgtgagctacctgcccgtgctgcccggcgactacagcatcctggtgaagtacaacgagcagcacgtgcccggcagccccttcaccgccagagtgaccggcgacgacagcatgagaatgagccacctgaaggtgggcagcgccgccgacatccccatcaacatcagcgagaccgacctgagcctgctgaccgccaccgtggtgccccccagcggcagagaggagccctgcctgctgaagagactgagaaacggccacgtgggcatcagcttcgtgcccaaggagaccggcgagcacctggtgcacgtgaagaagaacggccagcacgtggccagcagccccatccccgtggtgatcagccagagcgagatcggcgacgccagcagagtgagagtgagcggccagggcctgcacgagggccacaccttcgagcccgccgagttcatcatcgacaccagagacgccggctacggcggcctgagcctgagcatcgagggccccagcaaggtggacatcaacaccgaggacctggaggacggcacctgcagagtgacctactgccccaccgagcccggcaactacatcatcaacatcaagttcgccgaccagcacgtgcccggcagccccttcagcgtgaaggtgaccggcgagggcagagtgaaggagagcatcaccagaagaagaagagcccccagcgtggccaacgtgggcagccactgcgacctgagcctgaagatccccgagatcagcatccaggacatgaccgcccaggtgaccagccccagcggcaagacccacgaggccgagatcgtggagggcgagaaccacacctactgcatcagattcgtgcccgccgagatgggcacccacaccgtgagcgtgaagtacaagggccagcacgtgcccggcagccccttccagttcaccgtgggccccctgggcgagggcggcgcccacaaggtgagagccggcggccccggcctggagagagccgaggccggcgtgcccgccgagttcagcatctggaccagagaggccggcgccggcggcctggccatcgccgtggagggccccagcaaggccgagatcagcttcgaggacagaaaggacggcagctgcggcgtggcctacgtggtgcaggagcccggcgactacgaggtgagcgtgaagttcaacgaggagcacatccccgacagccccttcgtggtgcccgtggccagccccagcggcgacgccagaagactgaccgtgagcagcctgcaggagagcggcctgaaggtgaaccagcccgccagcttcgccgtgagcctgaacggcgccaagggcgccatcgacgccaaggtgcacagccccagcggcgccctggaggagtgctacgtgaccgagatcgaccaggacaagtacgccgtgagattcatccccagagagaacggcgtgtacctgatcgacgtgaagttcaacggcacccacatccccggcagccccttcaagatcagagtgggcgagcccggccacggcggcgaccccggcctggtgagcgcctacggcgccggcctggagggcggcgtgaccggcaaccccgccgagttcgtggtgaacaccagcaacgccggcgccggcgccctgagcgtgaccatcgacggccccagcaaggtgaagatggactgccaggagtgccccgagggctacagagtgacctacacccccatggcccccggcagctacctgatcagcatcaagtacggcggcccctaccacatcggcggcagccccttcaaggccaaggtgaccggccccagactggtgagcaaccacagcctgcacgagaccagcagcgtgttcgtggacagcctgaccaaggccacctgcgccccccagcacggcgcccccggccccggccccgccgacgccagcaaggtggtggccaagggcctgggcctgagcaaggcctacgtgggccagaagagcagcttcaccgtggactgcagcaaggccggcaacaacatgctgctggtgggcgtgcacggccccagaaccccctgcgaggagatcctggtgaagcacgtgggcagcagactgtacagcgtgagctacctgctgaaggacaagggcgagtacaccctggtggtgaagtggggcgacgagcacatccccggcagcccctacagagtggtggtgccctag

SEQ ID NO: 21388 - DNA, 3642 bp, Artificial Sequence
  Description of Artificial Sequence: Synthetic coding sequence
atgagaagcagaaaccagggcggcgagagcgccagcgacggccacatcagctgccccaagcccagcatcatcggcaacgccggcgagaagagcctgagcgaggacgccaagaagaagaagaagagcaacagaaaggaggacgacgtgatggccagcggcaccgtgaagagacacctgaagaccagcggcgagtgcgagagaaagaccaagaagagcctggagctgagcaaggaggacctgatccagctgctgagcatcatggagggcgagctgcaggccagagaggacgtgatccacatgctgaagaccgagaagaccaagcccgaggtgctggaggcccactacggcagcgccgagcccgagaaggtgctgagagtgctgcacagagacgccatcctggcccaggagaagagcatcggcgaggacgtgtacgagaagcccatcagcgagctggacagactggaggagaagcagaaggagacctacagaagaatgctggagcagctgctgctggccgagaagtgccacagaagaaccgtgtacgagctggagaacgagaagcacaagcacaccgactacatgaacaagagcgacgacttcaccaacctgctggagcaggagagagagagactgaagaagctgctggagcaggagaaggcctaccaggccagaaaggagaaggagaacgccaagagactgaacaagctgagagacgagctggtgaagctgaagagcttcgccctgatgctggtggacgagagacagatgcacatcgagcagctgggcctgcagagccagaaggtgcaggacctgacccagaagctgagagaggaggaggagaagctgaaggccatcaccagcaagagcaaggaggacagacagaagctgctgaagctggaggtggacttcgagcacaaggccagcagattcagccaggagcacgaggagatgaacgccaagctggccaaccaggagagccacaacagacagctgagactgaagctggtgggcctgacccagagaatcgaggagctggaggagaccaacaagaacctgcagaaggccgaggaggagctgcaggagctgagagacaagatcgccaagggcgagtgcggcaacagcagcctgatggccgaggtggagaacctgagaaagagagtgctggagatggagggcaaggacgaggagatcaccaagaccgagagccagtgcagagagctgagaaagaagctgcaggaggaggagcaccacagcaaggagctgagactggaggtggagaagctgcagaagagaatgagcgagctggagaagctggaggaggccttcagcaagagcaagagcgagtgcacccagctgcacctgaacctggagaaggagaagaacctgaccaaggacctgctgaacgagctggaggtggtgaagagcagagtgaaggagctggagtgcagcgagagcagactggagaaggccgagctgagcctgaaggacgacctgaccaagctgaagagcttcaccgtgatgctggtggacgagagaaagaacatgatggagaagatcaagcaggaggagagaaaggtggacggcctgaacaagaacttcaaggtggagcagggcaaggtgatggacgtgaccgagaagctgatcgaggagagcaagaagctgctgaagctgaagagcgagatggaggagaaggtgtacaacctgaccagagagagagacgagctgatcggcaagctgaagagcgaggaggagaagagcagcgagctgagctgcagcgtggacctgctgaagaagagactggacggcatcgaggaggtggagagagagatcaccagaggcagaagcagaaagggcagcgagctgacctgccccgaggacaacaagatcaaggagctgaccctggagatcgagagactgaagaagagactgcagcagctggaggtggtggagggcgacctgatgaagaccgaggacgagtacgaccagctggagcagaagttcagaaccgagcaggacaaggccaacttcctgagccagcagctggaggagatcaagcaccagatcgccaagaacaaggccatcgagaagggcgaggtggtgagccaggaggccgagctgagacacagattcagactggaggaggccaagagcagagacctgaaggccgaggtgcaggccctgaaggagaagatccacgagctgatgaacaaggaggaccagctgagccagctgcaggtggactacagcgtgctgcagcagagattcatggaggaggagaacaagaacaagaacatgggccaggaggtgctgaacctgaccaaggagctggagctgagcaagagatacagcagagccctgagacccagcgtgaacggcagaagaatggtggacgtgcccgtgaccagcaccggcgtgcagaccgacgccgtgagcggcgaggccgccgaggaggagacccccgccgtgttcatcagaaagagcttccaggaggagaaccacatcatgagcaacctgagacaggtgggcctgaagaagcccgtggagagaagcagcgtgctggacagatacccccccgccgccaacgagctgaccatgagaaagagctggatcccctggatgagaaagagagagaacggccccagcatcacccaggagaagggccccagaaccaacagcagccccggccaccccggcgaggtggtgctgagccccaagcagggccagcccctgcacatcagagtgacccccgaccacgagaacagcaccgccaccctggagatcaccagccccaccagcgaggagttcttcagcagcaccaccgtgatccccaccctgggcaaccagaagcccagaatcaccatcatccccagccccaacgtgatgccccagaagcagaagagcggcgacaccaccctgggccccgagagagccatgagccccgtgaccatcaccaccttcagcagagagaagacccccgagagcggcagaggcgccttcgccgacagacccaccagccccatccagatcatgaccgtgagcaccagcgccgcccccgccgagatcgccgtgagccccgagagccaggagatgcccatgggcagaaccatcctgaaggtgacccccgagaagcagaccgtgcccacccccgtgagaaagtacaacagcaacgccaacatcatcaccaccgaggacaacaagatccacatccacctgggcagccagttcaagagaagccccggcaccagcggcgagggcgtgagccccgtgatcaccgtgagacccgtgaacgtgaccgccgagaaggaggtgagcaccggcaccgtgctgagaagccccagaaaccacctgagcagcagacccggcgccagcaaggtgaccagcaccatcaccatcacccccgtgaccaccagcagcgccagaggcacccagagcgtgagcggccaggacggcagcagccagagacccacccccaccagaatccccatgagcaagggcatgaaggccggcaagcccgtggtggccgcccccggcgccggcaacctgaccaagttcgagcccagagccgagacccagagcatgaagatcgagctgaagaagagcgccgccagcagcaccaccagcctgggcggcggcaagggctag

SEQ ID NO: 21389 - DNA, 3345 bp, Artificial Sequence
  Description of Artificial Sequence: Synthetic coding sequence
atgctgaagaccgagaagaccaagcccgaggtgctggaggcccactacggcagcgccgagcccgagaaggtgctgagagtgctgcacagagacgccatcctggcccaggagaagagcatcggcgaggacgtgtacgagaagcccatcagcgagctggacagactggaggagaagcagaaggagacctacagaagaatgctggagcagctgctgctggccgagaagtgccacagaagaaccgtgtacgagctggagaacgagaagcacaagcacaccgactacatgaacaagagcgacgacttcaccaacctgctggagcaggagagagagagactgaagaagctgctggagcaggagaaggcctaccaggccagaaaggagaaggagaacgccaagagactgaacaagctgagagacgagctggtgaagctgaagagcttcgccctgatgctggtggacgagagacagatgcacatcgagcagctgggcctgcagagccagaaggtgcaggacctgacccagaagctgagagaggaggaggagaagctgaaggccatcaccagcaagagcaaggaggacagacagaagctgctgaagctggaggtggacttcgagcacaaggccagcagattcagccaggagcacgaggagatgaacgccaagctggccaaccaggagagccacaacagacagctgagactgaagctggtgggcctgacccagagaatcgaggagctggaggagaccaacaagaacctgcagaaggccgaggaggagctgcaggagctgagagacaagatcgccaagggcgagtgcggcaacagcagcctgatggccgaggtggagaacctgagaaagagagtgctggagatggagggcaaggacgaggagatcaccaagaccgagagccagtgcagagagctgagaaagaagctgcaggaggaggagcaccacagcaaggagctgagactggaggtggagaagctgcagaagagaatgagcgagctggagaagctggaggaggccttcagcaagagcaagagcgagtgcacccagctgcacctgaacctggagaaggagaagaacctgaccaaggacctgctgaacgagctggaggtggtgaagagcagagtgaaggagctggagtgcagcgagagcagactggagaaggccgagctgagcctgaaggacgacctgaccaagctgaagagcttcaccgtgatgctggtggacgagagaaagaacatgatggagaagatcaagcaggaggagagaaaggtggacggcctgaacaagaacttcaaggtggagcagggcaaggtgatggacgtgaccgagaagctgatcgaggagagcaagaagctgctgaagctgaagagcgagatggaggagaaggtgtacaacctgaccagagagagagacgagctgatcggcaagctgaagagcgaggaggagaagagcagcgagctgagctgcagcgtggacctgctgaagaagagactggacggcatcgaggaggtggagagagagatcaccagaggcagaagcagaaagggcagcgagctgacctgccccgaggacaacaagatcaaggagctgaccctggagatcgagagactgaagaagagactgcagcagctggaggtggtggagggcgacctgatgaagaccgaggacgagtacgaccagctggagcagaagttcagaaccgagcaggacaaggccaacttcctgagccagcagctggaggagatcaagcaccagatcgccaagaacaaggccatcgagaagggcgaggtggtgagccaggaggccgagctgagacacagattcagactggaggaggccaagagcagagacctgaaggccgaggtgcaggccctgaaggagaagatccacgagctgatgaacaaggaggaccagctgagccagctgcaggtggactacagcgtgctgcagcagagattcatggaggaggagaacaagaacaagaacatgggccaggaggtgctgaacctgaccaaggagctggagctgagcaagagatacagcagagccctgagacccagcgtgaacggcagaagaatggtggacgtgcccgtgaccagcaccggcgtgcagaccgacgccgtgagcggcgaggccgccgaggaggagacccccgccgtgttcatcagaaagagcttccaggaggagaaccacatcatgagcaacctgagacaggtgggcctgaagaagcccgtggagagaagcagcgtgctggacagatacccccccgccgccaacgagctgaccatgagaaagagctggatcccctggatgagaaagagagagaacggccccagcatcacccaggagaagggccccagaaccaacagcagccccggccaccccggcgaggtggtgctgagccccaagcagggccagcccctgcacatcagagtgacccccgaccacgagaacagcaccgccaccctggagatcaccagccccaccagcgaggagttcttcagcagcaccaccgtgatccccaccctgggcaaccagaagcccagaatcaccatcatccccagccccaacgtgatgccccagaagcagaagagcggcgacaccaccctgggccccgagagagccatgagccccgtgaccatcaccaccttcagcagagagaagacccccgagagcggcagaggcgccttcgccgacagacccaccagccccatccagatcatgaccgtgagcaccagcgccgcccccgccgagatcgccgtgagccccgagagccaggagatgcccatgggcagaaccatcctgaaggtgacccccgagaagcagaccgtgcccacccccgtgagaaagtacaacagcaacgccaacatcatcaccaccgaggacaacaagatccacatccacctgggcagccagttcaagagaagccccggcaccagcggcgagggcgtgagccccgtgatcaccgtgagacccgtgaacgtgaccgccgagaaggaggtgagcaccggcaccgtgctgagaagccccagaaaccacctgagcagcagacccggcgccagcaaggtgaccagcaccatcaccatcacccccgtgaccaccagcagcgccagaggcacccagagcgtgagcggccaggacggcagcagccagagacccacccccaccagaatccccatgagcaagggcatgaaggccggcaagcccgtggtggccgcccccggcgccggcaacctgaccaagttcgagcccagagccgagacccagagcatgaagatcgagctgaagaagagcgccgccagcagcaccaccagcctgggcggcggcaagggctag

SEQ ID NO: 21390 - DNA, 3534 bp, Artificial Sequence
  Description of Artificial Sequence: Synthetic coding sequence
atgagaagcagaaaccagggcggcgagagcgccagcgacggccacatcagctgccccaagcccagcatcatcggcaacgccggcgagaagagcctgagcgaggacgccaagaagaagaagaagagcaacagaaaggaggacgacgtgatggccagcggcaccgtgaagagacacctgaagaccagcggcgagtgcgagagaaagaccaagaagagcctggagctgagcaaggaggacctgatccagctgctgagcatcatggagggcgagctgcaggccagagaggacgtgatccacatgctgaagaccgagaagaccaagcccgaggtgctggaggcccactacggcagcgccgagcccgagaaggtgctgagagtgctgcacagagacgccatcctggcccaggagaagagcatcggcgaggacgtgtacgagaagcccatcagcgagctggacagactggaggagaagcagaaggagacctacagaagaatgctggagcagctgctgctggccgagaagtgccacagaagaaccgtgtacgagctggagaacgagaagcacaagcacaccgactacatgaacaagagcgacgacttcaccaacctgctggagcaggagagagagagactgaagaagctgctggagcaggagaaggcctaccaggccagaaaggagaaggagaacgccaagagactgaacaagctgagagacgagctggtgaagctgaagagcttcgccctgatgctggtggacgagagacagatgcacatcgagcagctgggcctgcagagccagaaggtgcaggacctgacccagaagctgagagaggaggaggagaagctgaaggccatcaccagcaagagcaaggaggacagacagaagctgctgaagctggaggtggacttcgagcacaaggccagcagattcagccaggagcacgaggagatgaacgccaagctggccaaccaggagagccacaacagacagctgagactgaagctggtgggcctgacccagagaatcgaggagctggaggagaccaacaagaacctgcagaaggccgaggaggagctgcaggagctgagagacaagatcgccaagggcgagtgcggcaacagcagcctgatggccgaggtggagaacctgagaaagagagtgctggagatggagggcaaggacgaggagatcaccaagaccgagagccagtgcagagagctgagaaagaagctgcaggaggaggagcaccacagcaaggagctgagactggaggtggagaagctgcagaagagaatgagcgagctggagaagctggaggaggccttcagcaagagcaagagcgagtgcacccagctgcacctgaacctggagaaggagaagaacctgaccaaggacctgctgaacgagctggaggtggtgaagagcagagtgaaggagctggagtgcagcgagagcagactggagaaggccgagctgagcctgaaggacgacctgaccaagctgaagagcttcaccgtgatgctggtggacgagagaaagaacatgatggagaagatcaagcaggaggagagaaaggtggacggcctgaacaagaacttcaaggtggagcagggcaaggtgatggacgtgaccgagaagctgatcgaggagagcaagaagctgctgaagctgaagagcgagatggaggagaaggtgtacaacctgaccagagagagagacgagctgatcggcaagctgaagagcgaggaggagaagagcagcgagctgagctgcagcgtggacctgctgaagaagagactggacggcatcgaggaggtggagagagagatcaccagaggcagaagcagaaagggcagcgagctgacctgccccgaggacaacaagatcaaggagctgaccctggagatcgagagactgaagaagagactgcagcagctggaggtggtggagggcgacctgatgaagaccgaggacgagtacgaccagctggagcagaagttcagaaccgagcaggacaaggccaacttcctgagccagcagctggaggagatcaagcaccagatcgccaagaacaaggccatcgagaagggcgaggtggtgagccaggaggccgagctgagacacagattcagactggaggaggccaagagcagagacctgaaggccgaggtgcaggccctgaaggagaagatccacgagctgatgaacaaggaggaccagctgagccagctgcaggtggactacagcgtgctgcagcagagattcatggaggaggagaacaagaacaagaacatgggccaggaggtgctgaacctgaccaaggagctggagctgagcaagagatacagcagagccctgagacccagcgtgaacggcagaagaatggtggacgtgcccgtgaccagcaccggcgtgcagaccgacgccgtgagcggcgaggccgccgaggaggagacccccgccgtgttcatcagaaagagcttccaggaggagaaccacatcatgagcaacctgagacaggtgggcctgaagaagcccgtggagagaagcagcgtgctggacagatacccccccgccgccaacgagctgaccatgagaaagagctggatcccctggatgagaaagagagagaacggccccagcatcacccaggagaagggccccagaaccaacagcagccccggccaccccggcgaggtggtgctgagccccaagcagggccagcccctgcacatcagagtgacccccgaccacgagaacagcaccgccaccctggagatcaccagccccaccagcgaggagttcttcagcagcaccaccgtgatccccaccctgggcaaccagaagcccagaatcaccatcatccccagccccaacgtgatgccccagaagcagaagagcggcgacaccaccctgggccccgagagagccatgagccccgtgaccatcaccaccttcagcagagagaagacccccgagagcggcagaggcgccttcgccgacagacccaccagccccatccagatcatgaccgtgagcaccagcgccgcccccgccgagatcgccgtgagccccgagagccaggagatgcccatgggcagaaccatcctgaaggtgacccccgagaagcagaccgtgcccacccccgtgagaaagtacaacagcaacgccaacatcatcaccaccgaggacaacaagatccacatccacctgggcagccagttcaagagaagccccggcaccagcggcgagggcgtgagccccgtgatcaccgtgagacccgtgaacgtgaccgccgagaaggaggtgagcaccggcaccgtgctgagaagccccagaaaccacctgagcagcagacccggcgccagcaaggtgaccagcaccatcaccatcacccccgtgaccaccagcagcgccagaggcacccagagcgtgagcggccaggacggcagcagccagagacccacccccaccagaatccccatgagcaaggagagcatcatcatccaccagctgagaatgaacagcagatag

SEQ ID NO: 21391 - DNA, 279 bp, Artificial Sequence
  Description of Artificial Sequence: Synthetic coding sequence
atgggcgtgcacgtggagaccatcagccccggcgacggcatgctggaggacggcaagaagttcgacagcagcagagacagaaacaagcccttcaagttcatgctgggcaagcaggaggtgatcagaggctgggaggagggcgtggtgcagatgagcgtgggccagagagccaagctgaccatcagccccgactacgcctacggcgccaccggccaccccggcatcatccccccccacgccaccctggtgttcgacgtggagctgctgaagctggagtag

SEQ ID NO: 21392 - DNA, 327 bp, Artificial Sequence
  Description of Artificial Sequence: Synthetic coding sequence
atgggcgtgcacgtggagaccatcagccccggcgactggagaaccttccccaagagaagccagacctgcgtgatgcactacaccggcatgctggaggacggcaagaagttcgacagcagcagagacagaaacaagcccttcaagttcatgctgggcaagcaggaggtgatcagaggctgggaggagggcgtggtgcagatgagcgtgggccagagagccaagctgaccatcagccccgactacgcctacggcgccaccggccaccccggcatcatccccccccacgccaccctggtgttcgacgtggagctgctgaagctggagtag

SEQ ID NO: 21393 - DNA, 774 bp, Artificial Sequence
  Description of Artificial Sequence: Synthetic coding sequence
atgcccaagaccatgcacttcctgttcagattcatcgtgttcttctacctgtggggcctgttcaccgcccagagacagaagaaggaggagagcaccgaggaggtgaagatcgaggtgctgcacagacccgagaactgcagcaagaccagcaagaagggcgacctgctgaacgcccactacgacggctacctggccaaggacggcagcaagttctactgcagcagaacccagaacgagggccaccccaagtggttcgtgctgggcgtgggccaggtgatcaagggcctggacatcgccatgaccgacatgtgccccggcgagaagagaaaggtggtgatcccccccagcttcgcctacggcaaggagggctacggcatcctggaggaggtgttcctgctgcagaacatcctggtgagctgccacagaaccaccctgcacgtgctgaagtgcatgctgctggtgaacaacaacacctgcgccgagggcaagatcccccccgacgccaccctgatcttcgagatcgagctgtacgccgtgaccaagggccccagaagcatcgagaccttcaagcagatcgacatggacaacgacagacagctgagcaaggccgagatcaacctgtacctgcagagagagttcgagaaggacgagaagcccagagacaagagctaccaggacgccgtgctggaggacatcttcaagaagaacgaccacgacggcgacggcttcatcagccccaaggagtacaacgtgtaccagcacgacgagctgtag

SEQ ID NO: 21394 - DNA, 669 bp, Artificial Sequence
  Description of Artificial Sequence: Synthetic coding sequence
atgcccaagaccatgcacttcctgttcagattcatcgtgttcttctacctgtggggcctgttcaccgcccagagacagaagaaggaggagagcaccgaggaggtgaagatcgaggtgctgcacagacccgagaactgcagcaagaccagcaagaagggcgacctgctgaacgcccactacgacggctacctggccaaggacggcagcaagttctactgcagcagaacccagaacgagggccaccccaagtggttcgtgctgggcgtgggccaggtgatcaagggcctggacatcgccatgaccgacatgtgccccggcgagaagagaaaggtggtgatcccccccagcttcgcctacggcaaggagggctacgccgagggcaagatcccccccgacgccaccctgatcttcgagatcgagctgtacgccgtgaccaagggccccagaagcatcgagaccttcaagcagatcgacatggacaacgacagacagctgagcaaggccgagatcaacctgtacctgcagagagagttcgagaaggacgagaagcccagagacaagagctaccaggacgccgtgctggaggacatcttcaagaagaacgaccacgacggcgacggcttcatcagccccaaggagtacaacgtgtaccagcacgacgagctgtag

SEQ ID NO: 21395 - DNA, 666 bp, Artificial Sequence
  Description of Artificial Sequence: Synthetic coding sequence
atgcccaagaccatgcacttcctgttcagattcatcgtgttcttctacctgtggggcctgttcaccgcccagagacagaagaaggaggagagcaccgaggaggtgaagatcgaggtgctgcacagacccgagaactgcagcaagaccagcaagaagggcgacctgctgaacgcccactacgacggctacctggccaaggacggcagcaagttctactgcagcagaacccagaacgagggccaccccaagtggttcgtgctgggcgtgggccaggtgatcaagggcctggacatcgccatgaccgacatgtgccccggcgagaagagaaaggtggtgatcccccccagcttcgcctacggcaaggagggctacgagggcaagatcccccccgacgccaccctgatcttcgagatcgagctgtacgccgtgaccaagggccccagaagcatcgagaccttcaagcagatcgacatggacaacgacagacagctgagcaaggccgagatcaacctgtacctgcagagagagttcgagaaggacgagaagcccagagacaagagctaccaggacgccgtgctggaggacatcttcaagaagaacgaccacgacggcgacggcttcatcagccccaaggagtacaacgtgtaccagcacgacgagctgtag

SEQ ID NO: 21396 - DNA, 1050 bp, Artificial Sequence
  Description of Artificial Sequence: Synthetic coding sequence
atggagaccccccccgtgaacaccatcggcgagaaggacaccagccagccccagcaggagtgggagaagaacctgagagagaacctggacagcgtgatccagatcagacagcagcccagagacccccccaccgagaccctggagctggaggtgagccccgaccccgccagccagatcctggagcacacccagggcgccgagaagctggtggccgagctggagggcgacagccacaagagccacggcagcaccagccagatgcccgagaccctgcaggccagcgacctgtggtactgccccgacggcagcttcgtgaagaagatcgtgatcagaggccacggcctggacaagcccaagctgggcagctgctgcagagtgctggccctgggcttccccttcggcagcggcccccccgagggctggaccgagctgaccatgggcgtgggcccctggagagaggagacctggggcgagctgatcgagaagtgcctggagagcatgtgccagggcgaggaggccgagctgcagctgcccggccacagcggcccccccgtgagactgaccctggccagcttcacccagggcagagacagctgggagctggagaccagcgagaaggaggccctggccagagaggagagagccagaggcaccgagctgttcagagccggcaaccccgagggcgccgccagatgctacggcagagccctgagactgctgctgaccctgcccccccccggcccccccgagagaaccgtgctgcacgccaacctggccgcctgccagctgctgctgggccagccccagctggccgcccagagctgcgacagagtgctggagagagagcccggccacctgaaggccctgtacagaagaggcgtggcccaggccgccctgggcaacctggagaaggccaccgccgacctgaagaaggtgctggccatcgaccccaagaacagagccgcccaggaggagctgggcaaggtggtgatccagggcaagaaccaggacgccggcctggcccagggcctgagaaagatgttcggctag

SEQ ID NO: 21397 - DNA, 423 bp, Artificial Sequence
  Description of Artificial Sequence: Synthetic coding sequence
atgcccctgcccgagcccagcgagcaggagggcgagagcgtgaaggccagccaggagcccagccccaagcccggcaccgaggtgatccccgccgcccccagaaagcccagaaagttcagcaagctggtgctgctgaccgccagcaaggacagcaccaaggtggccggcgccaagagaaagggcgtgcactgcgtgatgagcctgggcgtgcccggccccgccaccctggccaaggccctgctgcagacccaccccgaggcccagagagccatcgaggccgccccccaggagcccgagcagaagagaagcagacaggaccccggcaccgacagaaccgaggacagcggcctggccgccggcccccccgaggccgccggcgagaacttcgccccctgcagcgtggcccccggcaagagcctgtag

SEQ ID NO: 21398 - DNA, 423 bp, Artificial Sequence; identical to SEQ ID NO: 21397
  Description of Artificial Sequence: Synthetic coding sequence

SEQ ID NO: 21399 - DNA, 735 bp, Artificial Sequence
  Description of Artificial Sequence: Synthetic coding sequence
atggacatggcctggcagatgatgcagctgctgctgctggccctggtgaccgccgccggcagcgcccagcccagaagcgccagagccagaaccgacctgctgaacgtgtgcatgaacgccaagcaccacaagacccagcccagccccgaggacgagctgtacggccagtgcagcccctggaagaagaacgcctgctgcaccgccagcaccagccaggagctgcacaaggacaccagcagactgtacaacttcaactgggaccactgcggcaagatggagcccacctgcaagagacacttcatccaggacagctgcctggagtgcagccccaacctgggcccctggatcagacaggtgaaccagagctggagaaaggagagaatcctgaacgtgcccctgtgcaaggaggactgcgagagatggtgggaggactgcagaaccagctacacctgcaagagcaactggcacaagggctggaactggaccagcggcatcaacgagtgccccgccggcgccctgtgcagcaccttcgagagctacttccccacccccgccgccctgtgcgagggcctgtggagccacagcttcaaggtgagcaactacagcagaggcagcggcagatgcatccagatgtggttcgacagcgcccagggcaaccccaacgaggaggtggccaagttctacgccgccgccatgaacgccggcgcccccagcagaggcatcatcgacagctag

SEQ ID NO: 21400 - DNA, 864 bp, Artificial Sequence
  Description of Artificial Sequence: Synthetic coding sequence
atggacatggcctggcagatgatgcagctgctgctgctggccctggtgaccgccgccggcagcgcccagcccagaagcgccagagccagaaccgacctgctgaacgtgtgcatgaacgccaagcaccacaagacccagcccagccccgaggacgagctgtacggccaggtgggcgccccccagggccccagccccggcagcgtgcccctggacgacctgcccggcgccgaggagcccgagtacggcggcgacggctgcggcggcgagagactgagccccgtgagcagcccccccagcgccgtgcccggcagaagaatgcccgccgccagacccgcccccgccagaagctgcaccagaaccccccccgcctgcaccaccctgaccggcatcaccgtggtgagatggaacccccccgccagcgccaccctgagcagaaccgccgtgagcgagtgcagccccaacctgggcccctggatcagacaggtgaaccagagctggagaaaggagagaatcctgaacgtgcccctgtgcaaggaggactgcgagagatggtgggaggactgcagaaccagctacacctgcaagagcaactggcacaagggctggaactggaccagcggcatcaacgagtgccccgccggcgccctgtgcagcaccttcgagagctacttccccacccccgccgccctgtgcgagggcctgtggagccacagcttcaaggtgagcaactacagcagaggcagcggcagatgcatccagatgtggttcgacagcgcccagggcaaccccaacgaggaggtggccaagttctacgccgccgccatgaacgccggcgcccccagcagaggcatcatcgacagctag

SEQ ID NO: 21401 - DNA, 1380 bp, Artificial Sequence
  Description of Artificial Sequence: Synthetic coding sequence
atgaccctgagcaccgagatgagcgacgccagcggcctggccgaggagaccgacatcgacgtggtgggcgagggcgaggacgaggaggacgaggaggaggaggacgacgacgagggcggcggcggcggccccagactggccgtgcccgcccagagaagaagaagaagaagaagctacgccggcgaggacgagctggaggacctggaggaggaggaggacgacgacgacatcctgctggccccccccgccggcggcagccccgccccccccggccccgcccccgccgccggcgccggcgccggcggcggcggcggcggcggcggcgccggcggcggcggcagcgccggcagcggcgccaagaaccccctggtgaagcccccctacagctacatcgccctgatcaccatggccatcctgcagagccccaagaagagactgaccctgagcgagatctgcgagttcatcagcggcagattcccctactacagagagaagttccccgcctggcagaacagcatcagacacaacctgagcctgaacgactgcttcgtgaagatccccagagagcccggcaaccccggcaagggcaactactggaccctggaccccgagagcgccgacatgttcgacaacggcagcttcctgagaagaagaaagagattcaagagacagcccctgctgccccccaacgccgccgccgccgagagcctgctgctgagaggcgccggcgccgccggcggcgccggcgaccccgccgccgccgccgccctgttcccccccgccccccccccccccccccacgcctacggctacggcccctacggctgcggctacggcctgcagctgcccccctacgccccccccagcgccctgttcgccgccgccgccagaagaagaagaagaagactgccccccgccctggcccccgccgcccccgccaccgccagaagaggcagaagagccggccccgacagactgagactgcccgccgcccccgccagaagaagacccaccagaccccccgccggcctgagaggccagggcggcagacccggcagactgagcgccggcgccctggccctgctgcacagagagcaccacagaggccagctgggccccggcagaagatgcagaagaagaagagccggcagaagaagaagaagcggcctggccctggccctggccggcggcggcgccgccagcagcagaatccagagaagaagactgagaggcgccggcggcagaggccccggcggcagagcccaccccatccccagaggcagaagaggcagaagaagactgctgagcctgctggtgagaagactgggcgacagcgcccccagagactgccccgtgcagtgcagagagctgtactgctag

SEQ ID NO: 21402 - DNA, 2202 bp, Artificial Sequence
  Description of Artificial Sequence: Synthetic coding sequence
atggccgaggtgggcgaggacagcggcgccagagccctgctggccctgagaagcgccccctgcagccccgtgctgtgcgccgccgccgccgccgccgccttccccgccgccgcccccccccccgcccccgcccagccccagcccccccccggcccccccccccccccccccccccccctgccccccggcgccatcgccggcgccggcagcagcggcggcagcagcggcgtgagcggcgacagcgccgtggccggcgccgcccccgccctggtggccgccgccgccgccagcgtgagacagagccccggccccgccctggccagactggagggcagagagttcgagttcctgatgagacagcccagcgtgaccatcggcagaaacagcagccagggcagcgtggacctgagcatgggcctgagcagcttcatcagcagaagacacctgcagctgagcttccaggagccccacttctacctgagatgcctgggcaagaacggcgtgttcgtggacggcgccttccagagaagaggcgcccccgccctgcagctgcccaagcagtgcaccttcagattccccagcaccgccatcaagatccagttcaccagcctgtaccacaaggaggaggcccccgccagccccctgagacccctgtacccccagatcagccccctgaagatccacatccccgagcccgacctgagaagcatggtgagccccgtgcccagccccaccggcaccatcagcgtgcccaacagctgccccgccagccccagaggcgccggcagcagcagctacagattcgtgcagaacgtgaccagcgacctgcagctggccgccgagttcgccgccaaggccgccagcgagcagcaggccgacaccagcggcggcgacagccccaaggacgagagcaagccccccttcagctacgcccagctgatcgtgcaggccatcagcagcgcccaggacagacagctgaccctgagcggcatctacgcccacatcaccaagcactacccctactacagaaccgccgacaagggctggcagaacagcatcagacacaacctgagcctgaacagatacttcatcaaggtgcccagaagccaggaggagcccggcaagggcagcttctggagaatcgaccccgccagcgaggccaagctggtggagcaggccttcagaaagagaagacagagaggcgtgagctgcttcagaacccccttcggccccctgagcagcagaagcgcccccgccagccccacccaccccggcctgatgagccccagaagcggcggcctgcagacccccgagtgcctgagcagagagggcagccccatcccccacgaccccgagttcggcagcaagctggccagcgtgcccgagtacagatacagccagagcgcccccggcagccccgtgagcgcccagcccgtgatcatggccgtgccccccagacccagcagcctggtggccaagcccgtggcctacatgcccgccagcatcgtgaccagccagcagcccgccggccacgccatccacgtggtgcagcaggcccccaccgtgaccatggtgagagtggtgaccaccagcgccaacagcgccaacggctacatcctgaccagccagggcgccgccggcggcagccacgacgccgccggcgccgccgtgctggacctgggcagcgaggccagaggcctggaggagaagcccaccatcgccttcgccaccatccccgccgccggcggcgtgatccagaccgtggccagccagatggcccccggcgtgcccggccacaccgtgaccatcctgcagcccgccacccccgtgaccctgggccagcaccacctgcccgtgagagccgtgacccagaacggcaagcacgccgtgcccaccaacagcctggccggcaacgcctacgccctgaccagccccctgcagctgctggccacccaggccagcagcagcgcccccgtggtggtgaccagagtgtgcgaggtgggccccaaggagcccgccgccgccgtggccgccaccgccaccaccacccccgccaccgccaccaccgccagcgccagcgccagcagcaccggcgagcccgaggtgaagagaagcagagtggaggagcccagcggcgccgtgaccacccccgccggcgtgatcgccgccgccggcccccagggccccggcaccggcgagtag

SEQ ID NO: 21403 - DNA, 1713 bp, Artificial Sequence
  Description of Artificial Sequence: Synthetic coding sequence
atggcctactgcctgggcgtgaacttcgtgcccagcagattctgctaccagctgcacagactgctgctgagatgcaccttcagattccccagcaccgccatcaagatccagttcaccagcctgtaccacaaggaggaggcccccgccagccccctgagacccctgtacccccagatcagccccctgaagatccacatccccgagcccgacctgagaagcatggtgagccccgtgcccagccccaccggcaccatcagcgtgcccaacagctgccccgccagccccagaggcgccggcagcagcagctacagattcgtgcagaacgtgaccagcgacctgcagctggccgccgagttcgccgccaaggccgccagcgagcagcaggccgacaccagcggcggcgacagccccaaggacgagagcaagccccccttcagctacgcccagctgatcgtgcaggccatcagcagcgcccaggacagacagctgaccctgagcggcatctacgcccacatcaccaagcactacccctactacagaaccgccgacaagggctggcagaacagcatcagacacaacctgagcctgaacagatacttcatcaaggtgcccagaagccaggaggagcccggcaagggcagcttctggagaatcgaccccgccagcgaggccaagctggtggagcaggccttcagaaagagaagacagagaggcgtgagctgcttcagaacccccttcggccccctgagcagcagaagcgcccccgccagccccacccaccccggcctgatgagccccagaagcggcggcctgcagacccccgagtgcctgagcagagagggcagccccatcccccacgaccccgagttcggcagcaagctggccagcgtgcccgagtacagatacagccagagcgcccccggcagccccgtgagcgcccagcccgtgatcatggccgtgccccccagacccagcagcctggtggccaagcccgtggcctacatgcccgccagcatcgtgaccagccagcagcccgccggccacgccatccacgtggtgcagcaggcccccaccgtgaccatggtgagagtggtgaccaccagcgccaacagcgccaacggctacatcctgaccagccagggcgccgccggcggcagccacgacgccgccggcgccgccgtgctggacctgggcagcgaggccagaggcctggaggagaagcccaccatcgccttcgccaccatccccgccgccggcggcgtgatccagaccgtggccagccagatggcccccggcgtgcccggccacaccgtgaccatcctgcagcccgccacccccgtgaccctgggccagcaccacctgcccgtgagagccgtgacccagaacggcaagcacgccgtgcccaccaacagcctggccggcaacgcctacgccctgaccagccccctgcagctgctggccacccaggccagcagcagcgcccccgtggtggtgaccagagtgtgcgaggtgggccccaaggagcccgccgccgccgtggccgccaccgccaccaccacccccgccaccgccaccaccgccagcgccagcgccagcagcaccggcgagcccgaggtgaagagaagcagagtggaggagcccagcggcgccgtgaccacccccgccggcgtgatcgccgccgccggcccccagggccccggcaccggcgagtag

SEQ ID NO: 21404 - DNA, 1470 bp, Artificial Sequence
  Description of Artificial Sequence: Synthetic coding sequence
atggtgagccccgtgcccagccccaccggcaccatcagcgtgcccaacagctgccccgccagccccagaggcgccggcagcagcagctacagattcgtgcagaacgtgaccagcgacctgcagctggccgccgagttcgccgccaaggccgccagcgagcagcaggccgacaccagcggcggcgacagccccaaggacgagagcaagccccccttcagctacgcccagctgatcgtgcaggccatcagcagcgcccaggacagacagctgaccctgagcggcatctacgcccacatcaccaagcactacccctactacagaaccgccgacaagggctggcagaacagcatcagacacaacctgagcctgaacagatacttcatcaaggtgcccagaagccaggaggagcccggcaagggcagcttctggagaatcgaccccgccagcgaggccaagctggtggagcaggccttcagaaagagaagacagagaggcgtgagctgcttcagaacccccttcggccccctgagcagcagaagcgcccccgccagccccacccaccccggcctgatgagccccagaagcggcggcctgcagaccccccccatcccccacgaccccgagttcggcagcaagctggccagcgtgcccgagtacagatacagccagagcgcccccggcagccccgtgagcgcccagcccgtgatcatggccgtgccccccagacccagcagcctggtggccaagcccgtggcctacatgcccgccagcatcgtgaccagccagcagcccgccggccacgccatccacgtggtgcagcaggcccccaccgtgaccatggtgagagtggtgaccaccagcgccaacagcgccaacggctacatcctgaccagccagggcgccgccggcggcagccacgacgccgccggcgccgccgtgctggacctgggcagcgaggccagaggcctggaggagaagcccaccatcgccttcgccaccatccccgccgccggcggcgtgatccagaccgtggccagccagatggcccccggcgtgcccggccacaccgtgaccatcctgcagcccgccacccccgtgaccctgggccagcaccacctgcccgtgagagccgtgacccagaacggcaagcacgccgtgcccaccaacagcctggccggcaacgcctacgccctgaccagccccctgcagctgctggccacccaggccagcagcagcgcccccgtggtggtgaccagagtgtgcgaggtgggccccaaggagcccgccgccgccgtggccgccaccgccaccaccacccccgccaccgccaccaccgccagcgccagcgccagcagcaccggcgagcccgaggtgaagagaagcagagtggaggagcccagcggcgccgtgaccacccccgccggcgtgatcgccgccgccggcccccagggccccggcaccggcgagtag

SEQ ID NO: 21405 - DNA, 1752 bp, Artificial Sequence
  Description of Artificial Sequence: Synthetic coding sequence
atgagacagcccagcgtgaccatcggcagaaacagcagccagggcagcgtggacctgagcatgggcctgagcagcttcatcagcagaagacacctgcagctgagcttccaggagccccacttctacctgagatgcctgggcaagaacggcgtgttcgtggacggcgccttccagagaagaggcgcccccgccctgcagctgcccaagcagtgcaccttcagattccccagcaccgccatcaagatccagttcaccagcctgtaccacaaggaggaggcccccgccagccccctgagacccctgtacccccagatcagccccctgaagatccacatccccgagcccgacctgagaagcatggtgagccccgtgcccagccccaccggcaccatcagcgtgcccaacagctgccccgccagccccagaggcgccggcagcagcagctacagattcgtgcagaacgtgaccagcgacctgcagctggccgccgagttcgccgccaaggccgccagcgagcagcaggccgacaccagcggcggcgacagccccaaggacgagagcaagccccccttcagctacgcccagctgatcgtgcaggccatcagcagcgcccaggacagacagctgaccctgagcggcatctacgcccacatcaccaagcactacccctactacagaaccgccgacaagggctggcagaacagcatcagacacaacctgagcctgaacagatacttcatcaaggtgcccagaagccaggaggagcccggcaagggcagcttctggagaatcgaccccgccagcgaggccaagctggtggagcaggccttcagaaagagaagacagagaggcgtgagctgcttcagaacccccttcggccccctgagcagcagaagcgcccccgccagccccacccaccccggcctgatgagccccagaagcggcggcctgcagacccccgagtgcctgagcagagagggcagccccatcccccacgaccccgagttcggcagcaagctggccagcgtgcccgagtacagatacagccagagcgcccccggcagccccgtgagcgcccagcccgtgatcatggccgtgccccccagacccagcagcctggtggccaagcccgtggcctacatgcccgccagcatcgtgaccagccagcagcccgccggccacgccatccacgtggtgcagcaggcccccaccgtgaccatggtgagagtggtgaccaccagcgccaacagcgccaacggctacatcctgaccagccagggcgccgccggcggcagccacgacgccgccggcgccgccgtgctggacctgggcagcgaggccagaggcctggaggagaagcccaccatcgccttcgccaccatccccgccgccggcggcgtgatccagaccgtggccagccagatggcccccggcgtgcccggccacaccgtgaccatcctgcagcccgccacccccgtgaccctgggccagcaccacctgcccgtgagagccgtgacccagaacggcaagcacgccgtgcccaccaacagcctggccggcaacgcctacgccctgaccagccccctgcagctgctggccacccaggccagcagcagcgcccccgtggtggtgaccagagtgtgcgaggtgggccccaaggagcccctgccccccccccccctgcccccccccctgcccctggagagccccagaagcaagggccccggctggagaagccccgtggtgctgtag

SEQ ID NO: 21406 - DNA, 1947 bp, Artificial Sequence
  Description of Artificial Sequence: Synthetic coding sequence
atggtgagcctgccccccccccagagcgacgtgaccctgcccggccccaccagactggagggcgagagacagggcgacctgatgcaggcccccggcctgcccggcagccccgccccccagagcaagcacgccggcttcagctgcagcagcttcgtgagcgacggcccccccgagagaacccccagcctgcccccccacagccccagaatcgccagccccggccccgagcaggtgcagggccactgccccgccggccccggccccggccccttcagactgagccccagcgacaagtaccccggcttcggcttcgaggaggccgccgccagcagccccggcagattcctgaagggcagccacgcccccttccacccctacaagagacccttccacgaggacgtgttccccgaggccgagaccaccctggccctgaagggccacagcttcaagacccccggccccctggaggccttcgaggagatccccgtggacgtggccgaggccgaggccttcctgcccggcttcagcgccgaggcctggtgcaacggcctgccctaccccagccaggagcacggcccccaggtgctgggcagcgaggtgaaggtgaagccccccgtgctggagagcggcgccggcatgttctgctaccagccccccctgcagcacatgtactgcagcagccagccccccttccaccagtacagccccggcggcggcagctaccccatcccctacctgggcagcagccactaccagtaccagagaatggccccccaggccagcaccgacggccaccagcccctgttccccaagcccatctacagctacagcatcctgatcttcatggccctgaagaacagcaagaccggcagcctgcccgtgagcgagatctacaacttcatgaccgagcacttcccctacttcaagaccgcccccgacggctggaagaacagcgtgagacacaacctgagcctgaacaagtgcttcgagaaggtggagaacaagagcggcagcagcagcagaaagggctgcctgtgggccctgaaccccgccaagatcgacaagatgcaggaggagctgcagaagtggaagagaaaggaccccatcgccgtgagaaagagcatggccaagcccgaggagctggacagcctgatcggcgacaagagagagaagctgggcagccccctgctgggctgccccccccccggcctgagcggcagcggccccatcagacccctggccccccccgccggcctgagcccccccctgcacagcctgcaccccgcccccggccccatccccggcaagaaccccctgcaggacctgctgatgggccacacccccagctgctacggccagacctacctgcacctgagccccggcctggccccccccggccccccccagcccctgttcccccagcccgacggccacctggagctgagagcccagcccggcaccccccaggacagccccctgcccgcccacaccccccccagccacagcgccaagctgctggccgagcccagccccgccagaaccatgcacgacaccctgctgcccgacggcgacctgggcaccgacctggacgccatcaaccccagcctgaccgacttcgacttccagggcaacctgtgggagcagctgaaggacgacagcctggccctggaccccctggtgctggtgaccagcagccccaccagcagcagcatgccccccccccagccccccccccactgcttcccccccggcccctgcctgaccgagaccggcagcggcgccggcgacctggccgcccccggcagcggcggcagcggcgccctgggcgacctgcacctgaccaccctgtacagcgccttcatggagctggagcccaccccccccaccgcccccgccggccccagcgtgtacctgagccccagcagcaagcccgtggccctggcctag

SEQ ID NO: 21407 - DNA, 1191 bp, Artificial Sequence
  Description of Artificial Sequence: Synthetic coding sequence
atgcccaaccccagacccggcaagcccagcgcccccagcctggccctgggccccagccccggcgccagccccagctggagagccgcccccaaggccagcgacctgctgggcgccagaggccccggcggcaccttccagggcagagacctgagaggcggcgcccacgccagcagcagcagcctgaaccccatgccccccagccagctgcagctgagcaccgtggacgcccacgccagaacccccgtgctgcaggtgcaccccctggagagccccgccatgatcagcctgaccccccccaccaccgccaccggcgtgttcagcctgaaggccagacccggcctgccccccggcatcaacgtggccagcctggagtgggtgagcagagagcccgccctgctgtgcaccttccccaaccccagcgcccccagaaaggacagcaccctgagcgccgtgccccagagcagctaccccctgctggccaacggcgtgtgcaagtggcccggctgcgagaaggtgttcgaggagcccgaggacttcctgaagcactgccaggccgaccacctgctggacgagaagggcagagcccagtgcctgctgcagagagagatggtgcagagcctggagcagcagctggtgctggagaaggagaagctgagcgccatgcaggcccacctggccggcaagatggccctgaccaaggccagcagcgtggccagcagcgacaagggcagctgctgcatcgtggccgccggcagccagggccccgtggtgcccgcctggagcggccccagagaggcccccgacagcctgttcgccgtgagaagacacctgtggggcagccacggcaacagcaccttccccgagttcctgcacaacatggactacttcaagttccacaacatgagaccccccttcacctacgccaccctgatcagatgggccatcctggaggcccccgagaagcagagaaccctgaacgagatctaccactggttcaccagaatgttcgccttcttcagaaaccaccccgccacctggaagaacgccatcagacacaacctgagcctgcacaagtgcttcgtgagagtggagagcgagaagggcgccgtgtggaccgtggacgagctggagttcagaaagaagagaagccagagacccagcagatgcagcaaccccacccccggcccctag

SEQ ID NO: 21408 - DNA, 2052 bp, Artificial Sequence
  Description of Artificial Sequence: Synthetic coding sequence
atgcaggagctggagagcctgctggcccagcagaagaaggccctggccaagagcatcacccaggagaagaacagagtgaaggaggccctggaggaggagcagaccagagtgcaggagctggaggagagactggccagacagaaggagatcagcgagagcaacatcgcctacgagaagagaaaggccaaggaggccatggagaaggagaagaagaaggtgcaggacctggagaacagactgaccaagcagaaggaggagctggagctgaaggagcagaaggaggacgtgctgaacaacaagctgagcgacgccctggccatggtggaggagacccagaagaccaaggccaccgagagcctgaaggccgagagcctggccctgaagctgaacgagaccctggccgagctggagaccaccaagaccaagatgatcatggtggaggagagactgatcctgcagcagaagatggtgaaggccctgcaggacgagcaggagagccagagacacggcttcgaggaggagatcatggagtacaaggagcagatcaagcagcacgcccagaccatcgtgagcctggaggagaagctgcagaaggtgacccagcaccacaagaagatcgagggcgagatcgccaccctgaaggacaacgaccccgcccccaaggaggagagaccccaggaccccctggtggcccccatgaccgagagcagcgccaaggacatggcctacgagcacctgatcgacgacctgctggccgcccagaaggagatcctgagccagcaggaggtgatcatgaagctgagaaaggacctgaccgaggcccacagcagaatgagcgacctgagaggcgagctgaacgagaagcagaagatggagctggagcagaacgtggtgctggtgcagcagcagagcaaggagctgagcgtgctgaaggagaagatggcccagatgagcagcctggtggagaagaaggacagagagctgaaggccctggaggaggccctgagagccagccaggagaagcacagactgcagctgaacaccgagaaggagcagaagcccagaaagaagacccagacctgcgacaccagcgtgcagatcgagcccgtgcacaccgaggccttcagcagcagccaggagcagcagagcttcagcgacctgggcgtgagatgcaagggcagcagacacgaggaggtgatccagagacagaagaaggccctgagcgagctgagagccagaatcaaggagctggagaaggccagaagccccgaccacaaggaccaccagaacgagagcttcctggacctgaagaacctgagaatggagaacaacgtgcagaagatcctgctggacgccaagcccgacctgcccaccctgagcagaatcgagatcctggccccccagaacggcctgtgcaacgccagattcggcagcgccatggagaagagcggcaagatggacgtggccgaggccctggagctgagcgagaagctgtacctggacatgagcaagaccctgggcagcctgatgaacatcaagaacatgagcggccacgtgagcatgaagtacctgagcagacaggagagagagaaggtgaaccagctgagacagagagacctggacctggtgttcgacaagatcacccagctgaagaaccagctgggcagaaaggaggagctgctgagaggctacgagaaggacgtggagcagctgagaagaagcaaggtgagcatcgagatgtaccagagccaggtggccaagctggaggacgacatctacaaggaggccgaggagaaggccctgctgaaggaggccctggagagaatggagcaccagctgtgccaggagaagagaatcaacagagccatcagacagcagaagagaagagtgttcgtggagatggtgaagaacagaatgcagaacagcaacagccaggtgggcaccagaaaggccagcctgaagatggaccaggagagagagatgctgagaaaggagaccagcagcaagagcagccagagcctgctgcacagcaagcccagcggcaagtactag

SEQ ID NO: 21409 - DNA, 4239 bp, Artificial Sequence
  Description of Artificial Sequence: Synthetic coding sequence
atgaaggcctacctgaagagcgccgagggcttcttcgtgctgaacaagagcaccaccatcggcagacacgagaacagcgacctggtgctgcagagccccgacatcgacaaccaccacgccctgatcgagtacaacgaggccgagtgcagcttcgtgctgcaggacttcaacagcagaaacggcaccttcgtgaacgagtgccacatccagaacgtggccgtgaagctgatccccggcgacatcctgagattcggcagcgccggcctgacctacgagctggtgatcgagaaccccccccccgtgagcttcccctggatgagaggccccgccccctggcccggcccccagccccccagagccacccagcagcccaaccaggcccccccccccagccacatccccttccaccagggcgtgcagcccgcccccatgcagagaagctggagccaggccttccccagacccaccgtggtgctgcccgccagccacagaagacccgtgagcgccaacaaggagatgttcagcttcgtggtggacgacgccagaaagccccccgtgatcaagcaggtgtggaccaacgccatgaagctgagcgagaagagcgtggccgagggcatccccggcgccgtgccccccgccgagatctacgtggaggaggacctggcccagcaggacaaggacgagatcatcctgctgctgggcaaggaggtgagcagactgagcgactacgagatcgagagcaagtacaaggacgtgatcatcgccaacctgcagaacgaggtggccgagctgagccagaaggtgagcgagaccaccaccagcagacagaacgagaaggagatcagccagaagtgccaggtgctggacgaggacatcgacgccaagcagaaggagatccagagcctgaagagccagatcagcgccctgcagaagggctacagcaaggtgctgtgccagaccctgagcgagagaaacagcgagatcaccagcctgaagaacgagggcgagaacctgaagagagacaacgccatcaccagcggcatggtgagcagcctgcagaaggacatcctggccaaggacgagcaggtgcagcagctgaaggaggaggtgagccacctgaagagccagaacaaggacaaggaccaccagctggaggccctgggcagcagatgcagcgtgctgaaggaggagctgaagcaggaggacgcccacagagagctgagagaggcccaggagaaggagctgaagctgtgcaagacccagatccaggacatggagaaggagatgaagaagctgagagccgagctgagaaagagctgcaccgagcagagcgtgatcagcagaaccctgagagagaagagcaaggtggaggagaagctgcaggaggacagcagaagaaagctgctgcagctgcaggagatgggcaacagagagagcgtgatcaagatcaacctggagagagccgtgggccagctggagcacttcagaagccaggtgatcaaggccacctacggcagagccaagcccttcagagacaagcccgtgaccgaccagcagctgatcgagaagatcacccaggtgaccgaggacaacatcaacttccagcagaagaagtggaccctgcagaaggagacccagctgagcaacagcaagcaggaggagaccaccgagaacatcgagaagctgagaaccagcctggacagctgccaggcctgcatgaagatcagctgctgcagccacgacctgaagaaggaggtggacctgctgcagcacctgcaggtgagcccccccgtgagcggcctgcagaaggtggtgctggacgtgctgagacacgccctgagctggctggaggaggtggagcagctgctgagagacctgggcatcctgcccagcagccccaacaaggaccaggtgcagcagttcagcggcaacagcgccgtgttcaccgccggcaaggccgccggcgccagcggcagagagggcgaggccgagagaggcgaggccagagccagaggcgaggcccagagccagaaccaggccaccgacggcagagagggcggcaaggccctggaggagtacatcacccaggagagaaacagagccaaggagaccctggaggaggagagaaagagaatgcaggagctggagagcctgctggcccagcagaagaaggccctggccaagagcatcacccaggagaagaacagagtgaaggaggccctggaggaggagcagaccagagtgcaggagctggaggagagactggccagacagaaggaggtgctggagagcagcatcgcccacgagaagagaaaggccaaggaggccctggagagcgagaagagaaaggtgcaggacctggagaaccacctgacccagcagaaggagatcagcgagagcaacatcgcctacgagaagagaaaggccaaggaggccatggagaaggagaagaagaaggtgcaggacctggagaacagactgaccaagcagaaggaggagctggagctgaaggagcagaaggaggacgtgctgaacaacaagctgagcgacgccctggccatggtggaggagacccagaagaccaaggccaccgagagcctgaaggccgagagcctggccctgaagctgaacgagaccctggccgagctggagaccaccaagaccaagatgatcatggtggaggagagactgatcctgcagcagaagatggtgaaggccctgcaggacgagcaggagagccagagacacggcttcgaggaggagatcatggagtacaaggagcagatcaagcagcacgcccagaccatcgtgagcctggaggagaagctgcagaaggtgacccagcaccacaagaagatcgagggcgagatcgccaccctgaaggacaacgaccccgcccccaaggaggagagaccccaggaccccctggtggcccccatgaccgagagcagcgccaaggacatggcctacgagcacctgatcgacgacctgctggccgcccagaaggagatcctgagccagcaggaggtgatcatgaagctgagaaaggacctgaccgaggcccacagcagaatgagcgacctgagaggcgagctgaacgagaagcagaagatggagctggagcagaacgtggtgctggtgcagcagcagagcaaggagctgagcgtgctgaaggagaagatggcccagatgagcagcctggtggagaagaaggacagagagctgaaggccctggaggaggccctgagagccagccaggagaagcacagactgcagctgaacaccgagaaggagcagaagcccagaaagaagacccagacctgcgacaccagcgtgcagatcgagcccgtgcacaccgaggccttcagcagcagccaggagcagcagagcttcagcgacctgggcgtgagatgcaagggcagcagacacgaggaggtgatccagagacagaagaaggccctgagcgagctgagagccagaatcaaggagctggagaaggccagaagccccgaccacaaggaccaccagaacgagagcttcctggacctgaagaacctgagaatggagaacaacgtgcagaagatcctgctggacgccaagcccgacctgcccaccctgagcagaatcgagatcctggccccccagaacggcctgtgcaacgccagattcggcagcgccatggagaagagcggcaagatggacgtggccgaggccctggagctgagcgagaagctgtacctggacatgagcaagaccctgggcagcctgatgaacatcaagaacatgagcggccacgtgagcatgaagtacctgagcagacaggagagagagaaggtgaaccagctgagacagagagacctggacctggtgttcgacaagatcacccagctgaagaaccagctgggcagaaaggaggagctgctgagaggctacgagaaggacgtggagcagctgagaagaagcaaggtgagcatcgagatgtaccagagccaggtggccaagctggaggacgacatctacaaggaggccgaggagaaggccctgctgaaggaggccctggagagaatggagcaccagctgtgccaggagaagagaatcaacagagccatcagacagcagaaggtgggcaccagaaaggccagcctgaagatggaccaggagagagagatgctgagaaaggagaccagcagcaagagcagccagagcctgctgcacagcaagcccagcggcaagtactag

SEQ ID NO: 21410 - DNA, 4362 bp, Artificial Sequence
  Description of Artificial Sequence: Synthetic coding sequence
atgaaggcctacctgaagagcgccgagggcttcttcgtgctgaacaagagcaccaccatcggcagacacgagaacagcgacctggtgctgcagagccccgacatcgacaaccaccacgccctgatcgagtacaacgaggccgagtgcagcttcgtgctgcaggacttcaacagcagaaacggcaccttcgtgaacgagtgccacatccagaacgtggccgtgaagctgatccccggcgacatcctgagattcggcagcgccggcctgacctacgagctggtgatcgagaaccccccccccgtgagcttcccctggatgagaggccccgccccctggcccggcccccagccccccagagccacccagcagcccaaccaggcccccccccccagccacatccccttccaccagggcgtgcagcccgcccccatgcagagaagctggagccaggccttccccagacccaccgtggtgctgcccgccagccacagaagacccgtgagcgccaacaaggagatgttcagcttcgtggtggacgacgccagaaagccccccgtgatcaagcaggtgtggaccaacgccatgaagctgagcgagaagagcgtggccgagggcatccccggcgccgtgccccccgccgagatctacgtggaggaggacctggcccagcaggacaaggacgagatcatcctgctgctgggcaaggaggtgagcagactgagcgactacgagatcgagagcaagtacaaggacgtgatcatcgccaacctgcagaacgaggtggccgagctgagccagaaggtgagcgagaccaccaccagcagacagaacgagaaggagatcagccagaagtgccaggtgctggacgaggacatcgacgccaagcagaaggagatccagagcctgaagagccagatcagcgccctgcagaagggctacagcaaggtgctgtgccagaccctgagcgagagaaacagcgagatcaccagcctgaagaacgagggcgagaacctgaagagagacaacgccatcaccagcggcatggtgagcagcctgcagaaggacatcctggccaaggacgagcaggtgcagcagctgaaggaggaggtgagccacctgaagagccagaacaaggacaaggaccaccagctggaggccctgggcagcagatgcagcgtgctgaaggaggagctgaagcaggaggacgcccacagagagctgagagaggcccaggagaaggagctgaagctgtgcaagacccagatccaggacatggagaaggagatgaagaagctgagagccgagctgagaaagagctgcaccgagcagagcgtgatcagcagaaccctgagagagaagagcaaggtggaggagaagctgcaggaggacagcagaagaaagctgctgcagctgcaggagatgggcaacagagagagcgtgatcaagatcaacctggagagagccgtgggccagctggagcacttcagaagccaggtgatcaaggccacctacggcagagccaagcccttcagagacaagcccgtgaccgaccagcagctgatcgagaagatcacccaggtgaccgaggacaacatcaacttccagcagaagaagtggaccctgcagaaggagacccagctgagcaacagcaagcaggaggagaccaccgagaacatcgagaagctgagaaccagcctggacagctgccaggcctgcatgaagatcagctgctgcagccacgacctgaagaaggaggtggacctgctgcagcacctgcaggtgagcccccccgtgagcggcctgcagaaggtggtgctggacgtgctgagacacgccctgagctggctggaggaggtggagcagctgctgagagacctgggcatcctgcccagcagccccaacaaggaccaggtgcagcagttcagcggcaacagcgccgtgttcaccgccggcaaggccgccggcgccagcggcagagagggcgaggccgagagaggcgaggccagagccagaggcgaggcccagagccagaaccaggccaccgacggcagagagggcggcaaggccctggaggagtacatcacccaggagagaaacagagccaaggagaccctggaggaggagagaaagagaatgcaggagctggagagcctgctggcccagcagaagaaggccctggccaagagcatcacccaggagaagaacagagtgaaggaggccctggaggaggagcagaccagagtgcaggagctggaggagagactggccagacagaaggaggtgctggagagcagcatcgcccacgagaagagaaaggccaaggaggccctggagagcgagaagagaaaggtgcaggacctggagaaccacctgacccagcagaaggagatcagcgagagcaacatcgcctacgagaagagaaaggccaaggaggccatggagaaggagaagaagaaggtgcaggacctggagaacagactgaccaagcagaaggaggagctggagctgaaggagcagaaggaggacgtgctgaacaacaagctgagcgacgccctggccatggtggaggagacccagaagaccaaggccaccgagagcctgaaggccgagagcctggccctgaagctgaacgagaccctggccgagctggagaccaccaagaccaagatgatcatggtggaggagagactgatcctgcagcagaagatggtgaaggccctgcaggacgagcaggagagccagagacacggcttcgaggaggagatcatggagtacaaggagcagatcaagcagcacgcccagaccatcgtgagcctggaggagaagctgcagaaggtgacccagcaccacaagaagatcgagggcgagatcgccaccctgaaggacaacgaccccgcccccaaggaggagagaccccaggaccccctggtggcccccatgaccgagagcagcgccaaggacatggcctacgagcacctgatcgacgacctgctggccgcccagaaggagatcctgagccagcaggaggtgatcatgaagctgagaaaggacctgaccgaggcccacagcagaatgagcgacctgagaggcgagctgaacgagaagcagaagatggagctggagcagaacgtggtgctggtgcagcagcagagcaaggagctgagcgtgctgaaggagaagatggcccagatgagcagcctggtggagaagaaggacagagagctgaaggccctggaggaggccctgagagccagccaggagaagcacagactgcagctgaacaccgagaaggagcagaagcccagaaagaagacccagacctgcgacaccagcgtgcagatcgagcccgtgcacaccgaggccttcagcagcagccaggagcagcagagcttcagcgacctgggcgtgagatgcaagggcagcagacacgaggaggtgatccagagacagaagaaggccctgagcgagctgagagccagaatcaaggagctggagaaggccagaagccccgaccacaaggaccaccagaacgagagcttcctggacctgaagaacctgagaatggagaacaacgtgcagaagatcctgctggacgccaagcccgacctgcccaccctgagcagaatcgagatcctggccccccagaacggcctgtgcaacgccagattcggcagcgccatggagaagagcggcaagatggacgtggccgaggccctggagctgagcgagaagctgtacctggacatgagcaagaccctgggcagcctgatgaacatcaagaacatgagcggccacgtgagcatgaagtacctgagcagacaggagagagagaaggtgaaccagctgagacagagagacctggacctggtgttcgacaagatcacccagctgaagaaccagctgggcagaaaggaggagctgctgagaggctacgagaaggacgtggagcagctgagaagaagcaaggtgagcatcgagatgtaccagagccaggtggccaagctggaggacgacatctacaaggaggccgaggagaaggccctgctgaaggaggccctggagagaatggagcaccagctgtgccaggagaagagaatcaacagagccatcagacagcagaagatgagaaagctgagactgagagagctgagaggcgcccaggtgcacaccgccgccggcaaggacagctgggacctgacccccgaccccagcgaccccggcagccccgccgtgtgcagagtgggcagaaagtgcagaggcgccagaaccgagaagagaaagagaatcgacaccctgcagctgtgcctgcagagagagagacaggccggccccgccccccccgcctgcagcctgaacggctag

SEQ ID NO: 21411 - DNA, 951 bp, Artificial Sequence
  Description of Artificial Sequence: Synthetic coding sequence
atgatcctgagaccccccagaccctgcggcaccatcagcgccctgcagaagggctacagcaaggtgctgtgccagaccctgagcgagagaaacagcgagatcaccagcctgaagaacgagggcgagaacctgaagagagacaacgccatcaccagcggcatggtgagcagcctgcagaaggacatcctggccaaggacgagcaggtgcagcagctgaaggaggaggtgagccacctgaagagccagaacaaggacaaggaccaccagctggaggccctgggcagcagatgcagcgtgctgaaggaggagctgaagcaggaggacgcccacagagagctgagagaggcccaggagaaggagctgaagctgtgcaagacccagatccaggacatggagaaggagatgaagaagctgagagccgagctgagaaagagctgcaccgagcagagcgtgatcagcagaaccctgagagagaagagcaagctggagcacttcagaagccaggtgatcaaggccacctacggcagagccaagcccttcagagacaagcccgtgaccgaccagcagctgatcgagaagatcacccaggtgaccgaggacaacatcaacttccagcagaagaagtggaccctgcagaaggagacccagctgagcaacagcaagcaggaggagaccaccgagaacatcgagaagctgagaaccagcctggacagctgccaggcctgcatgaagatcagctgctgcagccacgacctgaagaaggaggtggacctgctgcagcacctgcaggtgagcccccccgtgagcggcctgcagaaggtggtgctggacgtgctgagacacgccctgagctggctggaggaggtggagcagctgctgagagacctgggcatcctgcccagcagccccaacaagggctactgggacttcttcagccacatggtggcctag

SEQ ID NO: 21412 - DNA, 4131 bp, Artificial Sequence
  Description of Artificial Sequence: Synthetic coding sequence
atgaaggcctacctgaagagcgccgagggcttcttcgtgctgaacaagagcaccaccatcggcagacacgagaacagcgacctggtgctgcagagccccgacatcgacaaccaccacgccctgatcgagtacaacgaggccgagtgcagcttcgtgctgcaggacttcaacagcagaaacggcaccttcgtgaacgagtgccacatccagaacgtggccgtgaagctgatccccggcgacatcctgagattcggcagcgccggcctgacctacgagctggtgatcgagaaccccccccccgtgagcttcccctggatgagaggccccgccccctggcccggcccccagccccccagagccacccagcagcccaaccaggcccccccccccagccacatccccttccaccagggcgtgcagcccgcccccatgcagagaagctggagccaggccttccccagacccaccgtggtgctgcccgccagccacagaagacccgtgagcgccaacaaggagatgttcagcttcgtggtggacgacgccagaaagccccccgtgatcaagcaggtgtggaccaacgccatgaagctgagcgagaagagcgtggccgagggcatccccggcgccgtgccccccgccgagatctacgtggaggaggacctggcccagcaggacaaggacgagatcatcctgctgctgggcaaggaggtgagcagactgagcgactacgagatcgagagcaagtacaaggacgtgatcatcgccaacctgcagaacgaggtggccgagctgagccagaaggtgagcgagaccaccaccagcagacagaacgagaaggagatcagccagaagtgccaggtgctggacgaggacatcgacgccaagcagaaggagatccagagcctgaagagccagatcagcgccctgcagaagggctacagcaaggtgctgtgccagaccctgagcgagagaaacagcgagatcaccagcctgaagaacgagggcgagaacctgaagagagacaacgccatcaccagcggcatggtgagcagcctgcagaaggacatcctggccaaggacgagcaggtgcagcagctgaaggaggaggtgagccacctgaagagccagaacaaggacaaggaccaccagctggaggccctgggcagcagatgcagcgtgctgaaggaggagctgaagcaggaggacgcccacagagagctgagagaggcccaggagaaggagctgaagctgtgcaagacccagatccaggacatggagaaggagatgaagaagctgagagccgagctgagaaagagctgcaccgagcagagcgtgatcagcagaaccctgagagagaagagcaaggtggaggagaagctgcaggaggacagcagaagaaagctgctgcagctgcaggagatgggcaacagagagagcgtgatcaagatcaacctggagagagccgtgggccagctggagcacttcagaagccaggtgatcaaggccacctacggcagagccaagcccttcagagacaagcccgtgaccgaccagcagctgatcgagaagatcacccaggtgaccgaggacaacatcaacttccagcagaagaagtggaccctgcagaaggagacccagctgagcaacagcaagcaggaggagaccaccgagaacatcgagaagctgagaaccagcctggacagctgccaggcctgcatgaagatcagctgctgcagccacgacctgaagaaggaggtggacctgctgcagcacctgcaggtgagcccccccgtgagcggcctgcagaaggtggtgctggacgtgctgagacacgccctgagctggctggaggaggtggagcagctgctgagagacctgggcatcctgcccagcagccccaacaaggaccaggtgcagcagttcagcggcaacagcgccgtgttcaccgccggcaaggccgccggcgccagcggcagagagggcgaggccgagagaggcgaggccagagccagaggcgaggcccagagccagaaccaggccaccgacggcagagagggcggcaaggccctggaggagtacatcacccaggagagaaacagagccaaggagaccctggaggaggagagaaagagaatgcaggagctggagagcctgctggcccagcagaagaaggccctggccaagagcatcacccaggagaagaacagagtgaaggaggccctggaggaggagcagaccagagtgcaggagctggaggagagactggccagacagaaggagatcagcgagagcaacatcgcctacgagaagagaaaggccaaggaggccatggagaaggagaagaagaaggtgcaggacctggagaacagactgaccaagcagaaggaggagctggagctgaaggagcagaaggaggacgtgctgaacaacaagctgagcgacgccctggccatggtggaggagacccagaagaccaaggccaccgagagcctgaaggccgagagcctggccctgaagctgaacgagaccctggccgagctggagaccaccaagaccaagatgatcatggtggaggagagactgatcctgcagcagaagatggtgaaggccctgcaggacgagcaggagagccagagacacggcttcgaggaggagatcatggagtacaaggagcagatcaagcagcacgcccagaccatcgtgagcctggaggagaagctgcagaaggtgacccagcaccacaagaagatcgagggcgagatcgccaccctgaaggacaacgaccccgcccccaaggaggagagaccccaggaccccctggtggcccccatgaccgagagcagcgccaaggacatggcctacgagcacctgatcgacgacctgctggccgcccagaaggagatcctgagccagcaggaggtgatcatgaagctgagaaaggacctgaccgaggcccacagcagaatgagcgacctgagaggcgagctgaacgagaagcagaagatggagctggagcagaacgtggtgctggtgcagcagcagagcaaggagctgagcgtgctgaaggagaagatggcccagatgagcagcctggtggagaagaaggacagagagctgaaggccctggaggaggccctgagagccagccaggagaagcacagactgcagctgaacaccgagaaggagcagaagcccagaaagaagacccagacctgcgacaccagcgtgcagatcgagcccgtgcacaccgaggccttcagcagcagccaggagcagcagagcttcagcgacctgggcgtgagatgcaagggcagcagacacgaggaggtgatccagagacagaagaaggccctgagcgagctgagagccagaatcaaggagctggagaaggccagaagccccgaccacaaggaccaccagaacgagagcttcctggacctgaagaacctgagaatggagaacaacgtgcagaagatcctgctggacgccaagcccgacctgcccaccctgagcagaatcgagatcctggccccccagaacggcctgtgcaacgccagattcggcagcgccatggagaagagcggcaagatggacgtggccgaggccctggagctgagcgagaagctgtacctggacatgagcaagaccctgggcagcctgatgaacatcaagaacatgagcggccacgtgagcatgaagtacctgagcagacaggagagagagaaggtgaaccagctgagacagagagacctggacctggtgttcgacaagatcacccagctgaagaaccagctgggcagaaaggaggagctgctgagaggctacgagaaggacgtggagcagctgagaagaagcaaggtgagcatcgagatgtaccagagccaggtggccaagctggaggacgacatctacaaggaggccgaggagaaggccctgctgaaggaggccctggagagaatggagcaccagctgtgccaggagaagagaatcaacagagccatcagacagcagaaggtgggcaccagaaaggccagcctgaagatggaccaggagagagagatgctgagaaaggagaccagcagcaagagcagccagagcctgctgcacagcaagcccagcggcaagtactag

SEQ ID NO: 21413 - DNA, 1656 bp, Artificial Sequence
  Description of Artificial Sequence: Synthetic coding sequence
atgagctggggcaccgagctgtgggaccagttcgacagcctggacaagcacacccagtggggcatcgacttcctggagagatacgccaagttcgtgaaggagagaatcgagatcgagcagaactacgccaagcagctgagaaacctggtgaagaagtactgccccaagagaagcagcaaggacgaggagcccagattcaccagctgcgtggccttcttcaacatcctgaacgagctgaacgactacgccggccagagagaggtggtggccgaggagatggcccacagagtgtacggcgagctgatgagatacgcccacgacctgaagaccgagagaaagatgcacctgcaggagggcagaaaggcccagcagtacctggacatgtgctggaagcagatggacaacagcaagaagaagttcgagagagagtgcagagaggccgagaaggcccagcagagctacgagagactggacaacgacaccaacgccaccaaggccgacgtggagaaggccaagcagcagctgaacctgagaacccacatggccgacgagaacaagaacgagtacgccgcccagctgcagaacttcaacggcgagcagcacaagcacttctacgtggtgatcccccagatctacaagcagctgcaggagatggacgagagaagaaccatcaagctgagcgagtgctacagaggcttcgccgacagcgagagaaaggtgatccccatcatcagcaagtgcctggagggcatgatcctggccgccaagagcgtggacgagagaagagacagccagatggtggtggacagcttcaagagcggcttcgagccccccggcgacttccccttcgaggactacagccagcacatctacagaaccatcagcgacggcaccatcagcgccagcaagcaggagagcggcaagatggacgccaagaccaccgtgggcaaggccaagggcaagctgtggctgttcggcaagaagcccaagggccccgccctggaggacttcagccacctgccccccgagcagagaagaaagaagctgcagcagagaatcgacgagctgaacagagagctgcagaaggagagcgaccagaaggacgccctgaacaagatgaaggacgtgtacgagaagaacccccagatgggcgaccccggcagcctgcagcccaagctggccgagaccatgaacaacatcgacagactgagaatggagatccacaagaacgaggcctggctgagcgaggtggagggcaagaccggcggcagaggcgacagaagacacagcagcgacatcaaccacctggtgacccagggcagagagagccccgagggcagctacaccgacgacgccaaccaggaggtgagaggccccccccagcagcacggccaccacaacgagttcgacgacgagttcgaggacgacgaccccctgcccgccatcggccactgcaaggccatctaccccttcgacggccacaacgagggcaccctggccatgaaggagggcgaggtgctgtacatcatcgaggaggacaagggcgacggctggaccagagccagaagacagaacggcgaggagggctacgtgcccaccagctacatcgacgtgaccctggagaagaacagcaagggcgccgtgacctacatctag

SEQ ID NO: 21414 - DNA, 1818 bp, Artificial Sequence
  Description of Artificial Sequence: Synthetic coding sequence
atgagctggggcaccgagctgtgggaccagttcgacagcctggacaagcacacccagtggggcatcgacttcctggagagatacgccaagttcgtgaaggagagaatcgagatcgagcagaactacgccaagcagctgagaaacctggtgaagaagtactgccccaagagaagcagcaaggacgaggagcccagattcaccagctgcgtggccttcttcaacatcctgaacgagctgaacgactacgccggccagagagaggtggtggccgaggagatggcccacagagtgtacggcgagctgatgagatacgcccacgacctgaagaccgagagaaagatgcacctgcaggagggcagaaaggcccagcagtacctggacatgtgctggaagcagatggacaacagcaagaagaagttcgagagagagtgcagagaggccgagaaggcccagcagagctacgagagactggacaacgacaccaacgccaccaaggccgacgtggagaaggccaagcagcagctgaacctgagaacccacatggccgacgagaacaagaacgagtacgccgcccagctgcagaacttcaacggcgagcagcacaagcacttctacgtggtgatcccccagatctacaagcagctgcaggagatggacgagagaagaaccatcaagctgagcgagtgctacagaggcttcgccgacagcgagagaaaggtgatccccatcatcagcaagtgcctggagggcatgatcctggccgccaagagcgtggacgagagaagagacagccagatggtggtggacagcttcaagagcggcttcgagccccccggcgacttccccttcgaggactacagccagcacatctacagaaccatcagcgacggcaccatcagcgccagcaagcaggagagcggcaagatggacgccaagaccaccgtgggcaaggccaagggcaagctgtggctgttcggcaagaagcccaagccccagagcccccccctgacccccaccagcctgttcaccagcagcacccccaacggcagccagttcctgaccttcagcatcgagcccgtgcactactgcatgaacgagatcaagaccggcaagcccagaatccccagcttcagaagcctgaagagaggctggagcgtgaagatgggccccgccctggaggacttcagccacctgccccccgagcagagaagaaagaagctgcagcagagaatcgacgagctgaacagagagctgcagaaggagagcgaccagaaggacgccctgaacaagatgaaggacgtgtacgagaagaacccccagatgggcgaccccggcagcctgcagcccaagctggccgagaccatgaacaacatcgacagactgagaatggagatccacaagaacgaggcctggctgagcgaggtggagggcaagaccggcggcagaggcgacagaagacacagcagcgacatcaaccacctggtgacccagggcagagagagccccgagggcagctacaccgacgacgccaaccaggaggtgagaggccccccccagcagcacggccaccacaacgagttcgacgacgagttcgaggacgacgaccccctgcccgccatcggccactgcaaggccatctaccccttcgacggccacaacgagggcaccctggccatgaaggagggcgaggtgctgtacatcatcgaggaggacaagggcgacggctggaccagagccagaagacagaacggcgaggagggctacgtgcccaccagctacatcgacgtgaccctggagaagaacagcaagggcagctag

SEQ ID NO: 21415 - DNA, 1815 bp, Artificial Sequence
  Description of Artificial Sequence: Synthetic coding sequence
atgagctggggcaccgagctgtgggaccagttcgacagcctggacaagcacacccagtggggcatcgacttcctggagagatacgccaagttcgtgaaggagagaatcgagatcgagcagaactacgccaagcagctgagaaacctggtgaagaagtactgccccaagagaagcagcaaggacgaggagcccagattcaccagctgcgtggccttcttcaacatcctgaacgagctgaacgactacgccggccagagagaggtggtggccgaggagatggcccacagagtgtacggcgagctgatgagatacgcccacgacctgaagaccgagagaaagatgcacctgcaggagggcagaaaggcccagcagtacctggacatgtgctggaagcagatggacaacagcaagaagaagttcgagagagagtgcagagaggccgagaaggcccagcagagctacgagagactggacaacgacaccaacgccaccaaggccgacgtggagaaggccaagcagcagctgaacctgagaacccacatggccgacgagaacaagaacgagtacgccgcccagctgcagaacttcaacggcgagcagcacaagcacttctacgtggtgatcccccagatctacaagcagctgcaggagatggacgagagaagaaccatcaagctgagcgagtgctacagaggcttcgccgacagcgagagaaaggtgatccccatcatcagcaagtgcctggagggcatgatcctggccgccaagagcgtggacgagagaagagacagccagatggtggtggacagcttcaagagcggcttcgagccccccggcgacttccccttcgaggactacagccagcacatctacagaaccatcagcgacggcaccatcagcgccagcaagcaggagagcggcaagatggacgccaagaccaccgtgggcaaggccaagggcaagctgtggctgttcggcaagaagcccaagccccagagcccccccctgacccccaccagcctgttcaccagcagcacccccaacggcagccagttcctgaccttcagcatcgagcccgtgcactactgcatgaacgagatcaagaccggcaagcccagaatccccagcttcagaagcctgaagagaggcggccccgccctggaggacttcagccacctgccccccgagcagagaagaaagaagctgcagcagagaatcgacgagctgaacagagagctgcagaaggagagcgaccagaaggacgccctgaacaagatgaaggacgtgtacgagaagaacccccagatgggcgaccccggcagcctgcagcccaagctggccgagaccatgaacaacatcgacagactgagaatggagatccacaagaacgaggcctggctgagcgaggtggagggcaagaccggcggcagaggcgacagaagacacagcagcgacatcaaccacctggtgacccagggcagagagagccccgagggcagctacaccgacgacgccaaccaggaggtgagaggccccccccagcagcacggccaccacaacgagttcgacgacgagttcgaggacgacgaccccctgcccgccatcggccactgcaaggccatctaccccttcgacggccacaacgagggcaccctggccatgaaggagggcgaggtgctgtacatcatcgaggaggacaagggcgacggctggaccagagccagaagacagaacggcgaggagggctacgtgcccaccagctacatcgacgtgaccctggagaagaacagcaagggcgccgtgacctacatctag

SEQ ID NO: 21416 - DNA, 1803 bp, Artificial Sequence
  Description of Artificial Sequence: Synthetic coding sequence
atgagctggggcaccgagctgtgggaccagttcgacagcctggacaagcacacccagtggggcatcgacttcctggagagatacgccaagttcgtgaaggagagaatcgagatcgagcagaactacgccaagcagctgagaaacctggtgaagaagtactgccccaagagaagcagcaaggacgaggagcccagattcaccagctgcgtggccttcttcaacatcctgaacgagctgaacgactacgccggccagagagaggtggtggccgaggagatggcccacagagtgtacggcgagctgatgagatacgcccacgacctgaagaccgagagaaagatgcacctgcaggagggcagaaaggcccagcagtacctggacatgtgctggaagcagatggacaacagcaagaagaagttcgagagagagtgcagagaggccgagaaggcccagcagagctacgagagactggacaacgacaccaacgccaccaaggccgacgtggagaaggccaagcagcagctgaacctgagaacccacatggccgacgagaacaagaacgagtacgccgcccagctgcagaacttcaacggcgagcagcacaagcacttctacgtggtgatcccccagatctacaagcagctgcaggagatggacgagagaagaaccatcaagctgagcgagtgctacagaggcttcgccgacagcgagagaaaggtgatccccatcatcagcaagtgcctggagggcatgatcctggccgccaagagcgtggacgagagaagagacagccagatggtggtggacagcttcaagagcggcttcgagccccccggcgacttccccttcgaggactacagccagcacatctacagaaccatcagcgacggcaccatcagcgccagcaagcaggagagcggcaagatggacgccaagaccaccgtgggcaaggccaagggcaagctgtggctgttcggcaagaagcccaagccccagagcccccccctgacccccaccagcctgttcaccagcagcacccccaacggcagccagttcctgaccttcagcatcgagcccgtgcactactgcatgaacgagatcaagaccggcaagcccagaatccccagcttcagaagcctgaagagaggcggccccgccctggaggacttcagccacctgccccccgagcagagaagaaagaagctgcagcagagaatcgacgagctgaacagagagctgcagaaggagagcgaccagaaggacgccctgaacaagatgaaggacgtgtacgagaagaacccccagatgggcgaccccggcagcctgcagcccaagctggccgagaccatgaacaacatcgacagactgagaatggagatccacaagaacgaggcctggctgagcgaggtggagggcaagaccggcggcagaggcgacagaagacacagcagcgacatcaaccacctggtgacccagggcagagagagccccgagggcagctacaccgacgacgccaaccaggaggtgagaggccccccccagcagcacggccaccacaacgagttcgacgacgagttcgaggacgacgaccccctgcccgccatcggccactgcaaggccatctaccccttcgacggccacaacgagggcaccctggccatgaaggagggcgaggtgctgtacatcatcgaggaggacaagggcgacggctggaccagagccagaagacagaacggcgaggagggctacgtgcccaccagctacatcgacgtgaccctggagaagaacagcaagggcagctag

SEQ ID NO: 21417 - DNA, 1257 bp, Artificial Sequence
  Description of Artificial Sequence: Synthetic coding sequence
gacaacagcaagaagaagttcgagagagagtgcagagaggccgagaaggcccagcagagctacgagagactggacaacgacaccaacgccaccaaggccgacgtggagaaggccaagcagcagctgaacctgagaacccacatggccgacgagaacaagaacgagtacgccgcccagctgcagaacttcaacggcgagcagcacaagcacttctacgtggtgatcccccagatctacaagcagctgcaggagatggacgagagaagaaccatcaagctgagcgagtgctacagaggcttcgccgacagcgagagaaaggtgatccccatcatcagcaagtgcctggagggcatgatcctggccgccaagagcgtggacgagagaagagacagccagatggtggtggacagcttcaagagcggcttcgagccccccggcgacttccccttcgaggactacagccagcacatctacagaaccatcagcgacggcaccatcagcgccagcaagcaggagagcggcaagatggacgccaagaccaccgtgggcaaggccaagggcaagctgtggctgttcggcaagaagcccaagggccccgccctggaggacttcagccacctgccccccgagcagagaagaaagaagctgcagcagagaatcgacgagctgaacagagagctgcagaaggagagcgaccagaaggacgccctgaacaagatgaaggacgtgtacgagaagaacccccagatgggcgaccccggcagcctgcagcccaagctggccgagaccatgaacaacatcgacagactgagaatggagatccacaagaacgaggcctggctgagcgaggtggagggcaagaccggcggcagaggcgacagaagacacagcagcgacatcaaccacctggtgacccagggcagagagagccccgagggcagctacaccgacgacgccaaccaggaggtgagaggccccccccagcagcacggccaccacaacgagttcgacgacgagttcgaggacgacgaccccctgcccgccatcggccactgcaaggccatctaccccttcgacggccacaacgagggcaccctggccatgaaggagggcgaggtgctgtacatcatcgaggaggacaagggcgacggctggaccagagccagaagacagaacggcgaggagggctacgtgcccaccagctacatcgacgtgaccctggagaagaacagcaagggcgccgtgacctacatctag

SEQ ID NO: 21418 - DNA, 747 bp, Artificial Sequence
  Description of Artificial Sequence: Synthetic coding sequence
atggacgccaagaccaccgtgggcaaggccaagggcaagctgtggctgttcggcaagaagcccaagccccagagcccccccctgacccccaccagcctgttcaccagcagcacccccaacggcagccagttcctgaccttcagcatcgagcccgtgcactactgcatgaacgagatcaagaccggcaagcccagaatccccagcttcagaagcctgaagagaggctggagcgtgaagatgggccccgccctggaggacttcagccacctgccccccgagcagagaagaaagaagctgcagcagagaatcgacgagctgaacagagagctgcagaaggagagcgaccagaaggacgccctgaacaagatgaaggacgtgtacgagaagaacccccagatgggcgaccccggcagcctgcagcccaagctggccgagaccatgaacaacatcgacagactgagaatggagatccacaagaacgaggcctggctgagcgaggtggagggcaagaccggcggcagaggcgacagaagacacagcagcgacatcaaccacctggtgacccagggcagagagagccccgagggcagctacaccgacgacgccaaccaggaggtgagaggccccccccagcagcacggccaccacaacgagttcgacgacgagttcgaggacgacgaccccctgcccgccatcggccactgcaaggccatctaccccctgatggacatcatgaaggtgctgtag

SEQ ID NO: 21419 - DNA, 3054 bp, Artificial Sequence
  Description of Artificial Sequence: Synthetic coding sequence
atgggcaagaagagcagagccgtgcccggcagaagacccatcctgcagctgagcccccccggccccagaggcagcacccccggcagagaccccgagcccgagcccgacaccgagcccgacagcaccgccgccgtgcccagccagcccgcccccagcgccgccaccaccaccaccaccgccgtgaccgccgccgccgccagcgacgacagccccagcgaggacgagcaggaggccgtgcaggaggtgcccagagtggtgcagaacccccccaagcccgtgatgaccaccagacccaccgccgtgaaggccaccggcggcctgtgcctgctgggcgcctacgccgacagcgacgacgacgacaacgacgtgagcgagaagctggcccagagcaaggagaccaacggcaaccagagcaccgacatcgacagcaccctggccaacttcctggccgagatcgacgccatcaccgccccccagcccgccgcccccgtgggcgccagcgcccccccccccaccccccccagacccgagcccaaggaggccgccaccagcaccctgagcagcagcaccagcaacggcaccgacagcacccagaccagcggctggcagtacgacacccagtgcagcctggccggcgtgggcatcgagatgggcgactggcaggaggtgtgggacgagaacaccggctgctactactactggaacacccagaccaacgaggtgacctgggagctgccccagtacctggccacccaggtgcagggcctgcagcactaccagcccagcagcgtgcccggcgccgagaccagcttcgtggtgaacaccgacatctacagcaaggagaagaccatcagcgtgagcagcagcaagagcggccccgtgatcgccaagagagaggtgaagaaggaggtgaacgagggcatccaggccctgagcaacagcgaggaggagaagaagggcgtggccgccagcctgctggcccccctgctgcccgagggcatcaaggaggaggaggagagatggagaagaaaggtgatctgcaaggaggagcccgtgagcgaggtgaaggagaccagcaccaccgtggaggaggccaccaccatcgtgaagccccaggagatcatgctggacaacatcgaggaccccagccaggaggacctgtgcagcgtggtgcagagcggcgagagcgaggaggaggaggagcaggacaccctggagctggagctggtgctggagagaaagaaggccgagctgagagccctggaggagggcgacggcagcgtgagcggcagcagccccagaagcgacatcagccagcccgccagccaggacggcatgagaagactgatgagcaagagaggcaagtggaagatgttcgtgagagccaccagccccgagagcaccagcagaagcagcagcaagaccggcagagacacccccgagaacggcgagaccgccatcggcgccgagaacagcgagaagatcgacgagaacagcgacaaggagatggaggtggaggagagccccgagaagatcaaggtgcagaccacccccaaggtggaggaggagcaggacctgaagttccagatcggcgagctggccaacaccctgaccagcaagttcgagttcctgggcatcaacagacagagcatcagcaacttccacgtgctgctgctgcagaccgagaccagaatcgccgactggagagagggcgccctgaacggcaactacctgaagagaaagctgcaggacgccgccgagcagctgaagcagtacgagatcaacgccacccccaagggctggagctgccactgggacagagaccacagaagatacttctacgtgaacgagcagagcggcgagagccagtgggagttccccgacggcgaggaggaggaggaggagagccaggcccaggagaacagagacgagaccctggccaagcagaccctgaaggacaagaccggcaccgacagcaacagcaccgagagcagcgagaccagcaccggcagcctgtgcaaggagagcttcagcggccaggtgagcagcagcagcctgatgcccctgacccccttctggaccctgctgcagagcaacgtgcccgtgctgcagccccccctgcccctggagatgccccccccccccccccccccccccgagagcccccccccccccccccccccccccccccccgccgaggacggcgagatccaggaggtggagatggaggacgagggcagcgaggagccccccgcccccggcaccgaggaggacacccccctgaagcccagcgcccagaccaccgtggtgaccagccagagcagcgtggacagcaccatcagcagcagcagcagcaccaagggcatcaagagaaaggccaccgagatcagcaccgccgtggtgcagagaagcgccaccatcggcagcagccccgtgctgtacagccagagcgccatcgccaccggccaccaggccgccggcatcggcaaccaggccaccggcatcggccaccagaccatccccgtgagcctgcccgccgccggcatgggccaccaggccagaggcatgagcctgcagagcaactacctgggcctggccgccgcccccgccatcatgagctacgccgagtgcagcgtgcccatcggcgtgaccgcccccagcctgcagcccgtgcaggccagaggcgccgtgcccaccgccaccatcatcgagccccccccccccccccccccccccccccccccccccccccccgcccccaagatgcccccccccgagaagaccaagaagggcagaaaggacaaggccaagaagagcaagaccaagatgcccagcctggtgaagaagtggcagagcatccagagagagctggacgaggaggacaacagcagcagcagcgaggaggacagagagagcaccgcccagaagagaatcgaggagtggaagcagcagcagctggtgagcggcatggccgagagaaacgccaacttcgaggccctgcccgaggactggagagccagactgaagagaagaaagatggcccccaacacctag

SEQ ID NO: 21420 - DNA, 3279 bp, Artificial Sequence
  Description of Artificial Sequence: Synthetic coding sequence
atgggcaacgccggcagcatggacagccagcagaccgacttcagagcccacaacgtgcccctgaagctgcccatgcccgagcccggcgagctggaggagagattcgccatcgtgctgaacgccatgaacctgccccccgacaaggccagactgctgagacagtacgacaacgagaagaagtgggagctgatctgcgaccaggagagattccaggtgaagaaccccccccacacctacatccagaagctgaagggctacctggaccccgccgtgaccagaaagaagttcagaagaagagtgcaggagagcacccaggtgctgagagagctggagatcagcctgagaaccaaccacatcggctgggtgagagagttcctgaacgaggagaacaagggcctggacgtgctggtggagtacctgagcttcgcccagtacgccgtgaccttcgacttcgagagcgtggagagcaccgtggagagcagcgtggacaagagcaagccctggagcagaagcatcgaggacctgcacagaggcagcaacctgcccagccccgtgggcaacagcgtgagcagaagcggcagacacagcgccctgagatacaacaccctgcccagcagaagaaccctgaagaacagcagactggtgagcaagaaggacgacgtgcacgtgtgcatcatgtgcctgagagccatcatgaactaccagtacggcttcaacatggtgatgagccacccccacgccgtgaacgagatcgccctgagcctgaacaacaagaaccccagaaccaaggccctggtgctggagctgctggccgccgtgtgcctggtgagaggcggccacgagatcatcctgagcgccttcgacaacttcaaggaggtgtgcggcgagaagcagagattcgagaagctgatggagcacttcagaaacgaggacaacaacatcgacttcatggtggccagcatgcagttcatcaacatcgtggtgcacagcgtggaggacatgaacttcagagtgcacctgcagtacgagttcaccaagctgggcctggacgagtacctggacaagctgaagcacaccgagagcgacaagctgcaggtgcagatccaggcctacctggacaacgtgttcgacgtgggcgccctgctggaggacgccgagaccaagaacgccgccctggagagagtggaggagctggaggagaacatcagccacctgagcgagaagctgcaggacaccgagaacgaggccatgagcaagatcgtggagctggagaagcagctgatgcagagaaacaaggagctggacgtggtgagagagatctacaaggacgccaacacccaggtgcacaccctgagaaagatggtgaaggagaaggaggaggccatccagagacagagcaccctggagaagaagatccacgagctggagaagcagggcaccatcaagatccagaagaagggcgacggcgacatcgccatcctgcccgtggtggccagcggcaccctgagcatgggcagcgaggtggtggccggcaacagcgtgggccccaccatgggcgccgccagcagcggccccctgccccccccccccccccccctgccccccagcagcgacacccccgagaccgtgcagaacggccccgtgaccccccccatgcccccccccccccccccccccccccccccccccccccccccccccccccccccccccccccccctgcccggccccgccgccgagaccgtgcccgccccccccctggccccccccctgcccagcgccccccccctgcccggcaccagcagccccaccgtggtgttcaacagcggcctggccgccgtgaagatcaagaagcccatcaagaccaagttcagaatgcccgtgttcaactgggtggccctgaagcccaaccagatcaacggcaccgtgttcaacgagatcgacgacgagagaatcctggaggacctgaacgtggacgagttcgaggagatcttcaagaccaaggcccagggccccgccatcgacctgagcagcagcaagcagaagatcccccagaagggcagcaacaaggtgaccctgctggaggccaacagagccaagaacctggccatcaccctgagaaaggccggcaagaccgccgacgagatctgcaaggccatccacgtgttcgacctgaagaccctgcccgtggacttcgtggagtgcctgatgagattcctgcccaccgagaacgaggtgaaggtgctgagactgtacgagagagagagaaagcccctggagaacctgagcgacgaggacagattcatgatgcagttcagcaagatcgagagactgatgcagaagatgaccatcatggccttcatcggcaacttcgccgagagcatccagatgctgaccccccagctgcacgccatcatcgccgccagcgtgagcatcaagagcagccagaagctgaagaagatcctggagatcatcctggccctgggcaactacatgaacagcagcaagagaggcgccgtgtacggcttcaagctgcagagcctggacctgctgctggacaccaagagcaccgacagaaagcagaccctgctgcactacatcagcaacgtggtgaaggagaagtaccaccaggtgagcctgttctacaacgagctgcactacgtggagaaggccgccgccgtgagcctggagaacgtgctgctggacgtgaaggagctgcagagaggcatggacctgaccaagagagagtacaccatgcacgaccacaacaccctgctgaaggagttcatcctgaacaacgagggcaagctgaagaagctgcaggacgacgccaagatcgcccaggacgccttcgacgacgtggtgaagtacttcggcgagaaccccaagaccaccccccccagcgtgttcttccccgtgttcgtgagattcgtgaaggcctacaagcaggccgaggaggagaacgagctgagaaagaagcaggagcaggccctgatggagaagctgctggagcaggaggccctgatggagcagcaggaccccaagagccccagccacaagagcaagagacagcagcaggagctgatcgccgagctgagaagaagacaggtgaaggacaacagacacgtgtacgagggcaaggacggcgccatcgaggacatcatcaccgacctgagaaaccagccctacagaagagccgacgccgtgagaagaagcgtgagaagaagattcgacgaccagaacctgagaagcgtgaacggcgccgagatcaccatgtag

SEQ ID NO: 21421 - DNA, 1707 bp, Artificial Sequence
  Description of Artificial Sequence: Synthetic coding sequence
atgggcagcgaggtggtggccggcaacagcgtgggccccaccatgggcgccgccagcagcggccccctgccccccccccccccccccctgccccccagcagcgacacccccgagaccgtgcagaacggccccgtgaccccccccatgcccccccccccccccctgcccggccccgccgccgagaccgtgcccgccccccccctggccccccccctgcccagcgccccccccctgcccggcaccagcagccccaccgtggtgttcaacagcggcctggccgccgtgaagatcaagaagcccatcaagaccaagttcagaatgcccgtgttcaactgggtggccctgaagcccaaccagatcaacggcaccgtgttcaacgagatcgacgacgagagaatcctggaggacctgaacgtggacgagttcgaggagatcttcaagaccaaggcccagggccccgccatcgacctgagcagcagcaagcagaagatcccccagaagggcagcaacaaggtgaccctgctggaggccaacagagccaagaacctggccatcaccctgagaaaggccggcaagaccgccgacgagatctgcaaggccatccacgtgttcgacctgaagaccctgcccgtggacttcgtggagtgcctgatgagattcctgcccaccgagaacgaggtgaaggtgctgagactgtacgagagagagagaaagcccctggagaacctgagcgacgaggacagattcatgatgcagttcagcaagatcgagagactgatgcagaagatgaccatcatggccttcatcggcaacttcgccgagagcatccagatgctgaccccccagctgcacgccatcatcgccgccagcgtgagcatcaagagcagccagaagctgaagaagatcctggagatcatcctggccctgggcaactacatgaacagcagcaagagaggcgccgtgtacggcttcaagctgcagagcctggacctgctgctggacaccaagagcaccgacagaaagcagaccctgctgcactacatcagcaacgtggtgaaggagaagtaccaccaggtgagcctgttctacaacgagctgcactacgtggagaaggccgccgccgtgagcctggagaacgtgctgctggacgtgaaggagctgcagagaggcatggacctgaccaagagagagtacaccatgcacgaccacaacaccctgctgaaggagttcatcctgaacaacgagggcaagctgaagaagctgcaggacgacgccaagatcgcccaggacgccttcgacgacgtggtgaagtacttcggcgagaaccccaagaccaccccccccagcgtgttcttccccgtgttcgtgagattcgtgaaggcctacaagcaggccgaggaggagaacgagctgagaaagaagcaggagcaggccctgatggagaagctgctggagcaggaggccctgatggagcagcaggaccccaagagccccagccacaagagcaagagacagcagcaggagctgatcgccgagctgagaagaagacaggtgaaggacaacagacacgtgtacgagggcaaggacggcgccatcgaggacatcatcaccgccctgaagaagaacaacatcaccaagttccccaacgtgcacagcagagtgagaatcagcagcagcacccccgtggtggaggacacccagagctag

SEQ ID NO: 21422 - DNA, 3087 bp, Artificial Sequence
  Description of Artificial Sequence: Synthetic coding sequence
atgggcaacctggagagcgccgagggcgtgcccggcgagccccccagcgtgcccctgctgctgccccccggcaagatgcccatgcccgagccctgcgagctggaggagagattcgccctggtgctgagcagcatgaacctgccccccgacaaggccagactgctgagacagtacgacaacgagaagaagtgggacctgatctgcgaccaggagagattccaggtgaagaaccccccccacacctacatccagaagctgcagagcttcctggaccccagcgtgaccagaaagaagttcagaagaagagtgcaggagagcaccaaggtgctgagagagctggagatcagcctgagaaccaaccacatcggctgggtgagagagttcctgaacgacgagaacaagggcctggacgtgctggtggactacctgagcttcgcccagtgcagcgtgatgttcgacttcgagggcctggagagcggcgacgacggcgccttcgacaagctgagaagctggagcagaagcatcgaggacctgcagccccccagcgccctgagcgcccccttcaccaacagcctggccagaagcgccagacagagcgtgctgagatacagcaccctgcccggcagaagagccctgaagaacagcagactggtgagccagaaggacgacgtgcacgtgtgcatcctgtgcctgagagccatcatgaactaccagtacggcttcaacctggtgatgagccacccccacgccgtgaacgagatcgccctgagcctgaacaacaagaaccccagaaccaaggccctggtgctggagctgctggccgccgtgtgcctggtgagaggcggccacgagatcatcctggccgccttcgacaacttcaaggaggtgtgcaaggagctgcacagattcgagaagctgatggagtacttcagaaacgaggacagcaacatcgacttcatggtggcctgcatgcagttcatcaacatcgtggtgcacagcgtggaggacatgaacttcagagtgcacctgcagtacgagttcaccaagctgggcctggaggagttcctgcagaagagcagacacaccgagagcgagaagctgcaggtgcagatccaggcctacctggacaacgtgttcgacgtgggcggcctgctggaggacgccgagaccaagaacgtggccctggagaaggtggaggagctggaggagcacgtgagccacctgaccgagaagctgctggacctggagaacgagaacatgatgagagtggccgagctggagaagcagctgctgcagagagagaaggagctggagagcatcaaggagacctacgagaacaccagccaccaggtgcacaccctgagaagactgatcaaggagaaggaggaggccttccagagaagatgccacctggagcccaacgtgagaggcctggagagcgtggacagcgaggccctggccagagtgggccccgccgagctgagcgagggcatgccccccagcgacctggacctgctggcccccgcccccccccccgaggaggtgctgcccctgccccccccccccgccccccccctgccccccccccccccccccctgcccgacaagtgcccccccgccccccccctgcccggcgccgcccccagcgtggtgctgaccgtgggcctgagcgccatcagaatcaagaagcccatcaagaccaagttcagactgcccgtgttcaactggaccgccctgaagcccaaccagatcagcggcaccgtgttcagcgagctggacgacgagaagatcctggaggacctggacctggacaagttcgaggagctgttcaagaccaaggcccagggccccgccctggacctgatctgcagcaagaacaagaccgcccagaaggccgccagcaaggtgaccctgctggaggccaacagagccaagaacctggccatcaccctgagaaaggccggcagaagcgccgaggagatctgcagagccatccacaccttcgacctgcagaccctgcccgtggacttcgtggagtgcctgatgagattcctgcccaccgaggccgaggtgaagctgctgagacagtacgagagagagagacagcccctggaggagctggccgccgaggacagattcatgctgctgttcagcaaggtggagagactgacccagagaatggccggcatggccttcctgggcaacttccaggacaacctgcagatgctgaccccccagctgaacgccatcatcgccgccagcgccagcgtgaagagcagccagaagctgaagcagatgctggagatcatcctggccctgggcaactacatgaacagcagcaagagaggcgccgtgtacggcttcaagctgcagagcctggacctgctgctggacaccaagagcaccgacagaaagatgaccctgctgcacttcatcgccctgaccgtgaaggagaagtaccccgacctggccaacttctggcacgagctgcacttcgtggagaaggccgccgccgtgagcctggagaacgtgctgctggacgtgaaggagctgggcagaggcatggagctgatcagaagagagtgcagcatccacgacaacagcgtgctgagaaacttcctgagcaccaacgagggcaagctggacaagctgcagagagacgccaagaccgccgaggaggcctacaacgccgtggtgagatacttcggcgagagccccaagaccaccccccccagcgtgttcttccccgtgttcgtgagattcatcagaagctacaaggaggccgagcaggagaacgaggccagaaagaagcaggaggaggtgatgagagagaagcagctggcccaggaggccaagaagctggacgccaagacccccagccagagaaacaagtggcagcagcaggagctgatcgccgagctgagaagaagacaggccaaggagcacagacccgtgtacgagggcaaggacggcaccatcgaggacatcatcaccgtgctgaagagcgtgcccttcaccgccagaaccgccaagagaggcagcagattcttctgcgacgccgcccaccacgacgagagcaactgctag

SEQ ID NO: 21423 - DNA, 3084 bp, Artificial Sequence
  Description of Artificial Sequence: Synthetic coding sequence
atgggcaacctggagagcgccgagggcgtgcccggcgagccccccagcgtgcccctgctgctgccccccggcaagatgcccatgcccgagccctgcgagctggaggagagattcgccctggtgctgagcagcatgaacctgccccccgacaaggccagactgctgagacagtacgacaacgagaagaagtgggacctgatctgcgaccaggagagattccaggtgaagaaccccccccacacctacatccagaagctgcagagcttcctggaccccagcgtgaccagaaagaagttcagaagaagagtgcaggagagcaccaaggtgctgagagagctggagatcagcctgagaaccaaccacatcggctgggtgagagagttcctgaacgacgagaacaagggcctggacgtgctggtggactacctgagcttcgcccagtgcagcgtgatgttcgacttcgagggcctggagagcggcgacgacggcgccttcgacaagctgagaagctggagcagaagcatcgaggacctgcagccccccagcgccctgagcgcccccttcaccaacagcctggccagaagcgccagacagagcgtgctgagatacagcaccctgcccggcagaagagccctgaagaacagcagactggtgagccagaaggacgacgtgcacgtgtgcatcctgtgcctgagagccatcatgaactaccagtacggcttcaacctggtgatgagccacccccacgccgtgaacgagatcgccctgagcctgaacaacaagaaccccagaaccaaggccctggtgctggagctgctggccgccgtgtgcctggtgagaggcggccacgagatcatcctggccgccttcgacaacttcaaggaggtgtgcaaggagctgcacagattcgagaagctgatggagtacttcagaaacgaggacagcaacatcgacttcatggtggcctgcatgcagttcatcaacatcgtggtgcacagcgtggaggacatgaacttcagagtgcacctgcagtacgagttcaccaagctgggcctggaggagttcctgcagaagagcagacacaccgagagcgagaagctgcaggtgcagatccaggcctacctggacaacgtgttcgacgtgggcggcctgctggaggacgccgagaccaagaacgtggccctggagaaggtggaggagctggaggagcacgtgagccacctgaccgagaagctgctggacctggagaacgagaacatgatgagagtggccgagctggagaagcagctgctgcagagagagaaggagctggagagcatcaaggagacctacgagaacaccagccaccaggtgcacaccctgagaagactgatcaaggagaaggaggaggccttccagagaagatgccacctggagcccaacgtgagaggcctggagagcgtggacagcgaggccctggccagagtgggccccgccgagctgagcgagggcatgccccccagcgacctggacctgctggcccccgcccccccccccgaggaggtgctgcccctgccccccccccccgccccccccctgccccccccccccccccccctgcccgacaagtgcccccccgccccccccctgcccggcgccgcccccagcgtggtgctgaccgtgggcctgagcgccatcagaatcaagaagcccatcaagaccaagttcagactgcccgtgttcaactggaccgccctgaagcccaaccagatcagcggcaccgtgttcagcgagctggacgacgagaagatcctggaggacctggacctggacaagttcgaggagctgttcaagaccaaggcccagggccccgccctggacctgatctgcagcaagaacaagaccgcccagaaggccgccagcaaggtgaccctgctggaggccaacagagccaagaacctggccatcaccctgagaaaggccggcagaagcgccgaggagatctgcagagccatccacaccttcgacctgcagaccctgcccgtggacttcgtggagtgcctgatgagattcctgcccaccgaggccgaggtgaagctgctgagacagtacgagagagagagacagcccctggaggagctggccgccgaggacagattcatgctgctgttcagcaaggtggagagactgacccagagaatggccggcatggccttcctgggcaacttccaggacaacctgcagatgctgaccccccagctgaacgccatcatcgccgccagcgccagcgtgaagagcagccagaagctgaagcagatgctggagatcatcctggccctgggcaactacatgaacagcagcaagagaggcgccgtgtacggcttcaagctgcagagcctggacctgctgctggacaccaagagcaccgacagaaagatgaccctgctgcacttcatcgccctgaccgtgaaggagaagtaccccgacctggccaacttctggcacgagctgcacttcgtggagaaggccgccgccgtgagcctggagaacgtgctgctggacgtgaaggagctgggcagaggcatggagctgatcagaagagagtgcagcatccacgacaacagcgtgctgagaaacttcctgagcaccaacgagggcaagctggacaagctgcagagagacgccaagaccgccgaggaggcctacaacgccgtggtgagatacttcggcgagagccccaagaccaccccccccagcgtgttcttccccgtgttcgtgagattcatcagaagctacaaggaggccgagcaggagaacgaggccagaaagaagcaggaggaggtgatgagagagaagcagctggcccaggaggccaagaagctggacgccaagacccccagccagagaaacaagtggcagcagcaggagctgatcgccgagctgagaagaagacaggccaaggagcacagacccgtgtacgagggcaaggacggcaccatcgaggacatcatcaccggcctgcactgccagcccatggtggtgagacaccaggccagaagcgccgccccccccagcggcccccccagagcccccggcccccactag

SEQ ID NO: 21424 - DNA, 2931 bp, Artificial Sequence
  Description of Artificial Sequence: Synthetic coding sequence
atgggcaacctggagagcgccgagggcgtgcccggcgagccccccagcgtgcccctgctgctgccccccggcaagatgcccatgcccgagccctgcgagctggaggagagattcgccctggtgctgagcagcatgaacctgccccccgacaaggccagactgctgagacagtacgacaacgagaagaagtgggacctgatctgcgaccaggagagattccaggtgaagaaccccccccacacctacatccagaagctgcagagcttcctggaccccagcgtgaccagaaagaagttcagaagaagagtgcaggagagcaccaaggtgctgagagagctggagatcagcctgagaaccaaccacatcggctgggtgagagagttcctgaacgacgagaacaagggcctggacgtgctggtggactacctgagcttcgcccagtgcagcgtgatgtacagcaccctgcccggcagaagagccctgaagaacagcagactggtgagccagaaggacgacgtgcacgtgtgcatcctgtgcctgagagccatcatgaactaccagtacggcttcaacctggtgatgagccacccccacgccgtgaacgagatcgccctgagcctgaacaacaagaaccccagaaccaaggccctggtgctggagctgctggccgccgtgtgcctggtgagaggcggccacgagatcatcctggccgccttcgacaacttcaaggaggtgtgcaaggagctgcacagattcgagaagctgatggagtacttcagaaacgaggacagcaacatcgacttcatggtggcctgcatgcagttcatcaacatcgtggtgcacagcgtggaggacatgaacttcagagtgcacctgcagtacgagttcaccaagctgggcctggaggagttcctgcagaagagcagacacaccgagagcgagaagctgcaggtgcagatccaggcctacctggacaacgtgttcgacgtgggcggcctgctggaggacgccgagaccaagaacgtggccctggagaaggtggaggagctggaggagcacgtgagccacctgaccgagaagctgctggacctggagaacgagaacatgatgagagtggccgagctggagaagcagctgctgcagagagagaaggagctggagagcatcaaggagacctacgagaacaccagccaccaggtgcacaccctgagaagactgatcaaggagaaggaggaggccttccagagaagatgccacctggagcccaacgtgagaggcctggagagcgtggacagcgaggccctggccagagtgggccccgccgagctgagcgagggcatgccccccagcgacctggacctgctggcccccgcccccccccccgaggaggtgctgcccctgccccccccccccgccccccccctgccccccccccccccccccctgcccgacaagtgcccccccgccccccccctgcccggcgccgcccccagcgtggtgctgaccgtgggcctgagcgccatcagaatcaagaagcccatcaagaccaagttcagactgcccgtgttcaactggaccgccctgaagcccaaccagatcagcggcaccgtgttcagcgagctggacgacgagaagatcctggaggacctggacctggacaagttcgaggagctgttcaagaccaaggcccagggccccgccctggacctgatctgcagcaagaacaagaccgcccagaaggccgccagcaaggtgaccctgctggaggccaacagagccaagaacctggccatcaccctgagaaaggccggcagaagcgccgaggagatctgcagagccatccacaccttcgacctgcagaccctgcccgtggacttcgtggagtgcctgatgagattcctgcccaccgaggccgaggtgaagctgctgagacagtacgagagagagagacagcccctggaggagctggccgccgaggacagattcatgctgctgttcagcaaggtggagagactgacccagagaatggccggcatggccttcctgggcaacttccaggacaacctgcagatgctgaccccccagctgaacgccatcatcgccgccagcgccagcgtgaagagcagccagaagctgaagcagatgctggagatcatcctggccctgggcaactacatgaacagcagcaagagaggcgccgtgtacggcttcaagctgcagagcctggacctgctgctggacaccaagagcaccgacagaaagatgaccctgctgcacttcatcgccctgaccgtgaaggagaagtaccccgacctggccaacttctggcacgagctgcacttcgtggagaaggccgccgccgtgagcctggagaacgtgctgctggacgtgaaggagctgggcagaggcatggagctgatcagaagagagtgcagcatccacgacaacagcgtgctgagaaacttcctgagcaccaacgagggcaagctggacaagctgcagagagacgccaagaccgccgaggaggcctacaacgccgtggtgagatacttcggcgagagccccaagaccaccccccccagcgtgttcttccccgtgttcgtgagattcatcagaagctacaaggaggccgagcaggagaacgaggccagaaagaagcaggaggaggtgatgagagagaagcagctggcccaggaggccaagaagctggacgccaagacccccagccagagaaacaagtggcagcagcaggagctgatcgccgagctgagaagaagacaggccaaggagcacagacccgtgtacgagggcaaggacggcaccatcgaggacatcatcaccggcctgcactgccagcccatggtggtgagacaccaggccagaagcgccgccccccccagcggcccccccagagcccccggcccccactag

SEQ ID NO: 21425 - DNA, 3084 bp, Artificial Sequence
  Description of Artificial Sequence: Synthetic coding sequence
atgggcaacctggagagcgccgagggcgtgcccggcgagccccccagcgtgcccctgctgctgccccccggcaagatgcccatgcccgagccctgcgagctggaggagagattcgccctggtgctgagcagcatgaacctgccccccgacaaggccagactgctgagacagtacgacaacgagaagaagtgggacctgatctgcgaccaggagagattccaggtgaagaaccccccccacacctacatccagaagctgcagagcttcctggaccccagcgtgaccagaaagaagttcagaagaagagtgcaggagagcaccaaggtgctgagagagctggagatcagcctgagaaccaaccacatcggctgggtgagagagttcctgaacgacgagaacaagggcctggacgtgctggtggactacctgagcttcgcccagtgcagcgtgatgttcgacttcgagggcctggagagcggcgacgacggcgccttcgacaagctgagaagctggagcagaagcatcgaggacctgcagccccccagcgccctgagcgcccccttcaccaacagcctggccagaagcgccagacagagcgtgctgagatacagcaccctgcccggcagaagagccctgaagaacagcagactggtgagccagaaggacgacgtgcacgtgtgcatcctgtgcctgagagccatcatgaactaccagtacggcttcaacctggtgatgagccacccccacgccgtgaacgagatcgccctgagcctgaacaacaagaaccccagaaccaaggccctggtgctggagctgctggccgccgtgtgcctggtgagaggcggccacgagatcatcctggccgccttcgacaacttcaaggaggtgtgcaaggagctgcacagattcgagaagctgatggagtacttcagaaacgaggacagcaacatcgacttcatggtggcctgcatgcagttcatcaacatcgtggtgcacagcgtggaggacatgaacttcagagtgcacctgcagtacgagttcaccaagctgggcctggaggagttcctgcagaagagcagacacaccgagagcgagaagctgcaggtgcagatccaggcctacctggacaacgtgttcgacgtgggcggcctgctggaggacgccgagaccaagaacgtggccctggagaaggtggaggagctggaggagcacgtgagccacctgaccgagaagctgctggacctggagaacgagaacatgatgagagtggccgagctggagaagcagctgctgcagagagagaaggagctggagagcatcaaggagacctacgagaacaccagccaccaggtgcacaccctgagaagactgatcaaggagaaggaggaggccttccagagaagatgccacctggagcccaacgtgagaggcctggagagcgtggacagcgaggccctggccagagtgggccccgccgagctgagcgagggcatgccccccagcgacctggacctgctggcccccgcccccccccccgaggaggtgctgcccctgccccccccccccgccccccccctgccccccccccccccccccctgcccgacaagtgcccccccgccccccccctgcccggcgccgcccccagcgtggtgctgaccgtgggcctgagcgccatcagaatcaagaagcccatcaagaccaagttcagactgcccgtgttcaactggaccgccctgaagcccaaccagatcagcggcaccgtgttcagcgagctggacgacgagaagatcctggaggacctggacctggacaagttcgaggagctgttcaagaccaaggcccagggccccgccctggacctgatctgcagcaagaacaagaccgcccagaaggccgccagcaaggtgaccctgctggaggccaacagagccaagaacctggccatcaccctgagaaaggccggcagaagcgccgaggagatctgcagagccatccacaccttcgacctgcagaccctgcccgtggacttcgtggagtgcctgatgagattcctgcccaccgaggccgaggtgaagctgctgagacagtacgagagagagagacagcccctggaggagctggccgccgaggacagattcatgctgctgttcagcaaggtggagagactgacccagagaatggccggcatggccttcctgggcaacttccaggacaacctgcagatgctgaccccccagctgaacgccatcatcgccgccagcgccagcgtgaagagcagccagaagctgaagcagatgctggagatcatcctggccctgggcaactacatgaacagcagcaagagaggcgccgtgtacggcttcaagctgcagagcctggacctgctgctggacaccaagagcaccgacagaaagatgaccctgctgcacttcatcgccctgaccgtgaaggagaagtaccccgacctggccaacttctggcacgagctgcacttcgtggagaaggccgccgccgtgagcctggagaacgtgctgctggacgtgaaggagctgggcagaggcatggagctgatcagaagagagtgcagcatccacgacaacagcgtgctgagaaacttcctgagcaccaacgagggcaagctggacaagctgcagagagacgccaagaccgccgaggcctacaacgccgtggtgagatacttcggcgagagccccaagaccaccccccccagcgtgttcttccccgtgttcgtgagattcatcagaagctacaaggaggccgagcaggagaacgaggccagaaagaagcaggaggaggtgatgagagagaagcagctggcccaggaggccaagaagctggacgccaagacccccagccagagaaacaagtggcagcagcaggagctgatcgccgagctgagaagaagacaggccaaggagcacagacccgtgtacgagggcaaggacggcaccatcgaggacatcatcaccgtgctgaagagcgtgcccttcaccgccagaaccgccaagagaggcagcagattcttctgcgacgccgcccaccacgacgagagcaactgctag

SEQ ID NO: 21426 - DNA, 1227 bp, Artificial Sequence
  Description of Artificial Sequence: Synthetic coding sequence
atgagcaagagagacatcgtgctgaccaacgtgaccgtggtgcagctgctgagacagccctgccccgtgaccagagccccccccccccccgagcccaaggccgaggtggagccccagccccagcccgagcccacccccgtgagagaggagatcaagcccccccccccccccctgcccccccaccccgccacccccccccccaagatggtgagcgtggccagagagctgaccgtgggcatcaacggcttcggcagaatcggcagactggtgctgagagcctgcatggagaagggcgtgaaggtggtggccgtgaacgaccccttcatcgaccccgagtacatggtgtacatgttcaagtacgacagcacccacggcagatacaagggcagcgtggagttcagaaacggccagctggtggtggacaaccacgagatcagcgtgtaccagtgcaaggagcccaagcagatcccctggagagccgtgggcagcccctacgtggtggagagcaccggcgtgtacctgagcatccaggccgccagcgaccacatcagcgccggcgcccagagagtggtgatcagcgcccccagccccgacgcccccatgttcgtgatgggcgtgaacgagaacgactacaaccccggcagcatgaacatcgtgagcaacgccagctgcaccaccaactgcctggcccccctggccaaggtgatccacgagagattcggcatcgtggagggcctgatgaccaccgtgcacagctacaccgccacccagaagaccgtggacggccccagcagaaaggcctggagagacggcagaggcgcccaccagaacatcatccccgccagcaccggcgccgccaaggccgtgaccaaggtgatccccgagctgaagggcaagctgaccggcatggccttcagagtgcccacccccgacgtgagcgtggtggacctgacctgcagactggcccagcccgccccctacagcgccatcaaggaggccgtgaaggccgccgccaagggccccatggccggcatcctggcctacaccgaggacgaggtggtgagcaccgacttcctgggcgacacccacagcagcatcttcgacgccaaggccggcatcgccctgaacgacaacttcgtgaagctgatcagctggtacgacaacgagtacggctacagccacagagtggtggacctgctgagatacatgttcagcagagacaagtag

SEQ ID NO: 21427 - DNA, 2811 bp, Artificial Sequence
  Description of Artificial Sequence: Synthetic coding sequence
atggccgccgccagagacccccccgaggtgagcctgagagaggccacccagagaaagctgagaagattcagcgagctgagaggcaagctggtggccagaggcgagttctgggacatcgtggccatcaccgccgccgacgagaagcaggagctggcctacaaccagcagctgagcgagaagctgaagagaaaggagctgcccctgggcgtgcagtaccacgtgttcgtggaccccgccggcgccaagatcggcaacggcggcagcaccctgtgcgccctgcagtgcctggagaagctgtacggcgacaagtggaacagcttcaccatcctgctgatccacagcgacgagtggaagaagaaggtgagcgagagctacgtgatcaccatcgagagactggaggacgacctgcagatcaaggagaaggagctgaccgagctgagaaacatcttcggcagcgacgaggccttcagcaaggtgaacctgaactacagaaccgagaacggcctgagcctgctgcacctgtgctgcatctgcggcggcaagaagagccacatcagaaccctgatgctgaagggcctgagacccagcagactgaccagaaacggcttcaccgccctgcacctggccgtgtacaaggacaacgccgagctgatcaccagcctgctgcacagcggcgccgacatccagcaggtgggctacggcggcctgaccgccctgcacatcgccaccatcgccggccacctggaggccgccgacgtgctgctgcagcacggcgccaacgtgaacatccaggacgccgtgttcttcacccccctgcacatcgccgcctactacggccacgagcaggtgaccagactgctgctgaagttcggcgccgacgtgaacgtgagcggcgaggtgggcgacagacccctgcacctggccagcgccaagggcttcctgaacatcgccaagctgctgatggaggagggcagcaaggccgacgtgaacgcccaggacaacgaggaccacgtgcccctgcacttctgcagcagattcggccaccacgacatcgtgaagtacctgctgcagagcgacctggaggtgcagccccacgtggtgaacatctacggcgacacccccctgcacctggcctgctacaacggcaagttcgaggtggccaaggagatcatccagatcagcggcaccgagagcctgaccaaggagaacatcttcagcgagaccgccttccacagcgcctgcacctacggcaagagcatcgacctggtgaagttcctgctggaccagaacgtgatcaacatcaaccaccagggcagagacggccacaccggcctgcacagcgcctgctaccacggccacatcagactggtgcagttcctgctggacaacggcgccgacatgaacctggtggcctgcgaccccagcagaagcagcggcgagaaggacgagcagacctgcctgatgtgggcctacgagaagggccacgacgccatcgtgaccctgctgaagcactacaagagaccccaggacgagctgccctgcaacgagtacagccagcccggcggcgacggcagctacgtgagcgtgcccagccccctgggcaagatcaagagcatgaccaaggagaaggccgacatcctgctgctgagagccggcctgcccagccacttccacctgcagctgagcgagatcgagttccacgagatcatcggcagcggcagcttcggcaaggtgtacaagggcagatgcagaaacaagatcgtggccatcaagagatacagagccaacacctactgcagcaagagcgacgtggacatgttctgcagagaggtgagcatcctgtgccagctgaaccacccctgcgtgatccagttcgtgggcgcctgcctgaacgaccccagccagttcgccatcgtgacccagtacatcagcggcggcagcctgttcagcctgctgcacgagcagaagagaatcctggacctgcagagcaagctgatcatcgccgtggacgtggccaagggcatggagtacctgcacaacctgacccagcccatcatccacagagacctgaacagccacaacatcctgctgtacgaggacggccacgccgtggtggccgacttcggcgagagcagattcctgcagagcctggacgaggacaacatgaccaagcagcccggcaacctgagatggatggcccccgaggtgttcacccagtgcaccagatacaccatcaaggccgacgtgttcagctacgccctgtgcctgtgggagatcctgaccggcgagatccccttcgcccacctgaagcccgccgccgccgccgccgacatggcctaccaccacatcagaccccccatcggctacagcatccccaagcccatcagcagcctgctgatcagaggctggaacgcctgccccgagggcagacccgagttcagcgaggtggtgatgaagctggaggagtgcctgtgcaacatcgagctgatgagccccgccagcagcaacagcagcggcagcctgagccccagcagcagcagcgactgcctggtgaacagaggcggccccggcagaagccacgtggccgccctgagaagcagattcgagctggagtacgccctgaacgccagaagctacgccgccctgagccagagcgccggccagtacagcagccagggcctgagcctggaggagatgaagagaagcctgcagtacacccccatcgacaagtacggctacgtgagcgaccccatgagcagcatgcacttccacagctgcagaaacagcagcagcttcgaggacagcagctag

SEQ ID NO: 21428 - DNA, 2532 bp, Artificial Sequence
  Description of Artificial Sequence: Synthetic coding sequence
atggccgccgccagagacccccccgaggtgagcctgagagaggccacccagagaaagctgagaagattcagcgagctgagaggcaagctggtggccagaggcgagttctgggacatcgtggccatcaccgccgccgacgagaagcaggagctggcctacaaccagcagctgagcgagaagctgaagagaaaggagctgcccctgggcgtgcagtaccacgtgttcgtggaccccgccggcgccaagatcggcaacggcggcagcaccctgtgcgccctgcagtgcctggagaagctgtacggcgacaagtggaacagcttcaccatcctgctgatccacagcgacgagtggaagaagaaggtgagcgagagctacgtgatcaccatcgagagactggaggacgacctgcagatcaaggagaaggagctgaccgagctgagaaacatcttcggcagcgacgaggccttcagcaaggtgaacctgaactacagaaccgagaacggcctgagcctgctgcacctgtgctgcatctgcggcggcaagaagagccacatcagaaccctgatgctgaagggcctgagacccagcagactgaccagaaacggcttcaccgccctgcacctggccgtgtacaaggacaacgccgagctgatcaccagcctgctgcacagcggcgccgacatccagcaggtgggctacggcggcctgaccgccctgcacatcgccaccatcgccggccacctggaggccgccgacgtgctgctgcagcacggcgccaacgtgaacatccaggacgccgtgttcttcacccccctgcacatcgccgcctactacggccacgagcaggtgaccagactgctgctgaagttcggcgccgacgtgaacgtgagcggcgaggtgggcgacagacccctgcacctggccagcgccaagggcttcctgaacatcgccaagctgctgatggaggagggcagcaaggccgacgtgaacgcccaggacaacgaggaccacgtgcccctgcacttctgcagcagattcggccaccacgacatcgtgaagtacctgctgcagagcgacctggaggtgcagccccacgtggtgaacatctacggcgacacccccctgcacctggcctgctacaacggcaagttcgaggtggccaaggagatcatccagatcagcggcaccgagagcctgaccaaggagaacatcttcagcgagaccgccttccacagcgcctgcacctacggcaagagcatcgacctggtgaagttcctgctggaccagaacgtgatcaacatcaaccaccagggcagagacggccacaccggcctgcacagcgcctgctaccacggccacatcagactggtgcagttcctgctggacaacggcgccgacatgaacctggtggcctgcgaccccagcagaagcagcggcgagaaggacgagcagacctgcctgatgtgggcctacgagaagggccacgacgccatcgtgaccctgctgaagcactacaagagaccccaggacgagctgccctgcaacgagtacagccagcccggcggcgacggcagctacgtgagcgtgcccagccccctgggcaagatcaagagcatgaccaaggagaaggccgacatcctgctgctgagagccggcctgcccagccacttccacctgcagctgagcgagatcgagttccacgagatcatcggcagcggcagcttcggcaaggtgtacaagggcagatgcagaaacaagatcgtggccatcaagagatacagagccaacacctactgcagcaagagcgacgtggacatgttctgcagagaggtgagcatcctgtgccagctgaaccacccctgcgtgatccagttcgtgggcgcctgcctgaacgaccccagccagttcgccatcgtgacccagtacatcagcggcggcagcctgttcagcctgctgcacgagcagaagagaatcctggacctgcagagcaagctgatcatcgccgtggacgtggccaagggcatggagtacctgcacaacctgacccagcccatcatccacagagacctgaacagccacaacatcctgctgtacgaggacggccacgccgtggtggccgacttcggcgagagcagattcctgcagagcctggacgaggacaacatgaccaagcagcccggcaacctgagatggatggcccccgaggtgttcacccagtgcaccagatacaccatcaaggccgacgtgttcagctacgccctgtgcctgtgggagatcctgaccggcgagatccccttcgcccacctgaagcccgccgccgccgccgccgacatggcctaccaccacatcagaccccccatcggctacagcatccccaagcccatcagcagcctgctgatcagaggctggaacgcctgccccgaggccaagagcagacccagccactaccccgtgagcagcgtgtacaccgagaccctgaagaagaagaacgaggacagattcggcatgtggatcgagtacctgagaagatag

SEQ ID NO: 21429 - DNA, 444 bp, Artificial Sequence
  Description of Artificial Sequence: Synthetic coding sequence
atgagcttcagattcggccagcacctgatcaagcccagcgtggtgttcctgaagaccgagctgagcttcgccctggtgaacagaaagcccgtggtgcccggccacgtgctggtgtgccccctgagacccgtggagagattccacgacctgagacccgacgaggtggccgacctgttccagaccacccagagagtgggcaccgtggtggagaagcacttccacggcaccagcctgaccttcagcatgcaggacggccccgaggccggccagaccgtgaagcacgtgcacgtgcacgtgctgcccagaaaggccggcgacttccacagaaacgacagcatctacgaggagctgcagaagcacgacaaggaggacttccccgccagctggagaagcgaggaggagatggccgccgaggccgccgccctgagagtgtacttccagtag

SEQ ID NO: 21430 - DNA, 930 bp, Artificial Sequence
  Description of Artificial Sequence: Synthetic coding sequence
atggagcagctgctgagagccgagctgagaaccgccaccctgagagccttcggcggccccggcgccggctgcatcagcgagggcagagcctacgacaccgacgccggccccgtgttcgtgaaggtgaacagaagaacccaggccagacagatgttcgagggcgaggtggccagcctggaggccctgagaagcaccggcctggtgagagtgcccagacccatgaaggtgatcgacctgcccggcggcggcgccgccttcgtgatggagcacctgaagatgaagagcctgagcagccaggccagcaagctgggcgagcagatggccgacctgcacctgtacaaccagaagctgagagagaagctgaaggaggaggagaacaccgtgggcagaagaggcgagggcgccgagccccagtacgtggacaagttcggcttccacaccgtgacctgctgcggcttcatcccccaggtgaacgagtggcaggacgactggcccaccttcttcgccagacacagactgcaggcccagctggacctgatcgagaaggactacgccgacagagaggccagagagctgtggagcagactgcaggtgaagatccccgacctgttctgcggcctggagatcgtgcccgccctgctgcacggcgacctgtggagcggcaacgtggccgaggacgacgtgggccccatcatctacgaccccgccagcttctacggccacagcgagttcgagctggccatcgccctgatgttcggcggcttccccagaagcttcttcaccgcctaccacagaaagatccccaaggcccccggcttcgaccagagactgctgctgtaccagctgttcaactacctgaaccactggaaccacttcggcagagagtacagaagccccagcctgggcaccatgagaagactgctgaagtag

SEQ ID NO: 21431 - DNA, 609 bp, Artificial Sequence
  Description of Artificial Sequence: Synthetic coding sequence
atggagcagctgctgagagccgagctgagaaccgccaccctgagagccttcggcggccccggcgccggctgcatcagcgagggcagagcctacgacaccgacgccggccccgtgttcgtgaaggtgaacagaagaacccaggccagacagatgttcgagggcgaggtggccagcctggaggccctgagaagcaccggcctggtgagagtgcccagacccatgaaggtgatcgacctgcccggcggcggcgccgccttcgtgatggagcacctgaagatgaagagcctgagcagccaggccagcaagctgggcgagcagatggccgacctgcacctgtacaaccagaagctgagagagaagctgaaggaggaggagaacaccgtgggcagaagaggcgagggcgccgagccccagtacgtggacaagttcggcttccacaccgtgacctgctgcggcttcatcccccaggagcccctggagcccagcagcctgaagagcgtgaagttccagagaagactgtggaccgcccagctgccctgcgccagcctggaggaggccaacatcggcccctacttcggcttcgtgagaaacaccgcccccatcatctag

SEQ ID NO: 21432 - DNA, 534 bp, Artificial Sequence
  Description of Artificial Sequence: Synthetic coding sequence
atgcaggccagacagatgttcgagggcgaggtggccagcctggaggccctgagaagcaccggcctggtgagagtgcccagacccatgaaggtgatcgacctgcccggcggcggcgccgccttcgtgatggagcacctgaagatgaagagcctgagcagccaggccagcaagctgggcgagcagatggccgacctgcacctgtacaaccagaagctgagagagaagctgaaggaggaggagaacaccgtgggcagaagaggcgagggcgccgagccccagtacgtggacaagttcggcttccacaccgtgacctgctgcggcttcatcccccaggtgaacgagtggcaggacgactggcccaccttcttcgccagacacagactgcaggcccagctggacctgatcgagaaggactacgccgacagagaggccagagagctgtggagcagactgcaggtgggcaccgccgtgaccagcctgggcaagagctggagcagccacgaccccgccgccttcgtgagagtgcacctgtag

SEQ ID NO: 21433 - DNA, 1212 bp, Artificial Sequence
  Description of Artificial Sequence: Synthetic coding sequence
atgcccgagcccctggcccccgagagctaccccgagagcgtgtgcgaggaggacgtgaccctggccctgaaggagctggacgagagatgcgaggaggaggaggccgacttcagcggcctgagcagccaggacgaggaggagcaggacggcttccccgaggtgcagaccagccccctgcccagccccttcctgagcgccatcatcgccgccttccagcccgtggcctacgacgacgaggaggaggcctggagatgccacgtgaaccagatgctgagcgacaccgacggcagcagcgccgtgttcaccttccacgtgttcagcagactgttccagaccatccagagaaagttcggcgagatcaccaacgaggccgtgagcttcctgggcgacagcctgcagagaatcggcaccaagttcaagagcagcctggaggtgatgatgctgtgcagcgagtgccccaccgtgttcgtggacgccgagaccctgatgagctgcggcctgctggagaccctgaagttcggcgtgctggagctgcaggagcacctggacacctacaacgtgaagagagaggccgccgagcagtggctggacgactgcaagagaaccttcggcgccaaggaggacatgtacagaatcaacaccgacgcccaggagctggagctgtgcagaagactgtacaagctgcacttccagctgctgctgctgttccaggcctactgcaagctgatcaaccaggtgaacaccatcaagaacgaggccgaggtgatcaacatgagcgaggagctggcccagctggagagcatcctgaaggaggccgagagcgccagcgagaacgaggagatcgacatcagcaaggccgcccagaccaccatcgagaccgccatccacagcctgatcgagaccctgaagaacaaggagttcatcagcgccgtggcccaggtgaaggccttcagaagcctgtggcccagcgacatcttcggcagctgcgaggacgaccccgtgcagaccctgctgcacatctacttccaccaccagaccctgggccagaccggcagcttcgccgtgatcggcagcaacctggacatgagcgaggccaactacaagctgatggagctgaacctggagatcagagagagcctgagaatggtgcagagctaccagctgctggcccaggccaagcccatgggcaacatggtgagcaccggcttctag

SEQ ID NO: 21434 - DNA, 9042 bp, Artificial Sequence
  Description of Artificial Sequence: Synthetic coding sequence
atgagcaacatcaccatcgaccccgacgtgaagcccggcgagtacgtgatcaagagcctgttcgccgagttcgccgtgcaggccgagaagaagatcgaggtggtgatggccgagcccctggagaagctgctgagcagaagcctgcagagaggcgaggacctgcagttcgaccagctgatcagcagcatgagcagcgtggccgagcactgcctgcccagcctgctgagaaccctgttcgactggtacagaagacagaacggcaccgaggacgagagctacgagtacagacccagaagcagcaccaagagcaagggcgacgagcagcagagagagagagactacctgctggagagaagagacctggccgtggacttcatcttctgcctggtgctggtggaggtgctgaagcagatccccgtgcaccccgtgcccgaccccctggtgcacgaggtgctgaacctggccttcaagcacttcaagcacaaggagggctacagcggcaccaacaccggcaacgtgcacatcatcgccgacctgtacgccgaggtgatcggcgtgctggcccagagcaagttccaggccgtgagaaagaagttcgtgaccgagctgaaggagctgagacagaaggagcagagcccccacgtggtgcagagcgtgatcagcctgatcatgggcatgaagttcttcagagtgaagatgtaccccgtggaggacttcgaggccagcttccagttcatgcaggagtgcgcccagtacttcctggaggtgaaggacaaggacatcaagcacgccctggccggcctgttcgtggagatcctgatccccgtggccgccgccgtgaagaacgaggtgaacgtgccctgcctgaagaacttcgtggagatgctgtaccagaccaccttcgagctgagcagcagaaagaagcacagcctggccctgtaccccctgatcacctgcctgctgtgcgtgagccagaagcagttcttcctgaacaactggcacatcttcctgcagaactgcctgagccacctgaagaacaaggaccccaagatgagcagagtggccctggagagcctgtacagactgctgtgggtgtacgtgatcagaatcaagtgcgagagcaacaccgtgacccagagcagactgatgagcatcgtgagcgccctgttccccaagggcagcagaagcgtggtgcccagagacacccccctgaacatcttcgtgaagatcatccagttcatcgcccaggagagactggacttcgccatgaaggagatcatcttcgacctgctgagcgtgggcaagagcaccaagaccttcaccatcaaccccgagagaatgaacatcggcctgagagtgttcctggtgatcgccgacagcctgcagcagaaggacggcgagccccccatgcccaccaccggcgtgatcctgcccagcggcaacaccctgagagtgaagaagatcttcctgaacaagaccctgaccgacgaggaggccaaggtgatcggcatgagcgtgtactacccccaggtgagaaaggccctggacagcatcctgagacacctggacaaggaggtgggcagacccatgtgcatgaccagcgtgcagatgagcaacaaggagcccgaggacatgatcaccggcgagagaaagcccaagatcgacctgttcagaacctgcatcgccgccatccccagactgatccccgacggcatgagcagaaccgacctgatcgagctgctggccagactgaccatccacatggacgaggagctgagagccctggccttcaacaccctgcaggccctgatgctggacttccccgactggagagaggacgtgctgagcggcttcgtgtacttcatcgtgagagaggtgaccgacgtgcaccccaccctgctggacaacgccgtgaagatgctggtgcagctgatcaaccagtggaagcaggccgcccagatgcacaacaagaaccaggacacccagcacggcgtggccaacggcgccagccaccccccccccctggagagaagcccctacagcaacgtgttccacgtggtggagggcttcgccctggtgatcctgtgcagcagcagacccgccaccagaagactggccgtgagcgtgctgagagagatcagagccctgttcgccctgctggagatccccaagggcgacgacgagctggccatcgacgtgatggacagactgagccccagcatcctggagagcttcatccacctgaccggcgccgaccagaccaccctgctgtactgccccagcagcatcgacctgcagaccctggccgagtggaacagcagccccatcagccaccagttcgacgtgatcagccccagccacatctggatcttcgcccacgtgacccagggccaggacccctggatcatcagcctgagcagcttcctgaagcaggagaacctgcccaagcactgcagcaccgccgtgagctacgcctggatgttcgcctacaccagactgcagctgctgagcccccaggtggacatcaacagccccatcaacgccaagaaggtgaacaccaccaccagcagcgacagctacatcggcctgtggagaaactacctgatcctgtgctgcagcgccgccaccagcagcagcagcaccagcgccggcagcgtgagatgcagcccccccgagaccctggccagcacccccgacagcggctacagcatcgacagcaagatcatcggcatccccagccccagcagcctgttcaagcacatcgtgcccatgatgagaagcgagagcatggagatcaccgagagcctggtgctgggcctgggcagaaccaaccccggcgccttcagagagctgatcgaggagctgcaccccatcatcaaggaggccctggagagaagacccgagaacatgaagagaagaagaagaagagacatcctgagagtgcagctggtgagaatcttcgagctgctggccgacgccggcgtgatcagccacagcgccagcggcggcctggacaacgagacccacttcctgaacaacaccctgctggagtacgtggacctgaccagacagctgctggaggccgagaacgagaaggacagcgacaccctgaaggacatcagatgccacttcagcgccctggtggccaacatcatccagaacgtgcccgtgcaccagagaagaagcatcttcccccagcagagcctgagacacagcctgttcatgctgttcagccactgggccggccccttcagcatcatgttcacccccctggacagatacagcgacagaaacatgcagatcaacagacaccagtactgcgccctgaaggccatgagcgccgtgctgtgctgcggccccgtggccgacaacgtgggcctgagcagcgacggctacctgtacaagtggctggacaacatcctggacagcctggacaagaaggtgcaccagctgggctgcgaggccgtgaccctgctgctggagctgaaccccgaccagagcaacctgatgtactgggccgtggacagatgctacaccggcagcggcagagtggccgccggctgcttcaaggccatcgccaacgtgttccagaacagagactaccagtgcgacaccgtgatgctgctgaacctgatcctgttcaaggccgccgacagcagcagaagcatctacgaggtggccatgcagctgctgcagatcctggagcccaagatgttcagatacgcccacaagctggaggtgcagagaaccgacggcgtgctgagccagctgagccccctgccccacctgtacagcgtgagctactaccagctgagcgaggagctggccagagcctaccccgagctgaccctggccatcttcagcgagatcagccagagaatccagaccgcccaccccgccggcagacaggtgatgctgcactacctgctgccctggatgaacaacatcgagctggtggacctgaagcccctgcccaccgccagaagacacgacgaggacgaggacgacagcctgaaggacagagagctgatggtgaccagcagaagatggctgagaggcgagggctggggcagcccccaggccaccgccatggtgctgaacaacctgatgtacatgaccgccaagtacggcgacgagctggcctggagcgaggtggagaacgtgtggaccaccctggccgacggctggcccaagaacctgaagatcatcctgcacttcctgatcagcatctgcggcgtgaacagcgagcccagcctgctgccctacgtgaagaaggtgatcgtgtacctgggcagagacaagaccatgcagctgctggaggagctggtgagcgagctgcagctgaccgaccccgtgagcagcggcgtgacccacatggacaaccccccctactacagaatcaccagcagctacaagatccccagcgtgaccagcggcaccaccagcagcagcaacaccatggtggcccccaccgacggcaaccccgacaacaagcccatcaaggagaacatcgaggagagctacgtgcacctggacatctacagcggcctgaacagccacctgaacagacagcaccacagactggagagcagatacagcagcagcagcggcggcagctacgaggaggagaagagcgacagcatgcccctgtacagcaactggagactgaaggtgatggagcacaaccagggcgagcccctgcccttcccccccgccggcggctgctggagccccctggtggactacgtgcccgagaccagcagccccggcctgcccctgcacagatgcaacatcgccgtgatcctgctgaccgacctgatcatcgaccacagcgtgaaggtggagtggggcagctacctgcacctgctgctgcacgccatcttcatcggcttcgaccactgccaccccgaggtgtacgagcactgcaagagactgctgctgcacctgctgatcgtgatgggccccaacagcaacatcagaaccgtggccagcgtgctgctgagaaacaaggagttcaacgagcccagagtgctgaccgtgaagcaggtggcccacctggactacaacttcaccgccggcatcaacgacttcatccccgactaccagcccagccccatgaccgacagcggcctgagcagcagcagcaccagcagcagcatcagcctgggcaacaacagcgccgccatcagccacctgcacaccaccatcctgaacgaggtggacatcagcgtggagcaggacggcaaggtgaagaccctgatggagttcatcaccagcagaaagagaggccccctgtggaaccacgaggacgtgagcgccaagaaccccagcatcaagagcgccgagcagctgaccaccttcctgaagcacgtggtgagcgtgttcaagcagagcagcagcgagggcatccacctggagcaccacctgagcgaggtggccctgcagaccgccctgagctgcagcagcagacactacgccggcagaagcttccagatcttcagagccctgaagcagcccctgaccgccaccaccctgagcgacgtgctgagcagactggtggagaccgtgggcgaccccggcgaggacgcccagggcttcgtgatcgagctgctgctgaccctggagagcgccatcgacaccctggccgagaccatgaagcactacgacctgctgagcgccctgagccagaccagctaccacgaccccatcatgggcaacaagtacgccgccaacagaaagagcaccggccagctgaacctgagcaccagccccatcaacagcagcagctacctgggctacaacagcaacgccagaagcaacagcctgagactgagcctgatcggcgacagaagaggcgacagaagaagaagcaacaccctggacatcatggacggcagaatcaaccacagcagcagcctggccagaaccagaagcctgagcagcctgagagagaagggcatgtacgacgtgcagagcaccaccgagcccaccaacctgatggccaccatcttctggatcgccgccagcctgctggagagcgactacgagtacgagtacctgctggccctgagactgctgaacaagctgctgatccacctgcccctggacaagagcgagagcagagagaagatcgagaacgtgcagagcaagctgaagtggaccaacttccccggcctgcagcagctgttcctgaagggcttcaccagcgccagcacccaggagatgaccgtgcacctgctgagcaagctgatcagcgtgagcaagcacaccctggtggaccccagccagctgagcggcttccccctgaacatcctgtgcctgctgccccacctgatccagcacttcgacagccccacccagttctgcaaggagaccgccagcagaatcgccaaggtgtgcgccgaggagaagtgccccaccctggtgaacctggcccacatgatgagcctgtacagcacccacacctacagcagagactgcagcaactggatcaacgtggtgtgcagatacctgcacgacagcttcagcgacaccaccttcaacctggtgacctacctggccgagctgctggagaagggcctgagcagcatgcagcagagcctgctgcagatcatctacagcctgctgagccacatcgacctgagcgccgcccccgccaagcagttcaacctggagatcatcaagatcatcggcaagtacgtgcagagcccctactggaaggaggccctgaacatcctgaagctggtggtgagcagaagcgccagcctggtggtgcccagcgacatccccaagacctacggcggcgacaccggcagccccgagatcagcttcaccaagatcttcaacaacgtgagcaaggagctgcccggcaagaccctggacttccacttcgacatcagcgagacccccatcatcggcaacaagtacggcgaccagcacagcgccgccggcagaaacggcaagcccaaggtgatcgccgtgaccagaagcaccagcagcaccagcagcggcagcaacagcaacgccctggtgcccgtgagctggaagagaccccagctgagccagagaagaaccagagagaagctgatgaacgtgctgagcctgtgcggccccgagagcggcctgcccaagaaccccagcgtggtgttcagcagcaacgaggacctggaggtgggcgaccagcagaccagcctgatcagcaccaccgaggacatcaaccaggaggaggaggtggccgtggaggacaacagcagcgagcagcagttcggcgtgttcaaggacttcgacttcctggacgtggagctggaggacgccgagggcgagagcatggacaacttcaactggggcgtgagaagaagaagcctggacagcatcgacaagggcgacacccccagcctgcaggagtaccagtgcagcagcagcacccccagcctgaacctgaccaaccaggaggacaccgacgagagcagcgaggaggaggccgccctgaccgccagccagatcctgagcagaacccagatgctgaacagcgacagcgccaccgacgagaccatccccgaccaccccgacctgctgctgcagagcgaggacagcaccggcagcatcaccaccgaggaggtgctgcagatcagagacgagacccccaccctggaggccagcctggacaacgccaacagcagactgcccgaggacaccaccagcgtgctgaaggaggagcacgtgaccaccttcgaggacgagggcagctacatcatccaggagcagcaggagagcctggtgtgccagggcatcctggacctggaggagaccgagatgcccgagcccctggcccccgagagctaccccgagagcgtgtgcgaggaggacgtgaccctggccctgaaggagctggacgagagatgcgaggaggaggaggccgacttcagcggcctgagcagccaggacgaggaggagcaggacggcttccccgaggtgcagaccagccccctgcccagccccttcctgagcgccatcatcgccgccttccagcccgtggcctacgacgacgaggaggaggcctggagatgccacgtgaaccagatgctgagcgacaccgacggcagcagcgccgtgttcaccttccacgtgttcagcagactgttccagaccatccagagaaagttcggcgagatcaccaacgaggccgtgagcttcctgggcgacagcctgcagagaatcggcaccaagttcaagagcagcctggaggtgatgatgctgtgcagcgagtgccccaccgtgttcgtggacgccgagaccctgatgagctgcggcctgctggagaccctgaagttcggcgtgctggagctgcaggagcacctggacacctacaacgtgaagagagaggccgccgagcagtggctggacgactgcaagagaaccttcggcgccaaggaggacatgtacagaatcaacaccgacgcccagcagatggagatcctggccgagctggagctgtgcagaagactgtacaagctgcacttccagctgctgctgctgttccaggcctactgcaagctgatcaaccaggtgaacaccatcaagaacgaggccgaggtgatcaacatgagcgaggagctggcccagctggagagcatcctgaaggaggccgagagcgccagcgagaacgaggagatcgacatcagcaaggccgcccagaccaccatcgagaccgccatccacagcctgatcgagaccctgaagaacaaggagttcatcagcgccgtggcccaggtgaaggccttcagaagcctgtggcccagcgacatcttcggcagctgcgaggacgaccccgtgcagaccctgctgcacatctacttccaccaccagaccctgggccagaccggcagcttcgccgtgatcggcagcaacctggacatgagcgaggccaactacaagctgatggagctgaacctggagatcagagagagcctgagaatggtgcagagctaccagctgctggcccaggccaagcccatgggcaacatggtgagcaccggcttctag

SEQ ID NO: 21435 - DNA, 9042 bp, Artificial Sequence; identical to SEQ ID NO: 21434
  Description of Artificial Sequence: Synthetic coding sequence

SEQ ID NO: 21436 - DNA, 1212 bp, Artificial Sequence; identical to SEQ ID NO: 21433
  Description of Artificial Sequence: Synthetic coding sequence

SEQ ID NO: 21437 - DNA, 9042 bp, Artificial Sequence
  Description of Artificial Sequence: Synthetic coding sequence
atgagcaacatcaccatcgaccccgacgtgaagcccggcgagtacgtgatcaagagcctgttcgccgagttcgccgtgcaggccgagaagaagatcgaggtggtgatggccgagcccctggagaagctgctgagcagaagcctgcagagaggcgaggacctgcagttcgaccagctgatcagcagcatgagcagcgtggccgagcactgcctgcccagcctgctgagaaccctgttcgactggtacagaagacagaacggcaccgaggacgagagctacgagtacagacccagaagcagcaccaagagcaagggcgacgagcagcagagagagagagactacctgctggagagaagagacctggccgtggacttcatcttctgcctggtgctggtggaggtgctgaagcagatccccgtgcaccccgtgcccgaccccctggtgcacgaggtgctgaacctggccttcaagcacttcaagcacaaggagggctacagcggcaccaacaccggcaacgtgcacatcatcgccgacctgtacgccgaggtgatcggcgtgctggcccagagcaagttccaggccgtgagaaagaagttcgtgaccgagctgaaggagctgagacagaaggagcagagcccccacgtggtgcagagcgtgatcagcctgatcatgggcatgaagttcttcagagtgaagatgtaccccgtggaggacttcgaggccagcttccagttcatgcaggagtgcgcccagtacttcctggaggtgaaggacaaggacatcaagcacgccctggccggcctgttcgtggagatcctgatccccgtggccgccgccgtgaagaacgaggtgaacgtgccctgcctgaagaacttcgtggagatgctgtaccagaccaccttcgagctgagcagcagaaagaagcacagcctggccctgtaccccctgatcacctgcctgctgtgcgtgagccagaagcagttcttcctgaacaactggcacatcttcctgcagaactgcctgagccacctgaagaacaaggaccccaagatgagcagagtggccctggagagcctgtacagactgctgtgggtgtacgtgatcagaatcaagtgcgagagcaacaccgtgacccagagcagactgatgagcatcgtgagcgccctgttccccaagggcagcagaagcgtggtgcccagagacacccccctgaacatcttcgtgaagatcatccagttcatcgcccaggagagactggacttcgccatgaaggagatcatcttcgacctgctgagcgtgggcaagagcaccaagaccttcaccatcaaccccgagagaatgaacatcggcctgagagtgttcctggtgatcgccgacagcctgcagcagaaggacggcgagccccccatgcccaccaccggcgtgatcctgcccagcggcaacaccctgagagtgaagaagatcttcctgaacaagaccctgaccgacgaggaggccaaggtgatcggcatgagcgtgtactacccccaggtgagaaaggccctggacagcatcctgagacacctggacaaggaggtgggcagacccatgtgcatgaccagcgtgcagatgagcaacaaggagcccgaggacatgatcaccggcgagagaaagcccaagatcgacctgttcagaacctgcatcgccgccatccccagactgatccccgacggcatgagcagaaccgacctgatcgagctgctggccagactgaccatccacatggacgaggagctgagagccctggccttcaacaccctgcaggccctgatgctggacttccccgactggagagaggacgtgctgagcggcttcgtgtacttcatcgtgagagaggtgaccgacgtgcaccccaccctgctggacaacgccgtgaagatgctggtgcagctgatcaaccagtggaagcaggccgcccagatgcacaacaagaaccaggacacccagcacggcgtggccaacggcgccagccaccccccccccctggagagaagcccctacagcaacgtgttccacgtggtggagggcttcgccctggtgatcctgtgcagcagcagacccgccaccagaagactggccgtgagcgtgctgagagagatcagagccctgttcgccctgctggagatccccaagggcgacgacgagctggccatcgacgtgatggacagactgagccccagcatcctggagagcttcatccacctgaccggcgccgaccagaccaccctgctgtactgccccagcagcatcgacctgcagaccctggccgagtggaacagcagccccatcagccaccagttcgacgtgatcagccccagccacatctggatcttcgcccacgtgacccagggccaggacccctggatcatcagcctgagcagcttcctgaagcaggagaacctgcccaagcactgcagcaccgccgtgagctacgcctggatgttcgcctacaccagactgcagctgctgagcccccaggtggacatcaacagccccatcaacgccaagaaggtgaacaccaccaccagcagcgacagctacatcggcctgtggagaaactacctgatcctgtgctgcagcgccgccaccagcagcagcagcaccagcgccggcagcgtgagatgcagcccccccgagaccctggccagcacccccgacagcggctacagcatcgacagcaagatcatcggcatccccagccccagcagcctgttcaagcacatcgtgcccatgatgagaagcgagagcatggagatcaccgagagcctggtgctgggcctgggcagaaccaaccccggcgccttcagagagctgatcgaggagctgcaccccatcatcaaggaggccctggagagaagacccgagaacatgaagagaagaagaagaagagacatcctgagagtgcagctggtgagaatcttcgagctgctggccgacgccggcgtgatcagccacagcgccagcggcggcctggacaacgagacccacttcctgaacaacaccctgctggagtacgtggacctgaccagacagctgctggaggccgagaacgagaaggacagcgacaccctgaaggacatcagatgccacttcagcgccctggtggccaacatcatccagaacgtgcccgtgcaccagagaagaagcatcttcccccagcagagcctgagacacagcctgttcatgctgttcagccactgggccggccccttcagcatcatgttcacccccctggacagatacagcgacagaaacatgcagatcaacagacaccagtactgcgccctgaaggccatgagcgccgtgctgtgctgcggccccgtggccgacaacgtgggcctgagcagcgacggctacctgtacaagtggctggacaacatcctggacagcctggacaagaaggtgcaccagctgggctgcgaggccgtgaccctgctgctggagctgaaccccgaccagagcaacctgatgtactgggccgtggacagatgctacaccggcagcggcagagtggccgccggctgcttcaaggccatcgccaacgtgttccagaacagagactaccagtgcgacaccgtgatgctgctgaacctgatcctgttcaaggccgccgacagcagcagaagcatctacgaggtggccatgcagctgctgcagatcctggagcccaagatgttcagatacgcccacaagctggaggtgcagagaaccgacggcgtgctgagccagctgagccccctgccccacctgtacagcgtgagctactaccagctgagcgaggagctggccagagcctaccccgagctgaccctggccatcttcagcgagatcagccagagaatccagaccgcccaccccgccggcagacaggtgatgctgcactacctgctgccctggatgaacaacatcgagctggtggacctgaagcccctgcccaccgccagaagacacgacgaggacgaggacgacagcctgaaggacagagagctgatggtgaccagcagaagatggctgagaggcgagggctggggcagcccccaggccaccgccatggtgctgaacaacctgatgtacatgaccgccaagtacggcgacgagctggcctggagcgaggtggagaacgtgtggaccaccctggccgacggctggcccaagaacctgaagatcatcctgcacttcctgatcagcatctgcggcgtgaacagcgagcccagcctgctgccctacgtgaagaaggtgatcgtgtacctgggcagagacaagaccatgcagctgctggaggagctggtgagcgagctgcagctgaccgaccccgtgagcagcggcgtgacccacatggacaaccccccctactacagaatcaccagcagctacaagatccccagcgtgaccagcggcaccaccagcagcagcaacaccatggtggcccccaccgacggcaaccccgacaacaagcccatcaaggagaacatcgaggagagctacgtgcacctggacatctacagcggcctgaacagccacctgaacagacagcaccacagactggagagcagatacagcagcagcagcggcggcagctacgaggaggagaagagcgacagcatgcccctgtacagcaactggagactgaaggtgatggagcacaaccagggcgagcccctgcccttcccccccgccggcggctgctggagccccctggtggactacgtgcccgagaccagcagccccggcctgcccctgcacagatgcaacatcgccgtgatcctgctgaccgacctgatcatcgaccacagcgtgaaggtggagtggggcagctacctgcacctgctgctgcacgccatcttcatcggcttcgaccactgccaccccgaggtgtacgagcactgcaagagactgctgctgcacctgctgatcgtgatgggccccaacagcaacatcagaaccgtggccagcgtgctgctgagaaacaaggagttcaacgagcccagagtgctgaccgtgaagcaggtggcccacctggactacaacttcaccgccggcatcaacgacttcatccccgactaccagcccagccccatgaccgacagcggcctgagcagcagcagcaccagcagcagcatcagcctgggcaacaacagcgccgccatcagccacctgcacaccaccatcctgaacgaggtggacatcagcgtggagcaggacggcaaggtgaagaccctgatggagttcatcaccagcagaaagagaggccccctgtggaaccacgaggacgtgagcgccaagaaccccagcatcaagagcgccgagcagctgaccaccttcctgaagcacgtggtgagcgtgttcaagcagagcagcagcgagggcatccacctggagcaccacctgagcgaggtggccctgcagaccgccctgagctgcagcagcagacactacgccggcagaagcttccagatcttcagagccctgaagcagcccctgaccgccaccaccctgagcgacgtgctgagcagactggtggagaccgtgggcgaccccggcgaggacgcccagggcttcgtgatcgagctgctgctgaccctggagagcgccatcgacaccctggccgagaccatgaagcactacgacctgctgagcgccctgagccagaccagctaccacgaccccatcatgggcaacaagtacgccgccaacagaaagagcaccggccagctgaacctgagcaccagccccatcaacagcagcagctacctgggctacaacagcaacgccagaagcaacagcctgagactgagcctgatcggcgacagaagaggcgacagaagaagaagcaacaccctggacatcatggacggcagaatcaaccacagcagcagcctggccagaaccagaagcctgagcagcctgagagagaagggcatgtacgacgtgcagagcaccaccgagcccaccaacctgatggccaccatcttctggatcgccgccagcctgctggagagcgactacgagtacgagtacctgctggccctgagactgctgaacaagctgctgatccacctgcccctggacaagagcgagagcagagagaagatcgagaacgtgcagagcaagctgaagtggaccaacttccccggcctgcagcagctgttcctgaagggcttcaccagcgccagcacccaggagatgaccgtgcacctgctgagcaagctgatcagcgtgagcaagcacaccctggtggaccccagccagctgagcggcttccccctgaacatcctgtgcctgctgccccacctgatccagcacttcgacagccccacccagttctgcaaggagaccgccagcagaatcgccaaggtgtgcgccgaggagaagtgccccaccctggtgaacctggcccacatgatgagcctgtacagcacccacacctacagcagagactgcagcaactggatcaacgtggtgtgcagatacctgcacgacagcttcagcgacaccaccttcaacctggtgacctacctggccgagctgctggagaagggcctgagcagcatgcagcagagcctgctgcagatcatctacagcctgctgagccacatcgacctgagcgccgcccccgccaagcagttcaacctggagatcatcaagatcatcggcaagtacgtgcagagcccctactggaaggaggccctgaacatcctgaagctggtggtgagcagaagcgccagcctggtggtgcccagcgacatccccaagacctacggcggcgacaccggcagccccgagatcagcttcaccaagatcttcaacaacgtgagcaaggagctgcccggcaagaccctggacttccacttcgacatcagcgagacccccatcatcggcaacaagtacggcgaccagcacagcgccgccggcagaaacggcaagcccaaggtgatcgccgtgaccagaagcaccagcagcaccagcagcggcagcaacagcaacgccctggtgcccgtgagctggaagagaccccagctgagccagagaagaaccagagagaagctgatgaacgtgctgagcctgtgcggccccgagagcggcctgcccaagaaccccagcgtggtgttcagcagcaacgaggacctggaggtgggcgaccagcagaccagcctgatcagcaccaccgaggacatcaaccaggaggaggaggtggccgtggaggacaacagcagcgagcagcagttcggcgtgttcaaggacttcgacttcctggacgtggagctggaggacgccgagggcgagagcatggacaacttcaactggggcgtgagaagaagaagcctggacagcatcgacaagggcgacacccccagcctgcaggagtaccagtgcagcagcagcacccccagcctgaacctgaccaaccaggaggacaccgacgagagcagcgaggaggaggccgccctgaccgccagccagatcctgagcagaacccagatgctgaacagcgacagcgccaccgacgagaccatccccgaccaccccgacctgctgctgcagagcgaggacagcaccggcagcatcaccaccgaggaggtgctgcagatcagagacgagacccccaccctggaggccagcctggacaacgccaacagcagactgcccgaggacaccaccagcgtgctgaaggaggagcacgtgaccaccttcgaggacgagggcagctacatcatccaggagcagcaggagagcctggtgtgccagggcatcctggacctggaggagaccgagatgcccgagcccctggcccccgagagctaccccgagagcgtgtgcgaggaggacgtgaccctggccctgaaggagctggacgagagatgcgaggaggaggaggccgacttcagcggcctgagcagccaggacgaggaggagcaggacggcttccccgaggtgcagaccagccccctgcccagccccttcctgagcgccatcatcgccgccttccagcccgtggcctacgacgacgaggaggaggcctggagatgccacgtgaaccagatgctgagcgacaccgacggcagcagcgccgtgttcaccttccacgtgttcagcagactgttccagaccatccagagaaagttcggcgagatcaccaacgaggccgtgagcttcctgggcgacagcctgcagagaatcggcaccaagttcaagagcagcctggaggtgatgatgctgtgcagcgagtgccccaccgtgttcgtggacgccgagaccctgatgagctgcggcctgctggagaccctgaagttcggcgtgctggagctgcaggagcacctggacacctacaacgtgaagagagaggccgccgagcagtggctggacgactgcaagagaaccttcggcgccaaggaggacatgtacagaatcaacaccgacgcccagctgaacgagatcctggtggagctggagctgtgcagaagactgtacaagctgcacttccagctgctgctgctgttccaggcctactgcaagctgatcaaccaggtgaacaccatcaagaacgaggccgaggtgatcaacatgagcgaggagctggcccagctggagagcatcctgaaggaggccgagagcgccagcgagaacgaggagatcgacatcagcaaggccgcccagaccaccatcgagaccgccatccacagcctgatcgagaccctgaagaacaaggagttcatcagcgccgtggcccaggtgaaggccttcagaagcctgtggcccagcgacatcttcggcagctgcgaggacgaccccgtgcagaccctgctgcacatctacttccaccaccagaccctgggccagaccggcagcttcgccgtgatcggcagcaacctggacatgagcgaggccaactacaagctgatggagctgaacctggagatcagagagagcctgagaatggtgcagagctaccagctgctggcccaggccaagcccatgggcaacatggtgagcaccggcttctag

SEQ ID NO: 21438 - DNA, 549 bp, Artificial Sequence
  Description of Artificial Sequence: Synthetic coding sequence
atgagagagcccatctacatgcacagcaccatggtgttcctgccctgggagctgcacaccaagaagggccccagcccccccgagcagttcatggccgtgaagctgagcgacagcagaatcgccctgaagagcggctacggcaagtacctgggcatcaacagcgacgagctggtgggccacagcgacgccatcggccccagagagcagtgggagcccgtgttccagaacggcaagatggccctgctggccagcaacagctgcttcatcagatgcaacgaggccggcgacatcgaggccaagagcaagaccgccggcgaggaggagatgatcaagatcagaagctgcgccgagaaggagaccaagaagaaggacgacatccccgaggaggacaagggcaacgtgaagcagtgcgagatcaactacgtgaagaagttccagagcttccaggaccacaagctgaagatcagcaaggaggagagcaagatcctgaagaaggcccagaaggacggcttcctgcacgagaccctgctggacagagagcccaactag

SEQ ID NO: 21439 - DNA, 549 bp, Artificial Sequence; identical to SEQ ID NO: 21438
  Description of Artificial Sequence: Synthetic coding sequence

SEQ ID NO: 21440 - DNA, 369 bp, Artificial Sequence
  Description of Artificial Sequence: Synthetic coding sequence
atggacgagggcacctacatccacgccctggacaacggcctgttcaccctgggcgccccccacaaggaggacatcgacgagggccccagcccccccgagcagttcatggccgtgaagctgagcgacagcagaatcgccctgaagagcggctacggcaagtacctgggcatcaacagcgacgagctggtgggccacagcgacgccatcggccccagagagcagtgggagcccgtgttccagaacggcaagatggccctgctggccagcaacagctgcttcatcagatgcaacgaggccggcgacatcgaggccaagagcaagaccgccggcgaggaggagatgatcaagatgctgagccaccacctgtag

SEQ ID NO: 21441 - DNA, 837 bp, Artificial Sequence
  Description of Artificial Sequence: Synthetic coding sequence
atgggcaagggcaacgaggacagcgacctgcactgcagcagcatccagtgcagcaccgaccagccccccttccagcagatcagcttcaccgagaagggcagcgacgagaagaagcccttcaaggagaagggcaagaccgccttcagccacagcagcgagaagcacatccagagacagggcagcgagcccaaccccaacaaggagaacagcgaggagaccaagctgaaggccggcaacagcaccgccggcagcgagcccgagagcagcagctacagagagaactgcagaaagagaaagatgagcagcaaggacagctgccaggacaccgccggcaactgccccgagaaggagtgcagcctgagcctgaacaagaagagcagaagcagcaccgccgtgcacaacagcgagatccaggagacctgcgacgcccaccacagaggccacagcagagcctgcaccggccacagcaagagacacagaagcagagccctgggcgtgcagacccccagcatcagaaagagcctggtgaccagcgtgagagccatgagcgaggccgtgtaccaggacctggcccaggtgtgggcccagcagatccacagccccctgacctgcgagcagctgaccctgctgaccagactgagaggccccctgtgcgcccaggtgcagaccctgtacagcatggccacccaggccgcctacgtgttccccgccgagagctggctggtgcccgccaccctgcccggccccggcgagagcgccctggacagagaggcccaccccttccccggccaggagatcaccgagaccgtgagcggcagcgacgaggccaagctgtag

SEQ ID NO: 21442 - DNA, 849 bp, Artificial Sequence
  Description of Artificial Sequence: Synthetic coding sequence
atgggcaagggcaacgaggaccccgacctgcactgcagcagcatccagtgcagcaccgaccagccccccttccagcagatcagcttcaccgagaagggcagcgacgagaagaagcccttcaagggcaagggcaagaccgccttcagccacagcagcgagaagcacacccagagacaggccggcagcgaccccaaccccaacaaggagaacagcgaggagaccaagctgaaggccggcaacagcaccgccggcagcgagcccgagagcagcagctaccaggagaactgcagaaagagaaagatcagcagcaaggacatctgccaggacagagccggcaactgccccgaggaggagtgcaacctgaccctgaacaagaagagcagaagcagcaccgccgtgcacaacagcgagatccaggagacctgcgacgcccaccacagaggcagcagcagagcctgcaccggcagaagcaagagacacagaagcagagccctggaggtgcagacccccagcctgagaaagagcctggtgaccagcgtgagagccatgagcgaggccgtgtaccaggacctggcccaggtgtgggcccagcagatccacagccccctgacctgcgagcagctgaccctgctgaccagactgagaggccccctgtgcgcccaggtgcagaccctgtacagcatggccacccaggccgcctacgtgttccccgccgagagctggctggtgcccgccaccctgcccggccccggcgacagcgccctggacagagaggcccaccccttccccggccaggagatcaccgagcccgtgagcggcagcgacgaggccaagctgggcgccccctag

SEQ ID NO: 21443 - DNA, 984 bp, Artificial Sequence
  Description of Artificial Sequence: Synthetic coding sequence
atgggcagaaccagcaaggacaagagagacgtgtactacagactggccaaggagaacggctggagagccagaagcgccttcaagctgctgcagctggacaaggagttccagctgttccagggcgtgaccagagccgtggacctgtgcgccgcccccggcagctggagccaggtgctgagccagaagatcggcggccagggcagcggccacgtggtggccgtggacctgcaggccatggcccccctgcccggcgtggtgcagatccagggcgacatcacccagctgagcaccgccaaggagatcatccagcacttcaagggctgccccgccgacctggtggtgtgcgacggcgcccccgacgtgaccggcctgcacgacgtggacgagtacatgcaggcccagctgctgctggccgccctgaacatcgccacccacgtgctgaagcccggcggctgcttcgtggccaagatcttcagaggcagagacgtgaccctgctgtacagccagctgcaggtgttcttcagcagcgtgctgtgcgccaagcccagaagcagcagaaacagcagcatcgaggccttcgccgtgtgccagggctacgacccccccgagggcttcatccccgacctgagcaagcccctgctggaccacagctacgacttcaaccagctggacggccccaccagaatcatcgtgcccttcgtgacctgcggcgacctgagcagctacgacagcgacagaagctaccccctggacctggagggcggcagcgagtacaagtacaccccccccacccagccccccatcagccccccctaccaggaggcctgcaccctgaagagaaagggccagctggccaaggagatcagaccccaggactgccccatcagcagagtggacaccttcccccagcccctggccgccccccagtgccacaccctgctggcccccgagatggaggacaacgagatgagctgcagcccctag

SEQ ID NO: 21444 - DNA, 984 bp, Artificial Sequence; identical to SEQ ID NO: 21443
  Description of Artificial Sequence: Synthetic coding sequence

SEQ ID NO: 21445 - DNA, 411 bp, Artificial Sequence
  Description of Artificial Sequence: Synthetic coding sequence
ctgctgggcgagagagccatccccagagccggcagccaggccggctggagacccaccctgggcagcgtgggcggcagagtgggcagccccagcagcgccgagtgctgcagacccttccccggccagagaagatggaacttcgtggccctgcagccccccgccagaagatgggacctgaccatgctgcccagactggtgctgaacagctgggcccaggccatcctgcccccccagccccccaaggtgctgggcctgcaggaccccggcgccagcttcggcagcagactgcaccccgccctggagagaagccccggcatgatctacagctgggccgtgttcctgtaccccggcgtgcaccccgtgcaccccagaaacaccgacctgatcaccgtgaccaagagcgacggctag

SEQ ID NO: 21446 - DNA, 450 bp, Artificial Sequence
  Description of Artificial Sequence: Synthetic coding sequence
atgaagcccgccggcaacggcttccccagccccctggccggccccggcagcagaagaggctgcgtgcccggcctgaccacctggatcagagccagagccagagagaccggcagcagaagaggcagaaacgtgttcagccccgagagagccgccggcagcggcggctgcttctgcagcggcagaatccccagagtgagcgccgtggacgccctgagagtggccggcgccagaagagccgccgtgagcagaggcaaggccggcgtgcccctgagatacagagagagacacctggagctgagcgagtggcccagaaagcccgccagagcccacttccccgccagaaccggctgctggtggttctggtggctgctgagcggcggcacccccggcaccagcaagggcggcttcatctggctgtacctgacctggcagttcctgctgaacaagtag

SEQ ID NO: 21447 - DNA, 747 bp, Artificial Sequence
  Description of Artificial Sequence: Synthetic coding sequence
atgggcatcatggccgccagcagacccctgagcagattctgggagtggggcaagaacatcgtgtgcgtgggcagaaactacgccgaccacgtgagagagatgagaagcgccgtgctgagcgagcccgtgctgttcctgaagcccagcaccgcctacgcccccgagggcagccccatcctgatgcccgcctacaccagaaacctgcaccacgagctggagctgggcgtggtgatgggcaagagatgcagagccgtgcccgaggccgccgccatggactacgtgggcggctacgccctgtgcctggacatgaccgccagagacgtgcaggacgagtgcaagaagaagggcctgccctggaccctggccaagagcttcaccgccagctgccccgtgagcgccttcgtgcccaaggagaagatccccgacccccacaagctgaagctgtggctgaaggtgaacggcgagctgagacaggagggcgagaccagcagcatgatcttcagcatcccctacatcatcagctacgtgagcaagatcatcaccctggaggagggcgacatcatcctgaccggcacccccaagggcgtgggccccgtgaaggagaacgacgagatcgaggccggcatccacggcctgagacagggcctgaccctgagccccaagctggagtgcagcagcgccatcaccgcccactgcagcctggagctgcccggcagcagcaacccccccagcgccagcagattctag

SEQ ID NO: 21448 - DNA, 681 bp, Artificial Sequence
  Description of Artificial Sequence: Synthetic coding sequence
atgggcatcatggccgccagcagacccctgagcagattctgggagtggggcaagaacatcgtgtgcgtgggcagaaactacgccgaccacgtgagagagatgagaagcgccgtgctgagcgagcccgtgctgttcctgaagcccagcaccgcctacgcccccgagggcagccccatcctgatgcccgcctacaccagaaacctgcaccacgagctggagctgggcgtggtgatgggcaagagatgcagagccgtgcccgaggccgccgccatggactacgtgggcggctacgccctgtgcctggacatgaccgccagagacgtgcaggacgagtgcaagaagaagggcctgccctggaccctggccaagagcttcaccgccagctgccccgtgagcgccttcgtgcccaaggagaagatccccgacccccacaagctgaagctgtggctgaaggtgaacggcgagctgagacaggagggcgagaccagcagcatgatcttcagcatcccctacatcatcagctacgtgagcaagatcatcaccctggaggagggcgacatcatcctgaccggcacccccaagggcgtgggccccgtgaaggagaacgacgagatcgaggccggcatccacggcctgcccaaggtgagcagcgccaccctgcccgtgagactgcaggagtag

SEQ ID NO: 21449 - DNA, 675 bp, Artificial Sequence
  Description of Artificial Sequence: Synthetic coding sequence
atgggcatcatggccgccagcagacccctgagcagattctgggagtggggcaagaacatcgtgtgcgtgggcagaaactacgccgaccacgtgagagagatgagaagcgccgtgctgagcgagcccgtgctgttcctgaagcccagcaccgcctacgcccccgagggcagccccatcctgatgcccgcctacaccagaaacctgcaccacgagctggagctgggcgtggtgatgggcaagagatgcagagccgtgcccgaggccgccgccatggactacgtgggcggctacgccctgtgcctggacatgaccgccagagacgtgcaggacgagtgcaagaagaagggcctgccctggaccctggccaagagcttcaccgccagctgccccgtgagcgccttcgtgcccaaggagaagatccccgacccccacaagctgaagctgtggctgaaggtgaacggcgagctgagacaggagggcgagaccagcagcatgatcttcagcatcccctacatcatcagctacgtgagcaagatcatcaccctggaggagggcgacatcatcctgaccggcacccccaagggcgtgggccccgtgaaggagaacgacgagatcgaggccggcatccacggcctggtgagcatgaccttcaaggtggagaagcccgagtactag

SEQ ID NO: 21450 - DNA, 1134 bp, Artificial Sequence
  Description of Artificial Sequence: Synthetic coding sequence
atgtacaccttcgtggtgagagacgagaacagcagcgtgtacgccgaggtgagcagactgctgctggccaccggccactggaagagactgagaagagacaaccccagattcaacctgatgctgggcgagagaaacagactgcccttcggcagactgggccacgagcccggcctggtgcagctggtgaactactacagaggcgccgacaagctgtgcagaaaggccagcctggtgaagctgatcaagaccagccccgagctggccgagagctgcacctggttccccgagagctacgtgatctaccccaccaacctgaagacccccgtggcccccgcccagaacggcatccagccccccatcagcaacagcagaaccgacgagagagagttcttcctggccagctacaacagaaagaaggaggacggcgagggcaacgtgtggatcgccaagagcagcgccggcgccaagggcgagggcatcctgatcagcagcgaggccagcgagctgctggacttcatcgacaaccagggccaggtgcacgtgatccagaagtacctggagcaccccctgctgctggagcccggccacagaaagttcgacatcagaagctgggtgctggtggaccaccagtacaacatctacctgtacagagagggcgtgctgagaaccgccagcgagccctaccacgtggacaacttccaggacaagacctgccacctgaccaaccactgcatccagaaggagtacagcaagaactacggcaagtacgaggagggcaacgagatgttcttcaaggagttcaaccagtacctgaccagcgccctgaacatcaccctggagagcagcatcctgctgcagatcaagcacatcatcagaaactgcctgctgagcgtggagcccgccatcagcaccaagcacctgccctaccagagcttccagctgttcggcttcgacttcatggtggacgaggagctgaaggtgtggctgatcgaggtgaacggcgcccccgcctgcgcccagaagctgtacgccgagctgtgccagggcatcgtggacatcgccatcagcagcgtgttccccccccccgacgtggagcagccccagacccagcccgccgccttcatcaagctgtag

SEQ ID NO: 21451 - DNA, 384 bp, Artificial Sequence
  Description of Artificial Sequence: Synthetic coding sequence
atgctggtgagcggcagaagaagactgctgaccgtgctgctgcaggcccagaagtggcccttccagcccagcagagacatgagactggtgcagttcagagccccccacctggtgggcccccacctgggcctggagaccggcaacggcggcggcgtgatcaacctgaacgccttcgaccccaccctgcccaagaccatgacccagttcctggagcagggcgaggccaccctgagcgtggccagaagagccctggccgcccagctgcccgtgctgcccagaagcgaggtgaccttcctggcccccgtgaccagacccgacaaggtggtgtgcgtgggcatgaactacgtggaccactgcaaggagcagaacgtgcccgtgccctag

SEQ ID NO: 21452 - DNA, 246 bp, Artificial Sequence
  Description of Artificial Sequence: Synthetic coding sequence
atgctggtgagcggcagaagaagactgctgaccgtgctgctgcaggcccagaagtggcccttccagcccagcagagacatgagactggtgcagttcagagccccccacctggtgggcccccacctgggcctggagaccggcaacggcggcggcgtgatcaacctgaacgccttcgaccccaccctgcccaagaccatgacccagttcctggagcagggcgaggccaccctgagcgtggccagatag

SEQ ID NO: 21453 - DNA, 945 bp, Artificial Sequence
  Description of Artificial Sequence: Synthetic coding sequence
atgctggtgagcggcagaagaagactgctgaccgtgctgctgcaggcccagaagtggcccttccagcccagcagagacatgagactggtgcagttcagagccccccacctggtgggcccccacctgggcctggagaccggcaacggcggcggcgtgatcaacctgaacgccttcgaccccaccctgcccaagaccatgacccagttcctggagcagggcgaggccaccctgagcgtggccagaagagccctggccgcccagctgcccgtgctgcccagaagcgaggtgaccttcctggcccccgtgaccagacccgacaaggtggtgtgcgtgggcatgaactacgtggaccactgcaaggagcagaacgtgcccgtgcccaaggagcccatcatcttcagcaagttcgccagcagcatcgtgggcccctacgacgaggtggtgctgcccccccagagccaggaggtggactgggaggtggagctggccgtggtgatcggcaagaagggcaagcacatcaaggccaccgacgccatggcccacgtggccggcttcaccgtggcccacgacgtgagcgccagagactggcagatgagaagaaacggcaagcagtggctgctgggcaagaccttcgacaccttctgccccctgggccccgccctggtgaccaaggacagcgtggccgacccccacaacctgaagatctgctgcagagtgaacggcgaggtggtgcagagcggcaacaccaaccagatggtgttcaagaccgaggacctgatcgcctgggtgagccagttcgtgaccttctaccccggcgacgtgatcctgaccggcaccccccccggcgtgggcgtgttcagaaagccccccgtgttcctgaagaagggcgacgaggtgcagtgcgagatcgaggagctgggcgtgatcatcaacaaggtggtgtag

SEQ ID NO: 21454 - DNA, 945 bp, Artificial Sequence
  Description of Artificial Sequence: Synthetic coding sequence
atgctggtgagcggcagaagaagactgctgaccgccctgctgcaggcccagaagtggcccttccagcccagcagagacatgagactggtgcagttcagagccccccacctggtgggcccccacctgggcctggagaccggcaacggcggcggcgtgatcaacctgaacgccttcgaccccaccctgcccaagaccatgacccagttcctggagcagggcgaggccaccctgagcgtggccagaagagccctggccgcccagctgcccgtgctgccctggagcgaggtgaccttcctggcccccgtgacctggcccgacaaggtggtgtgcgtgggcatgaactacgtggaccactgcaaggagcagaacgtgcccgtgcccaaggagcccatcatcttcagcaagttcgccagcagcatcgtgggcccctacgacgaggtggtgctgcccccccagagccaggaggtggactgggaggtggagctggccgtggtgatcggcaagaagggcaagcacatcaaggccaccgacgccatggcccacgtggccggcttcaccgtggcccacgacgtgagcgccagagactggctgaccagaagaaacggcaagcagtggctgctgggcaagaccttcgacaccttctgccccctgggccccgccctggtgaccaaggacagcgtggccgacccccacaacctgaagatctgctgcagagtgaacggcgaggtggtgcagagcagcaacaccaaccagatggtgttcaagaccgaggacctgatcgcctgggtgagccagttcgtgaccttctaccccggcgacgtgatcctgaccggcaccccccccggcgtgggcgtgttcagaaagccccccgtgttcctgaagaagggcgacgaggtgcagtgcgagatcgaggagctgggcgtgatcatcaacaaggtggtgtag

SEQ ID NO: 21455 - DNA, 945 bp, Artificial Sequence; identical to SEQ ID NO: 21454
  Description of Artificial Sequence: Synthetic coding sequence

SEQ ID NO: 21456 - DNA, 945 bp, Artificial Sequence; identical to SEQ ID NO: 21454
  Description of Artificial Sequence: Synthetic coding sequence

SEQ ID NO: 21457 - DNA, 468 bp, Artificial Sequence
  Description of Artificial Sequence: Synthetic coding sequence
atggccaccagaaacccccccccccaggactacgagagcgacgacgacagctacgaggtgctggacctgaccgagtacgccagaagacaccagtggtggaacagagtgttcggccacagcagcggccccatggtggagaagtacagcgtggccacccagatcgtgatgggcggcgtgaccggctggtgcgccggcttcctgttccagaaggtgggcaagctggccgccaccgccgtgggcggcggcttcctgctgctgcagatcgccagccacagcggctacgtgcagatcgactggaagagagtggagaaggacgtgaacaaggccaagagacagatcaagaagagagccaacaaggccgcccccgagatcaacaacctgatcgaggaggccaccgagttcatcaagcagaacatcgtgatcagcagcggcttcgtgggcggcttcctgctgggcctggccagctag

SEQ ID NO: 21458 - DNA, 339 bp, Artificial Sequence
  Description of Artificial Sequence: Synthetic coding sequence
atggagctggtgctggtgttcctgtgcagcctgctggcccccatggtgctggccagcgccgccgagaaggagaaggagatggaccccttccactacgactaccagaccctgagaatcggcggcctggtgttcgccgtggtgctgttcagcgtgggcatcctgctgatcctgagaccccaggagatgagaaagcccagatggagaaccagcagcccccccatgcagcagagccccagaaagcagagaaccgaggtgcagcccagcggcggcagaagacagccccagggcggcagaggccccgtgctgctgtggcagaagatccccctgtggggccagtag

SEQ ID NO: 21459 - DNA, 339 bp, Artificial Sequence; identical to SEQ ID NO: 21458
  Description of Artificial Sequence: Synthetic coding sequence

SEQ ID NO: 21460 - DNA, 3537 bp, Artificial Sequence
  Description of Artificial Sequence: Synthetic coding sequence
atgggccaggacgccgaggacaccagcgaggagccccccgagaaggaggagctggccggcgtgcaggaggccgagaccgccaccgactgccccgaggtgctggaggagggctgcgaggaggccaccggcgtgaccggcggcgagcaggtggacctgagcgagccccccgaccacgagaagaagaccaaccaggaggtggccgccgccaccctggaggaccacgcccaggacgagagcgccgaggagagctgccagatcgtgcccttcgagaacgactgcatggaggacttcgtgaccagcctgaccggcagcccctacgagttcttccccaccgagagcaccagcttctgcagcgagagctgcagccccctgagcgagagcgccaagggcctggagagcgagcaggcccccaagctgggcctgagagccgaggagaaccccatggtgggcgccctgtgcggccagtgcggcagcctgcagggcggcgccgccgagggccccgccgcccccgacgtggtggtggtgctggaggaggaggccctggacgacgccctggccaacccctacgtgatgggcgtgggcctgcccggccaggccgcccccggcgagggcggccaggccgccagcgacgccctgggcggctacggcagcaaggaggagctgaactgcgaggccgagggcggcctggtgcccgccgacagaaagaacaccagcaccagagtgagaccccacagcggcaaggtggccggctacgtgcccgagaccgtgcccgaggagaccggccccgaggccggcagcagcgcccccggcatcggcggcgccgccgaggaggtgggcaagaccctgctgagcctggagggcaagcccctggaggccagcagagccctgcccgccaagcccagagccttcaccctgtaccccagaagcttcagcgtggagggcagagagatccccgtgagcgtgtaccaggagcccgagggcagcggcctggacgaccacagaatcaagagaaaggaggacaacctgagcctgagctgcgtgatcggcagcagcggcagcttcagccagagaaaccacctgcccagcagcggcaccagcacccccagcagcatggtggacatccccccccccttcgacctggcctgcatcaccaagaagcccatcaccaagagcagccccagcctgctgatcgagagcgacagccccgacaagtacaagaagaagaagagcagcttcaagagattcctggccctgaccttcaagaagaagaccgagaacaagctgcacgtggacgtgaacgtgagcagcagcagaagcagcagcgagagcagctaccacggccccagcagaatcctggaggtggacagaagaagcctgagcaacagcccccagctgaagagcagaaccggcaagctgagagccagcgagagccccagcagcctgatcttctacagagacggcaagagaaagggcgtgcccttcagcagaaccgtgagcagagtggagagcttcgaggacagaagcagaccccccttcctgcccctgcccctgaccaagcccagaagcatcagcttccccagcgccgacaccagcgactacgagaacatccccgccatgaacagcgactacgagaacatccagatcccccccagaagacccgccagagccggcgccttcaccaagctgttcgaggaccagagcagagccctgagcaccgccaacgagaacgacggctacgtggacatgagcagcttcaacgccttcgagagcaagcagcagagcgccgaccaggacgccgagagcgcctacaccgagccctacaaggtgtgccccatcagcagcgccgcccccaaggaggacctgaccagcgacgaggagcagagaagcagcgaggaggaggacagcgccagcagagaccccagcgtgacccacaaggtggagggccagagcagagccctggtgatcgcccaggagctgctgagcagcgagaaggcctacgtggagatgctgcagcacctgaacctggacttccacggcgccgtgatgagagccctggacgacatggaccacgagggcagagacaccctggccagagaggagctgagacagggcctgagcgagctgcccgccatccacgacctgcaccagggcatcctggaggagctggaggagagactgagcaactgggagagccagcagaaggtggccgacgtgttcctggccagagagcagggcttcgaccaccacgccacccacatcctgcagttcgacagatacctgggcctgctgagcgagaactgcctgcacagccccagactggccgccgccgtgagagagttcgagcagagcgtgcagggcggcagccagaccgccaagcacagactgctgagagtggtgcagagactgttccagtaccaggtgctgctgaccgactacctgaacaacctgtgccccgacagcgccgagtacgacaacacccagggcgccctgagcctgatcagcaaggtgaccgacagagccaacgacagcatggagcagggcgagaacctgcagaagctggtgcacatcgagcacagcgtgagaggccagggcgacctgctgcagcccggcagagagttcctgaaggagggcaccctgatgaaggtgaccggcaagaacagaagacccagacacctgttcctgatgaacgacgtgctgctgtacacctacccccagaaggacggcaagtacagactgaagaacaccctggccgtggccaacatgaaggtgagcagacccgtgatggagaaggtgccctacgccctgaagatcgagaccagcgagagctgcctgatgctgagcgccagcagctgcgccgagagagacgagtggtacggctgcctgagcagagccctgcccgaggactacaaggcccaggccctggccgccttccaccacagcgtggagatcagagagagactgggcgtgagcctgggcgagagaccccccaccctggtgcccgtgacccacgtgatgatgtgcatgaactgcggctgcgacttcagcctgaccctgagaagacaccactgccacgcctgcggcaagatcgtgtgcagaaactgcagcagaaacaagtaccccctgaagtacctgaaggacagaatggccaaggtgtgcgacggctgcttcggcgagctgaagaagagaggcagagccgtgcccggcctgatgagagagagacccgtgagcatgagcttccccctgagcagccccagattcagcggcagcgccttcagcagcgtgttccagagcatcaaccccagcaccttcaagaagcagaagaaggtgcccagcgccctgaccgaggacaaggtggccctggagagcatgcccctgctgggcttcaccatcgcccccgagaaggaggagggcagcagcgaggtgggccccatcttccacctgtaccacaagaagaccctgttctacagcttcaaggccgaggacaccaacagcgcccagagatggatcgaggccatggaggacgccagcgtgctgtag

SEQ ID NO: 21461 - DNA, 24 bp, Artificial Sequence
  Description of Artificial Sequence: Synthetic coding sequence
tgagagaagcagagccagtgctag

SEQ ID NO: 21462 - DNA, 354 bp, Artificial Sequence
  Description of Artificial Sequence: Synthetic coding sequence
atgagctggagaggcagaagcacctactactggcccagacccagaagatacgtgcagccccccgagatgatcggccccatgagacccgagcagttcagcgacgaggtggagcccgccacccccgaggagggcgagcccgccacccagtgccaggaccccgccgccgcccaggagggcgaggacgagggcgccagcgccggccagggccccaagcccgaggcccacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 21463 - DNA, 354 bp, Artificial Sequence; identical to SEQ ID NO: 21462
  Description of Artificial Sequence: Synthetic coding sequence

SEQ ID NO: 21464 - DNA, 354 bp, Artificial Sequence
  Description of Artificial Sequence: Synthetic coding sequence
atgagctggagaggcagaagcacctactactggcccagacccagaagatacgtgcagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggcccacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 21465 - DNA, 354 bp, Artificial Sequence; identical to SEQ ID NO: 21464
  Description of Artificial Sequence: Synthetic coding sequence

SEQ ID NO: 21466 - DNA, 354 bp, Artificial Sequence; identical to SEQ ID NO: 21464
  Description of Artificial Sequence: Synthetic coding sequence

SEQ ID NO: 21467 - DNA, 354 bp, Artificial Sequence
  Description of Artificial Sequence: Synthetic coding sequence
atgagctggagaggcagaagcacctactactggcccagacccagaagatacgtgcagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggccgacagccaggagcagggccacccccagaccggctgcgagtgcgaggacggccccgacggccaggagatggacccccccaaccccgaggaggtgaagacccccgaggagggcgagggccagagccagtgctag

SEQ ID NO: 21468 - DNA, 1131 bp, Artificial Sequence
  Description of Artificial Sequence: Synthetic coding sequence
atgttcggcgccgccggcagacagcccatcggcgcccccgccgccggcaacagctggcacttcagcagaaccatggaggagctggtgcacgacctggtgagcgccctggaggagagcagcgagcaggccagaggcggcttcgccgagaccggcgaccacagcagaagcatcagctgccccctgaagagacaggccagaaagagaagaggcagaaagagaagaagctacaacgtgcaccacccctgggagaccggccactgcctgagcgagggcagcgacagcagcctggaggagcccagcaaggactacagagagaaccacaacaacaacaagaaggaccacagcgacagcgacgaccagatgctggtggccaagagaagacccagcagcaacctgaacaacaacgtgagaggcaagagacccctgtggcacgagagcgacttcgccgtggacaacgtgggcaacagaaccctgagaagaagaagaaaggtgaagagaatggccgtggacctgccccaggacatcagcaacaagagaaccatgacccagccccccgagggctgcagagaccaggacatggacagcgacagagcctaccagtaccaggagttcaccaagaacaaggtgaagaagagaaagctgaagatcatcagacagggccccaagatccaggacgagggcgtggtgctggagagcgaggagaccaaccagaccaacaaggacaagatggagtgcgaggagcagaaggtgagcgacgagctgatgagcgagagcgacagcagcagcctgagcagcaccgacgccggcctgttcaccaacgacgagggcagacagggcgacgacgagcagagcgactggttctacgagaaggagagcggcggcgcctgcggcatcaccggcgtggtgccctggtgggagaaggaggaccccaccgagctggacaagaacgtgcccgaccccgtgttcgagagcatcctgaccggcagcttccccctgatgagccaccccagcagaagaggcttccaggccagactgagcagactgcacggcatgagcagcaagaacatcaagaagagcggcggcacccccaccagcatggccaccaactggaccagcgagatccccctgtag

SEQ ID NO: 21469 - DNA, 1587 bp, Artificial Sequence
  Description of Artificial Sequence: Synthetic coding sequence
atgttcggcgccgccggcagacagcccatcggcgcccccgccgccggcaacagctggcacttcagcagaaccatggaggagctggtgcacgacctggtgagcgccctggaggagagcagcgagcaggccagaggcggcttcgccgagaccggcgaccacagcagaagcatcagctgccccctgaagagacaggccagaaagagaagaggcagaaagagaagaagctacaacgtgcaccacccctgggagaccggccactgcctgagcgagggcagcgacagcagcctggaggagcccagcaaggactacagagagaaccacaacaacaacaagaaggaccacagcgacagcgacgaccagatgctggtggccaagagaagacccagcagcaacctgaacaacaacgtgagaggcaagagacccctgtggcacgagagcgacttcgccgtggacaacgtgggcaacagaaccctgagaagaagaagaaaggtgaagagaatggccgtggacctgccccaggacatcagcaacaagagaaccatgacccagccccccgagggctgcagagaccaggacatggacagcgacagagcctaccagtaccaggagttcaccaagaacaaggtgaagaagagaaagctgaagatcatcagacagggccccaagatccaggacgagggcgtggtgctggagagcgaggagaccaaccagaccaacaaggacaagatggagtgcgaggagcagaaggtgagcgacgagctgatgagcgagagcgacagcagcagcctgagcagcaccgacgccggcctgttcaccaacgacgagggcagacagggcgacgacgagcagagcgactggttctacgagaaggagagcggcggcgcctgcggcatcaccggcgtggtgccctggtgggagaaggaggaccccaccgagctggacaagaacgtgcccgaccccgtgttcgagagcatcctgaccggcagcttccccctgatgagccaccccagcagaagaggcttccaggccagactgagcagactgcacggcatgagcagcaagaacatcaagaagagcggcggcacccccaccagcatggtgcccatccccggccccgtgggcaacaagagaatggtgcacttcagccccgacagccaccaccacgaccactggttcagccccggcgccagaaccgagcacgaccagcaccagctgctgagagacaacagagccgagagaggccacaagaagaactgcagcgtgagaaccgccagcagacagaccagcatgcacctgggcagcctgtgcaccggcgacatcaagagaagaagaaaggccgcccccctgcccggccccaccaccgccggcttcgtgggcgagaacgcccagcccatcctggagaacaacatcggcaacagaatgctgcagaacatgggctggacccccggcagcggcctgggcagagacggcaagggcatcagcgagcccatccaggccatgcagagacccaagggcctgggcctgggcttccccctgcccaagagcaccagcgccaccaccacccccaacgccggcaagagcgcctag

SEQ ID NO: 21470 - DNA, 1578 bp, Artificial Sequence
  Description of Artificial Sequence: Synthetic coding sequence
atggccgtgcccggcgaggccgaggaggaggccaccgtgtacctggtggtgagcggcatccccagcgtgctgagaagcgcccacctgagaagctacttcagccagttcagagaggagagaggcggcggcttcctgtgcttccactacagacacagacccgagagagcccccccccaggccgcccccaacagcgccctgatccccaccgaccccgccgccgagggccagctgctgagccagaccagcgccaccgacgtgagacccctgagcaccagagacagcacccccatccagaccagaacctgctgctgcgtgatcagcgtgagaggcctggcccaggcccagagactgatcagaatgtacagcggcagaagatggctggacagccacggcacctggctgcccggcagatgcctgatcagaagactgagactgcccaccgaggccagcggcctgggcagcttccccttcaagaccagaaaggagctgcagagctggaaggccgagaacgaggccttcaccctggccgacctgaagcagctgcccgagctgaacccccccgtgctgatgcccagaggcaacgtgggcacccccctgagagtgttcctggagctgatcagagcctgcagactgccccccagaatcatcacccagctgcagctgcagttccccaagaccggcagcagcagaagatacggcaacgtgcccttcgagtacgaggacagcgagaccgtggagcaggaggagctggtgtacaccgccgagggcgaggagatcccccagggcacctacctggccgacatccccgccagcccctgcggcgagcccgaggaggaggtgggcaaggaggaggaggaggagagccacagcgacgaggacgacgacagaggcgaggagtgggagagacacgaggccctgcacgaggacgtgaccggccaggagagaaccaccgagcagctgttcgaggaggagatcgagctgaagtgggagaagggcggcagcggcctggtgttctacaccgacgcccagttctggcaggaggaggagggcgacttcgacgagcagaccgccgacgactgggacgtggacatgagcgtgtactacgacagagacggcggcgacaaggacgccagagacagcgtgcagatgagactggagcagagactgagagacggccaggaggacggcagcgtgatcgagagacaggtgggcaccttcgagagacacaccaagggcatcggcagaaaggtgatggagagacagggctgggccgagggccagggcctgggctgcagatgcagcggcgtgcccgaggccctggacagcgacggccagcaccccagatgcaagagaggcctgggctaccacggcgagaagctgcagcccttcggccagctgaagagacccagaagaaacggcctgggcctgatcagcaccatctacgacgagcccctgccccaggaccagaccgagagcctgctgagaagacagccccccaccagcatgaagttcagaaccgacatggccttcgtgagaggcagcagctgcgccagcgacagccccagcctgcccgactag

SEQ ID NO: 21471 - DNA, 714 bp, Artificial Sequence
  Description of Artificial Sequence: Synthetic coding sequence
atgcccagaggcaacgtgggcacccccctgagagtgttcctggagctgatcagagcctgcagactgccccccagaatcatcacccagctgcagctgcagttccccaagaccggcagcagcagaagatacggcaacgtgcccttcgagtacgaggacagcgagaccgtggagcaggaggagctggtgtacaccgccgagggcgaggagatcccccagggcacctacctggccgacatccccgccagcccctgcggcgagcccgaggaggaggtgggcaaggaggaggaggaggagagccacagcgacgaggacgacgacagaggcgaggagtgggagagacacgaggccctgcacgaggacgtgaccggccaggagagaaccaccgagcagctgttcgaggaggagatcgagctgaagtgggagaagggcggcagcggcctggtgttctacaccgacgcccagttctggcaggaggaggagggcgacttcgacgagcagaccgccgacgactgggacgtggacatgagcgtgtactacgacagagacggcggcgacaaggacgccagagacagcgtgcagatgagactggagcagagactgagagacggccaggaggacggcagcgtgatcgagagacaggtgggcaccttcgagagacacaccaagggcatcttcaccaagagccccctgcccagcccccccctgggctactag

SEQ ID NO: 21472 - DNA, 231 bp, Artificial Sequence
  Description of Artificial Sequence: Synthetic coding sequence
tgattcgacgagcagaccgccgacgactgggacgtggacatgagcgtgtactacgacagagacggcggcgacaaggacgccagagacagcgtgcagatgagactggagcagagactgagagacggccaggaggacggcagcgtgatcgagagacaggtgggcaccttcgagagacacaccaagggcatcttcaccaagagccccctgcccagcccccccctgggctactag

SEQ ID NO: 21473 - DNA, 387 bp, Artificial Sequence
  Description of Artificial Sequence: Synthetic coding sequence
atgagactggagcagagactgagagacggccaggaggacggcagcgtgatcgagagacaggtgggcaccttcgagagacacaccaagggcatcggcagaaaggtgatggagagacagggctgggccgagggccagggcctgggctgcagatgcagcggcgtgcccgaggccctggacagcgacggccagcaccccagatgcaagagaggcctgggctaccacggcgagaagctgcagcccttcggccagctgaagagacccagaagaaacggcctgggcctgatcagcaccatctacgacgagcccctgccccaggaccagaccgagagcctgctgagaagacagccccccaccagcatgaagttcagaaccgacatggccttctag

SEQ ID NO: 21474 - DNA, 1524 bp, Artificial Sequence
  Description of Artificial Sequence: Synthetic coding sequence
atggccgtgcccggcgaggccgaggaggaggccaccgtgtacctggtggtgagcggcatccccagcgtgctgagaagcgcccacctgagaagctacttcagccagttcagagaggagagaggcggcggcttcctgtgcttccactacagacacagacccgagagagcccccccccaggccgcccccaacagcgccctgatccccaccgaccccgccgccgagggccagctgctgagccagaccagcgccaccgacgtgagacccctgagcaccagagacagcacccccatccagaccagaacctgctgctgcgtgatcagcgtgagaggcctggcccaggcccagagactgatcagaatgtacagcggcagaagatggctggacagccacggcacctggctgcccggcagatgcctgatcagaagactgagactgcccaccgaggccagcggcctgggcagcttccccttcaagaccagaaaggagctgcccgagctgaacccccccgtgctgatgcccagaggcaacgtgggcacccccctgagagtgttcctggagctgatcagagcctgcagactgccccccagaatcatcacccagctgcagctgcagttccccaagaccggcagcagcagaagatacggcaacgtgcccttcgagtacgaggacagcgagaccgtggagcaggaggagctggtgtacaccgccgagggcgaggagatcccccagggcacctacctggccgacatccccgccagcccctgcggcgagcccgaggaggaggtgggcaaggaggaggaggaggagagccacagcgacgaggacgacgacagaggcgaggagtgggagagacacgaggccctgcacgaggacgtgaccggccaggagagaaccaccgagcagctgttcgaggaggagatcgagctgaagtgggagaagggcggcagcggcctggtgttctacaccgacgcccagttctggcaggaggaggagggcgacttcgacgagcagaccgccgacgactgggacgtggacatgagcgtgtactacgacagagacggcggcgacaaggacgccagagacagcgtgcagatgagactggagcagagactgagagacggccaggaggacggcagcgtgatcgagagacaggtgggcaccttcgagagacacaccaagggcatcggcagaaaggtgatggagagacagggctgggccgagggccagggcctgggctgcagatgcagcggcgtgcccgaggccctggacagcgacggccagcaccccagatgcaagagaggcctgggctaccacggcgagaagctgcagcccttcggccagctgaagagacccagaagaaacggcctgggcctgatcagcaccatctacgacgagcccctgccccaggaccagaccgagagcctgctgagaagacagccccccaccagcatgaagttcagaaccgacatggccttcgtgagaggcagcagctgcgccagcgacagccccagcctgcccgactag

SEQ ID NO: 21475 - DNA, 420 bp, Artificial Sequence
  Description of Artificial Sequence: Synthetic coding sequence
atggacggcctgaaggtgggccacgaccccgccaaggagttcaccaaccactggtggaacgagctgttcaacaagaccgccgccaacctggtggtggagaccggccaggacggcgtgcagatcagaagcctgagcaaggagaccaccagatacaaccaccccaagcccaacctgctgtaccagaagttcgtgaaggtgctggaggccgtgggcaacagagtgcaccccttcagcctgccctggttcccctggggcctgaacagctgcctggtgtgcctgatcaacagccagaacttccccaacatcgtgggcagctgcgaccagccctgctgctgcctgctgagactgcccagacccagcgccggcatcgagatcttcagattcagaggcagctgccacctgctgagagagcagcagtag

SEQ ID NO: 21476 - DNA, 1338 bp, Artificial Sequence
  Description of Artificial Sequence: Synthetic coding sequence
atgaacgtgacccccgaggtgaagagcagaggcatgaagttcgccgaggagcagctgctgaagcacggctggacccagggcaagggcctgggcagaaaggagaacggcatcacccaggccctgagagtgaccctgaagcaggacacccacggcgtgggccacgaccccgccaaggagttcaccaaccactggtggaacgagctgttcaacaagaccgccgccaacctggtggtggagaccggccaggacggcgtgcagatcagaagcctgagcaaggagaccaccagatacaaccaccccaagcccaacctgctgtaccagaagttcgtgaagatggccaccctgaccagcggcggcgagaagcccaacaaggacctggagagctgcagcgacgacgacaaccagggcagcaagagccccaagatcctgaccgacgagatgctgctgcaggcctgcgagggcagaaccgcccacaaggccgccagactgggcatcaccatgaaggccaagctggccagactggaggcccaggagcaggccttcctggccagactgaagggccaggaccccggcgccccccagctgcagagcgagagcaagccccccaagaagaagaagaagaagagaagacagaaggaggaggaggaggccaccgccagcgagagaaacgacgccgacgagaagcaccccgagcacgccgagcagaacatcagaaagagcaagaagaagaagagaagacaccaggagggcaaggtgagcgacgagagagagggcaccaccaagggcaacgagaaggaggacgccgccggcaccagcggcctgggcgagctgaacagcagagagcagaccaaccagagcctgagaaagggcaagaagaagaagagatggcaccacgaggaggagaagatgggcgtgctggaggagggcggcaagggcaaggaggccgccggcagcgtgagaaccgaggaggtggagagcagagcctacgccgacccctgcagcagaagaaagaagagacagcagcaggaggaggaggacctgaacctggaggacagaggcgaggagaccctgggcggcggcaccagagaggccgagagcagagcctgcagcgacggcagaagcagaaagagcaagaagaagagacagcagcaccaggaggaggaggacatcctggacgtgagagacgagaaggacggcggcgccagagaggccgagagcagagcccacaccggcagcagcagcagaggcaagagaaagagacagcagcaccccaagaaggagagagccggcgtgagcaccgtgcagaaggccaagaagaagcagaagaagagagactag

SEQ ID NO: 21477 - DNA, 1113 bp, Artificial Sequence
  Description of Artificial Sequence: Synthetic coding sequence
atgaacgtgacccccgaggtgaagagcagaggcatgaagttcgccgaggagcagctgctgaagcacggctggacccagggcaagggcctgggcagaaaggagaacggcatcacccaggccctgagagtgaccctgaagcaggacacccacggcgtgggccacgaccccgccaaggagttcaccaaccactggtggaacgagctgttcaacaagaccgccgccaacctggtggtggagaccggccaggacggcgtgcagatcagaagcctgagcaaggagaccaccagatacaaccaccccaagcccaacctgctgtaccagaagttcgtgaagatggccaccctgaccagcggcggcgagaagcccaacaaggacctggagagctgcagcgacgacgacaaccagggcagcaagagccccaagatcctgaccgacgagatgctgctgcaggcctgcgagggcagaaccgcccacaaggccgccagactgggcatcaccatgaaggccaagctggccagactggaggcccaggagcaggccttcctggccagactgaagggccaggaccccggcgccccccagctgcagagcgagagcaagccccccaagaagaagaagaagaagagaagacagaaggaggaggaggaggccaccgccagcgagagaaacgacgccgacgagaagcaccccgagcacgccgagcagaacatcagaaagagcaagaagaagaagagaagacaccaggagggcaaggtgagcgacgagagagagggcaccaccaagggcaacgagaaggaggacgccgccggcaccagcggcctgggcgagctgaacagcagagagcagaccaaccagagcctgagaaagggcaagaagaagaagagatggcaccacgaggaggagaagatgggcgtgctggaggagggcggcaagggcaaggaggccgccggcagcgtgagaaccgaggaggtggagagcagagcctacgccgacccctgcagcagaagaaagaagagacagcagcaggaggaggaggacctgaacctggaggacagaggcgaggagaccttcagatggtggaaccagggcagcagagagcagagcatgcagtag

SEQ ID NO: 21478 - DNA, 1128 bp, Artificial Sequence
  Description of Artificial Sequence: Synthetic coding sequence
atgttccccagaagcggccccagcaacgacgaggtgaagagcagaggcatgaagttcgccgaggagcagctgctgaagcacggctggacccagggcaagggcctgggcagaaaggagaacggcatcacccaggccctgagagtgaccctgaagcaggacacccacggcgtgggccacgaccccgccaaggagttcaccaaccactggtggaacgagctgttcaacaagaccgccgccaacctggtggtggagaccggccaggacggcgtgcagatcagaagcctgagcaaggagaccaccagatacaaccaccccaagcccaacctgctgtaccagaagttcgtgaagatggccaccctgaccagcggcggcgagaagcccaacaaggacctggagagctgcagcgacgacgacaaccagggcagcaagagccccaagatcctgaccgacgagatgctgctgcaggcctgcgagggcagaaccgcccacaaggccgccagactgggcatcaccatgaaggccaagctggccagactggaggcccaggagcaggccttcctggccagactgaagggccaggaccccggcgccccccagctgcagagcgagagcaagccccccaagaagaagaagaagaagagaagacagaaggaggaggaggaggccaccgccagcgagagaaacgacgccgacgagaagcaccccgagcacgccgagcagaacatcagaaagagcaagaagaagaagagaagacaccaggagggcaaggtgagcgacgagagagagggcaccaccaagggcaacgagaaggaggacgccgccggcaccagcggcctgggcgagctgaacagcagagagcagaccaaccagagcctgagaaagggcaagaagaagaagagatggcaccacgaggaggagaagatgggcgtgctggaggagggcggcaagggcaaggaggccgccggcagcgtgagaaccgaggaggtggagagcagagcctacgccgacccctgcagcagaagaaagaagagacagcagcaggaggaggaggacctgaacctggaggacagaggcgaggagaccttcagatggtggaaccagggcagcagagagcagagcatgcagtag

SEQ ID NO: 21479 - DNA, 1218 bp, Artificial Sequence
  Description of Artificial Sequence: Synthetic coding sequence
tgaagcctggtgctgggcgtgatcacctgcgcccccgagagactgaacttccccgccagcgcctgcgccctgaagagagccgcctggctgctgagaggcagaggcgtgttccacaacggcctgaagatctgcgagaagttcggccccaacctggacacctgccccgagggcaccatcctgggcctgagactggacagcagcggcggcctgcacctgcacgtgaacggcgtggaccagggcgtggccgtgcccgacgtgccccagccctgccacgccctggtggacctgtacggccagtgcgagcaggtgaccatcgtgaaccccgagcccggcgccgccagcggcaagagcgccggcacccagggcgacatggagaaggccgacatggtggacggcatcaaggagagcgtgtgctggggccccccccccgccgccagccccctgaagagctgcgagtaccacgccctgtgcagcagattccaggagctgctgctgctgcccgaggactacttcatgcccccccccaagagaagcctgtgctactgcgagagctgcagaaagctgagaggcgacgaggcccacagaagaagaggcgagccccccagagagtacgccctgcccttcggctggtgcagattcaacctgagagtgaaccccagactggaggccggcaccctgaccaagaagtggcacatggcctaccacggcagcaacgtggccgccgtgagaagagtgctggacagaggcgagctgggcgccggcaccgccagcatcctgagctgcagacccctgaagggcgagcccggcgtgggcttcgaggagcccggcgagaactgcgccccccccagagaggagcagcccccccccgtgctgctgagccccagcctgcagtacgccggcgccgagaccctggccagcaaggtgcagttcagagaccccaagagccagagaacccaccaggcccaggtggccttccagagaagcctgagcctgtgcccccacgaggccgccttcagcggcgccaccggcagagagtggggcagagtgggcgccagaaagatgggcgccagcgtgcagctgctgctgaccctgatcagcaaggagcccatcaacaccgtgagcgagcccccccccagacccctgagcagagcccccctgagcggcgccagagtgccctggggcgccaccagatgggccagagagatcaaggagagctag

SEQ ID NO: 21480 - DNA, 1377 bp, Artificial Sequence
  Description of Artificial Sequence: Synthetic coding sequence
atgagcagcagcagacccgagcccggcccctgggcccccctgagccccagactgcagcccctgagccagagcagcagcagcctgctgggcgagggcagagagcagagacccgagctgagaaagaccgccagcagcaccgtgtggcaggcccagctgggcgaggccagcaccagaccccaggcccccgaggaggagggcaacccccccgagagcatgaagcccgccagagccagcggccccaaggccagacccagcgccggcggccactggtggagcagcaccgtgggcaacgtgagcaccatgggcggcagcgacctgtgcagactgagagcccccagcgccgccgccatgcagagaagccacagcgacctggtgagaagcacccagatgagaggccacagcggcgccagaaaggccagcctgagctgcagcgccctgggcagcagccccgtgcacagagcccagctgcagcccggcggcaccagcggccagggcggccaggcccccgccggcctggagagagacctggcccccgaggacgagaccagcaacagcgcctggatgctgggcgccagccagctgagcgtgccccccctggacctgggcgacaccaccgcccacagcagcagcgcccaggccgagcccaaggccgccgagcagctggccaccaccacctgccacgccctgccccccgccgccctgctgtgcggcatgagagaggtgagagccggcggctgctgccacgccctgcccgccaccggcatcctggccttccccaagctggtggccagcgtgagcgagagcggcctgcaggcccagcacggcgtgaagatccactgcagactgagcggcggcctgcccggccacagccactgctgcgcccacctgtggggccccgccggcctggtgcccgagcccggcagcagaaccaaggacgtgtggaccatgaccagcgccaacgacctggcccccgccgaggccagccccctgagcgcccaggacgccggcgtgcaggccgcccccgtggccgcctgcaaggccgtggccaccagccccagcctggaggcccccgccgccctgcacgtgttccccgaggtgaccctgggcagcagcctggaggaggtgcccagccccgtgagagacgtgagatgggacgccgagggcatgacctgggaggtgtacggcgccgccgtggacctggaggtgctgggcgtggccatccagaagcacctggagatgcagttcgagcagctgcagagagcccccgccagcgaggacagcctgagcgtggagggcagaagaggccccctgagagccgtgatgcagagcctgagaagacccagctgctgcggctgcagcggcgccgcccccgagtag

SEQ ID NO: 21481 - DNA, 1377 bp, Artificial Sequence; identical to SEQ ID NO: 21480
  Description of Artificial Sequence: Synthetic coding sequence

SEQ ID NO: 21482 - DNA, 1377 bp, Artificial Sequence; identical to SEQ ID NO: 21480
  Description of Artificial Sequence: Synthetic coding sequence

SEQ ID NO: 21483 - DNA, 1641 bp, Artificial Sequence
  Description of Artificial Sequence: Synthetic coding sequence
atggagctggagaacatcgtggccaacagcctgctgctgaaggccagacaggagaaggactacagcagcctgtgcgacaagcagcccatcggcagaagactgttcagacagttctgcgacaccaagcccaccctgaagagacacatcgagttcctggacgccgtggccgagtacgaggtggccgacgacgaggacagaagcgactgcggcctgagcatcctggacagattcttcaacgacaagctggccgcccccctgcccgagatcccccccgacgtggtgaccgagtgcagactgggcctgaaggaggagaaccccagcaagaaggccttcgaggagtgcaccagagtggcccacaactacctgagaggcgagcccttcgaggagtaccaggagagcagctacttcagccagttcctgcagtggaagtggctggagagacagcccgtgaccaagaacaccttcagacactacagagtgctgggcaagggcggcttcggcgaggtgtgcgcctgccaggtgagagccaccggcaagatgtacgcctgcaagaagctgcagaagaagagaatcaagaagagaaagggcgaggccatggccctgaacgagaagagaatcctggagaaggtgcagagcagattcgtggtgagcctggcctacgcctacgagaccaaggacgccctgtgcctggtgctgaccatcatgaacggcggcgacctgaagttccacatctacaacctgggcaaccccggcttcgacgagcagagagccgtgttctacgccgccgagctgtgctgcggcctggaggacctgcagagagagagaatcgtgtacagagacctgaagcccgagaacatcctgctggacgacagaggccacatcagaatcagcgacctgggcctggccaccgagatccccgagggccagagagtgagaggcagagtgggcaccgtgggctacatggcccccgaggtggtgaacaacgagaagtacaccttcagccccgactggtggggcctgggctgcctgatctacgagatgatccagggccacagccccttcaagaagtacaaggagaaggtgaagtgggaggaggtggaccagagaatcaagaacgacaccgaggagtacagcgagaagttcagcgaggacgccaagagcatctgcagaatgctgctgaccaagaaccccagcaagagactgggctgcagaggcgagggcgccgccggcgtgaagcagcaccccgtgttcaaggacatcaacttcagaagactggaggccaacatgctggagccccccttctgccccgacccccacgccgtgtactgcaaggacgtgctggacatcgagcagttcagcgtggtgaagggcatctacctggacaccgccgacgaggacttctacgccagattcgccaccggctgcgtgagcatcccctggcagaacgagatgatcgagagcggctgcttcaaggacatcaacaagagcgagagcgaggaggccctgcccctggacctggacaagaacatccacacccccgtgagcagacccaacagaggcttcttctacagactgttcagaagaggcggctgcctgaccatggtgcccagcgagaaggaggtggagcccaagcagtgctag

SEQ ID NO: 21484 - DNA, 1503 bp, Artificial Sequence
  Description of Artificial Sequence: Synthetic coding sequence
atggagctggagaacatcgtggccaacagcctgctgctgaaggccagacaggagaaggactacagcagcctgtgcgacaagcagcccatcggcagaagactgttcagacagttctgcgacaccaagcccaccctgaagagacacatcgagttcctggacgccgtggccgagtacgaggtggccgacgacgaggacagaagcgactgcggcctgagcatcctggacagattcttcaacgacaagctggccgcccccctgcccgagatcccccccgacgtggtgaccgagtgcagactgggcctgaaggaggagaaccccagcaagaaggccttcgaggagtgcaccagagtggcccacaactacctgagaggcgagcccttcgaggagtaccaggagagcagctacttcagccagttcctgcagtggaagtggctggagagacagcccgtgaccaagaacaccttcagacactacagagtgctgggcaagggcggcttcggcgaggtgtgcgcctgccaggtgagagccaccggcaagatgtacgcctgcaagaagctgcagaagaagagaatcaagaagagaaagggcgaggccatggccctgaacgagaagagaatcctggagaaggtgcagagcagattcgtggtgagcctggcctacgcctacgagaccaaggacgccctgtgcctggtgctgaccatcatgaacggcggcgacctgaagttccacatctacaacctgggcaaccccggcttcgacgagcagagagccgtgttctacgccgccgagctgtgctgcggcctggaggacctgcagagagagagaatcgtgtacagagacctgaagcccgagaacatcctgctggacgacagaggccacatcagaatcagcgacctgggcctggccaccgagatccccgagggccagagagtgagaggcagagtgggcaccgtgggctacatggcccccgaggtggtgaacaacgagaagtacaccttcagccccgactggtggggcctgggctgcctgatctacgagatgatccagggccacagccccttcaagaagtacaaggagaaggtgaagtgggaggaggtggaccagagaatcaagaacgacaccgaggagtacagcgagaagttcagcgaggacgccaagagcatctgcagaatgctgctgaccaagaaccccagcaagagactgggctgcagaggcgagggcgccgccggcgtgaagcagcaccccgtgttcaaggacatcaacttcagaagactggaggccaacatgctggagccccccttctgccccgacccccacgccgtgtactgcaaggacgtgctggacatcgagcagttcagcgtggtgaagggcatctacctggacaccgccgacgaggacttctacgccagattcgccaccggctgcgtgagcatcccctggcagaacgagggctgcctgaccatggtgcccagcgagaaggaggtggagcccaagcagtgctag

SEQ ID NO: 21485 - DNA, 405 bp, Artificial Sequence
  Description of Artificial Sequence: Synthetic coding sequence
atgcacggcggcggcggcgtgagcagctgcagcgccagcagcgtgagcagcgtgagccagaacccccccgccgccgccgcccccggccacggcgccagagagcacagaggccagctggccgccgccgagagcgccagcagccccctgcaccccgccaccaaggccagcgtgggccccgccctgcagagagagacccccaccatcctgtgcgccatcctgtgcctgggcccccacgtgagcctggcctgcgtgagcagagagctggccaccgagcccagaaccagcagcccctgcgccagccacggcagcagcagccaccccgtgaccctgaccgagctgctgatcagcagcatcagcctgagagacggcgccgccctgctgggcctgtgcagcagaaccgtgtag

SEQ ID NO: 21486 - DNA, 1599 bp, Artificial Sequence
  Description of Artificial Sequence: Synthetic coding sequence
atggagctggagaacatcgtggccaacagcctgctgctgaaggccagacagggcggctacggcaagaagagcggcagaagcaagaagtggaaggagatcctgaccctgccccccgtgagccagtgcagcgagctgagacacagcatcgagaaggactacagcagcctgtgcgacaagcagcccatcggcagaagactgttcagacagttctgcgacaccaagcccaccctgaagagacacatcgagttcctggacgccgtggccgagtacgaggtggccgacgacgaggacagaagcgactgcggcctgagcatcctggacagattcttcaacgacaagctggccgcccccctgcccgagatcccccccgacgtggtgaccgagtgcagactgggcctgaaggaggagaaccccagcaagaaggccttcgaggagtgcaccagagtggcccacaactacctgagaggcgagcccttcgaggagtaccaggagagcagctacttcagccagttcctgcagtggaagtggctggagagacagcccgtgaccaagaacaccttcagacactacagagtgctgggcaagggcggcttcggcgaggtgtgcgcctgccaggtgagagccaccggcaagatgtacgcctgcaagaagctgcagaagaagagaatcaagaagagaaagggcgaggccatggccctgaacgagaagagaatcctggagaaggtgcagagcagattcgtggtgagcctggcctacgcctacgagaccaaggacgccctgtgcctggtgctgaccatcatgaacggcggcgacctgaagttccacatctacaacctgggcaaccccggcttcgacgagcagagagccgtgttctacgccgccgagctgtgctgcggcctggaggacctgcagagagagagaatcgtgtacagagacctgaagcccgagaacatcctgctggacgacagaggccacatcagaatcagcgacctgggcctggccaccgagatccccgagggccagagagtgagaggcagagtgggcaccgtgggctacatggcccccgaggtggtgaacaacgagaagtacaccttcagccccgactggtggggcctgggctgcctgatctacgagatgatccagggccacagccccttcaagaagtacaaggagaaggtgaagtgggaggaggtggaccagagaatcaagaacgacaccgaggagtacagcgagaagttcagcgaggacgccaagagcatctgcagaatgctgctgaccaagaaccccagcaagagactgggctgcagaggcgagggcgccgccggcgtgaagcagcaccccgtgttcaaggacatcaacttcagaagactggaggccaacatgctggagccccccttctgccccgacccccacgccgtgtactgcaaggacgtgctggacatcgagcagttcagcgtggtgaagggcatctacctggacaccgccgacgaggacttctacgccagattcgccaccggctgcgtgagcatcccctggcagaacgagggctgcctgaccatggtgcccagcgagaaggaggtggagcccaagcagtgctag

SEQ ID NO: 21487 - DNA, 942 bp, Artificial Sequence
  Description of Artificial Sequence: Synthetic coding sequence
atgaagagcccccccctgctgagcccctgcctgagctggaagagaatggccggcatcttcttcctgcccttcatcagcagcggcttcgcccccagattcaagcaggaggagaacttcatgctgggcagagcccaccccagccagcccagattcaactggagccacctgacccccctggagctgaagaacagaagcgtgggcctgggcaccgagagcaccggcagaggcaagccccacttcaccctggagggccacaagttcctgatcttcggcggcagcatccactacttcagagtgcccagagagtactggagagacagactgctgaagctgaaggcctgcggcttcaacaccgtgaccacctacgtgccctggaacctgcacgagcccgagagaggcaagttcgacttcagcggcaacctggacctggaggccttcgtgctgatggccgccgagatcggcctgtgggtgatcctgagacccggcagatacatctgcagcgagatggacctgggcggcctgcccagctggctgctgcaggaccccagactgctgctgagaaccaccaacaagagcttcatcgaggccgtggagaagtacttcgaccacctgatccccagagtgatccccctgcagtacagacaggccggccccgtgatcgccgtgcaggtggagaacgagtacggcagcttcaacaaggacaagacctacatgccctacctgcacaaggccctgctgagaagaggcatcgtggagctgctgctgaccagcgacggcgagaagcacgtgctgagcggccacaccaagggcgtgctggccgccatcaacctgcagaagctgcaccaggacaccttcaaccagctgcacaaggtgcagggcgccagcatcgacgccggcctgctgagcgacgccagccaggccgccaccagcagcagcctgtag

SEQ ID NO: 21488 - DNA, 1962 bp, Artificial Sequence
  Description of Artificial Sequence: Synthetic coding sequence
atgaagagcccccccctgctgagcccctgcctgagctggaagagaatggccggcatcttcttcctgcccttcatcagcagcggcttcgcccccagattcaagcaggaggagaacttcatgctgggcagagcccaccccagccagcccagattcaactggagccacctgacccccctggagctgaagaacagaagcgtgggcctgggcaccgagagcaccggcagaggcaagccccacttcaccctggagggccacaagttcctgatcttcggcggcagcatccactacttcagagtgcccagagagtactggagagacagactgctgaagctgaaggcctgcggcttcaacaccgtgaccacctacgtgccctggaacctgcacgagcccgagagaggcaagttcgacttcagcggcaacctggacctggaggccttcgtgctgatggccgccgagatcggcctgtgggtgatcctgagacccggcagatacatctgcagcgagatggacctgggcggcctgcccagctggctgctgcaggaccccagactgctgctgagaaccaccaacaagagcttcatcgaggccgtggagaagtacttcgaccacctgatccccagagtgatccccctgcagtacagacaggccggccccgtgatcgccgtgcaggtggagaacgagtacggcagcttcaacaaggacaagacctacatgccctacctgcacaaggccctgctgagaagaggcatcgtggagctgctgctgaccagcgacggcgagaagcacgtgctgagcggccacaccaagggcgtgctggccgccatcaacctgcagaagctgcaccaggacaccttcaaccagctgcacaaggtgcagagagacaagcccctgctgatcatggagtactgggtgggctggttcgacagatggggcgacaagcaccacgtgaaggacgccaaggaggtggagcacgccgtgagcgagttcatcaagtacgagatcagcttcaacgtgtacatgttccacggcggcaccaacttcggcttcatgaacggcgccacctacttcggcaagcacagcggcatcgtgaccagctacgactacgacgccgtgctgaccgaggccggcgactacaccgagaagtacctgaagctgcagaagctgttccagagcgtgagcgccacccccctgcccagagtgcccaagctgccccccaaggccgtgtacccccccgtgagacccagcctgtacctgcccctgtgggacgccctgagctacctgaacgagcccgtgagaagcagacagcccgtgaacatggagaacctgcccatcaacaacggcagcggccagagctacggcctggtgctgtacgagaagagcatctgcagcggcggcagactgagagcccacgcccacgacgtggcccaggtgttcctggacgagaccatgatcggcatcctgaacgagaacaacaaggacctgcacatccccgagctgagagactgcagatacctgagaatcctggtggagaaccagggcagagtgaacttcagctggcagatccagaacgagcagaagggcatcaccggcagcgtgagcatcaacaacagcagcctggagggcttcaccatctacagcctggagatgaagatgagcttcttcgagagactgagaagcgccacctggaagcccgtgcccgacagccaccagggccccgccttctactgcggcaccctgaaggccggccccagccccaaggacaccttcctgagcctgctgaactggaactacggcttcgtgttcatcaacggcagaaacctgggcagatactggaacatcggcccccagaagaccctgtacctgcccggcgtgtggctgcaccccgaggacaacgaggtgatcctgttcgagaagatgatgagcggcagcgacatcaagagcaccgacaagcccaccctgtag

SEQ ID NO: 21489 - DNA, 447 bp, Artificial Sequence
  Description of Artificial Sequence: Synthetic coding sequence
atggagcccgaggccttcgagatctgcccctacgacccccaccacagaatccccctgagcagattccagtaccacctggccagctgcagaagaaagaaccccaagaaggccaagaagatggccacctgcaagtacaacgcctgccacgtggtgcccatcaagaacctggaggagcacgaggccgtgtgcgtgaacagaagcgccgtggaggaggaggacaccgagaaccccctgaaggtgagcccccccagcagcgagcagaacgacgacacccagcaggtgagcccctgcctgcccagccccgacatctggaacgtggacggcgccaactgccagcacgtgttcgtgctgaagaccttcttcccccagaaggtggtgtgcgagaacgacaccaaggagagcgccagagagaccagcccccagaagatcctgagacccggccagtag

SEQ ID NO: 21490 - DNA, 372 bp, Artificial Sequence
  Description of Artificial Sequence: Synthetic coding sequence
atggagcccgaggccttcgagatctgcccctacgacccccaccacagaatccccctgagcagattccagtaccacctggccagctgcagaagaaagaaccccaagaaggccaagaagatggccacctgcaagtacaacgcctgccacgtggtgcccatcaagaacctggaggagcacgaggccgtgtgcgtgaacagaagcgccgtggaggaggaggacaccgagaaccccctgaaggtgagcccccccagcagcgagcagaacgacgacacccagcagaccttcttcccccagaaggtggtgtgcgagaacgacaccaaggagagcgccagagagaccagcccccagaagatcctgagacccggccagtag

SEQ ID NO: 21491 - DNA, 1491 bp, Artificial Sequence
  Description of Artificial Sequence: Synthetic coding sequence
atggaccccctgggcgcccccagccagttcgtggacgtggacaccctgcccagctggggcgacagctgccaggacgagctgaacagcagcgacaccaccgccgagatcttccaggaggacaccgtgagaagccccttcctgtacaacaaggacgtgaacggcaaggtggtgctgtggaagggcgacgtggccctgctgaactgcaccgccatcgtgaacaccagcaacgagagcctgaccgacaagaaccccgtgagcgagagcatcttcatgctggccggccccgacctgaaggaggacctgcagaagctgaagggctgcagaaccggcgaggccaagctgaccaagggcttcaacctggccgccagattcatcatccacaccgtgggccccaagtacaagagcagatacagaaccgccgccgagagcagcctgtacagctgctacagaaacgtgctgcagctggccaaggagcagagcatgagcagcgtgggcttctgcgtgatcaacagcgccaagagaggctaccccctggaggacgccacccacatcgccctgagaaccgtgagaagattcctggagatccacggcgagaccatcgagaaggtggtgttcgccgtgagcgacctggaggagggcacctaccagaagctgctgcccctgtacttccccagaagcctgaaggaggagaacagaagcctgccctacctgcccgccgacatcggcaacgccgagggcgagcccgtggtgcccgagagacagatcagaatcagcgagaagcccggcgcccccgaggacaaccaggaggaggaggacgagggcctgggcgtggacctgagcttcatcggcagccacgccttcgccagaatggagggcgacatcgacaagcagagaaagctgatcctgcagggccagctgagcgaggccgccctgcagaagcagcaccagagaaactacaacagatggctgtgccaggccagaagcgaggacctgagcgacatcgccagcctgaaggccctgtaccagaccggcgtggacaactgcggcagaaccgtgatggtggtggtgggcagaaacatccccgtgaccctgatcgacatggacaaggccctgctgtacttcatccacgtgatggaccacatcgccgtgaaggagtacgtgctggtgtacttccacaccctgaccagcgagtacaaccacctggacagcgacttcctgaagaagctgtacgacgtggtggacgtgaagtacaagagaaacctgaaggccgtgtacttcgtgcaccccaccttcagaagcaaggtgagcacctggttcttcaccaccttcagcgtgagcggcctgaaggacaagatccaccacgtggacagcctgcaccagctgttcagcgccatcagccccgagcagatcgacttcccccccttcgtgctggagtacgacgccagagtgagaagcaccagaagcagccccagccccggcatggtgtactag

SEQ ID NO: 21492 - DNA, 1494 bp, Artificial Sequence
  Description of Artificial Sequence: Synthetic coding sequence
atggaccccctgggcgcccccagccagttcgtggacgtggacaccctgcccagctggggcgacagctgccaggacgagctgaacagcagcgacaccaccgccgagatcttccaggaggacaccgtgagaagccccttcctgtacaacaaggacgtgaacggcaaggtggtgctgtggaagggcgacgtggccctgctgaactgcaccgccatcgtgaacaccagcaacgagagcctgaccgacaagaaccccgtgagcgagagcatcttcatgctggccggccccgacctgaaggaggacctgcagaagctgaagggctgcagaaccggcgaggccaagctgaccaagggcttcaacctggccgccagattcatcatccacaccgtgggccccaagtacaagagcagatacagaaccgccgccgagagcagcctgtacagctgctacagaaacgtgctgcagctggccaaggagcagagcatgagcagcgtgggcttctgcgtgatcaacagcgccaagagaggctaccccctggaggacgccacccacatcgccctgagaaccgtgagaagattcctggagatccacggcgagaccatcgagaaggtggtgttcgccgtgagcgacctggaggagggcacctaccagaagctgctgcccctgtacttccccagaagcctgaaggaggagaacagaagcctgccctacctgcccgccgacatcggcaacgccgagggcgagcccgtggtgcccgagagacagatcagaatcagcgagaagcccggcgcccccgaggacaaccaggaggaggaggacgagggcctgggcgtggacctgagcttcatcggcagccacgccttcgccagaatggagggcgacatcgacaagcagagaaagctgatcctgcagggccagctgagcgaggccgccctgcagaagcagcaccagagaaactacaacagatggctgtgccaggccagaagcgaggacctgagcgacatcgccagcctgaaggccctgtaccagaccggcgtggacaactgcggcagaaccgtgatggtggtggtgggcagaaacatccccgtgaccctgatcgacatggacaaggccctgctgtacttcatccacgtgatggaccacatcgccgtgaaggagtacgtgctggtgtacttccacaccctgaccagcgagtacaaccacctggacagcgacttcctgaagaagctgtacgacgtggtggacgtgaagtacaagagaaacctgaaggccgtgtacttcgtgcaccccaccttcagaagcaaggtgagcacctggttcttcaccaccttcagcgtgagcggcctgaaggacaagatccaccacgtggacagcctgcaccagctgttcagcgccatcagccccgagcagatcgacttcccccccttcgtgctggagtacgacgccagagagaacggcccctactacaccagctacccccccagccccgacctgtag

SEQ ID NO: 21493 - DNA, 384 bp, Artificial Sequence
  Description of Artificial Sequence: Synthetic coding sequence
atggccaagatcctggagcacgacgacgtgagctacctgaagaagatcctgggcgagctggccatggtgctggaccagatcgaggccgagctggagaagagaaagctggagaacgagggccagaagtgcgagctgtggctgtgcggctgcgccttcaccctggccgacgtgctgctgggcgccaccctgcacagactgaagttcctgggcctgagcaagaagtactgggaggacggcagcagacccaacctgcagagcttcttcgagagagtgcagagaagattcgccttcagaaaggtgagcagatggaactgcggcgactggctgggcagcgagggcaccctgccccaggacaaggccgacatcaagacccagctgctgtag

SEQ ID NO: 21494 - DNA, 1104 bp, Artificial Sequence
  Description of Artificial Sequence: Synthetic coding sequence
atggccacccccaacaacctgacccccaccaactgcagctggtggcccatcagcgccctggagagcgacgccgccaagcccgccgaggcccccgacgcccccgaggccgccagccccgcccactggcccagagagagcctggtgctgtaccactggacccagagcttcagcagccagaaggtgagactggtgatcgccgagaagggcctggtgtgcgaggagagagacgtgagcctgccccagagcgagcacaaggagccctggttcatgagactgaacctgggcgaggaggtgcccgtgatcatccacagagacaacatcatcagcgactacgaccagatcatcgactacgtggagagaaccttcaccggcgagcacgtggtggccctgatgcccgaggtgggcagcctgcagcacgccagagtgctgcagtacagagagctgctggacgccctgcccatggacgcctacacccacggctgcatcctgcaccccgagctgaccaccgacagcatgatccccaagtacgccaccgccgagatcagaagacacctggccaacgccaccaccgacctgatgaagctggaccacgaggaggagccccagctgagcgagccctacctgagcaagcagaagaagctgatggccaagatcctggagcacgacgacgtgagctacctgaagaagatcctgggcgagctggccatggtgctggaccagatcgaggccgagctggagaagagaaagctggagaacgagggccagaagtgcgagctgtggctgtgcggctgcgccttcaccctggccgacgtgctgctgggcgccaccctgcacagactgaagttcctgggcctgagcaagaagtactgggaggacggcagcagacccaacctgcagagcttcttcgagagagtgcagagaagattcgccttcagaaaggtgctgggcgacatccacaccaccctgctgagcgccgtgatccccaacgccttcagactggtgaagagaaagccccccagcttcttcggcgccagcttcctgatgggcagcctgggcggcatgggctacttcgcctactggtacctgaagaagaagtacatctag

SEQ ID NO: 21495 - DNA, 930 bp, Artificial Sequence
  Description of Artificial Sequence: Synthetic coding sequence
atggccacccccaacaacctgacccccaccaactgcagctggtggcccatcagcgccctggagagcgacgccgccaagcccgccgaggcccccgacgcccccgaggccgccagccccgcccactggcccagagagagcctggtgctgtaccactggacccagagcttcagcagccagaaggtgagactggtgatcgccgagaagggcctggtgtgcgaggagagagacgtgagcctgccccagagcgagcacaaggagccctggttcatgagactgaacctgggcgaggaggtgcccgtgatcatccacagagacaacatcatcagcgactacgaccagatcatcgactacgtggagagaaccttcaccggcggccacctggccaacgccaccaccgacctgatgaagctggaccacgaggaggagccccagctgagcgagccctacctgagcaagcagaagaagctgatggccaagatcctggagcacgacgacgtgagctacctgaagaagatcctgggcgagctggccatggtgctggaccagatcgaggccgagctggagaagagaaagctggagaacgagggccagaagtgcgagctgtggctgtgcggctgcgccttcaccctggccgacgtgctgctgggcgccaccctgcacagactgaagttcctgggcctgagcaagaagtactgggaggacggcagcagacccaacctgcagagcttcttcgagagagtgcagagaagattcgccttcagaaaggtgctgggcgacatccacaccaccctgctgagcgccgtgatccccaacgccttcagactggtgaagagaaagccccccagcttcttcggcgccagcttcctgatgggcagcctgggcggcatgggctacttcgcctactggtacctgaagaagaagtacatctag

SEQ ID NO: 21496 - DNA, 1089 bp, Artificial Sequence
  Description of Artificial Sequence: Synthetic coding sequence
atggccacccccaacaacctgacccccaccaactgcagctggtggcccatcagcgccctggagagctgcggccaggccagcggcggccccagaagaagcagaggcggccagccccactggcccagagagagcctggtgctgtaccactggacccagagcttcagcagccagaaggtgagactggtgatcgccgagaagggcctggtgtgcgaggagagagacgtgagcctgccccagagcgagcacaaggagccctggttcatgagactgaacctgggcgaggaggtgcccgtgatcatccacagagacaacatcatcagcgactacgaccagatcatcgactacgtggagagaaccttcaccggcgagcacgtggtggccctgatgcccgaggtgggcagcctggccagaaccggcgccgccgtgagagagctgctggacgccctgcccatggacgcctacacccacggctgcatcctgcaccccgagctgaccaccgacagcatgatccccaagtacgccaccgccgagatcagaagacacctggccaacgccaccaccgacctgatgaagctggaccacgaggaggagccccagctgagcgagccctacctgagcaagcagaagaagctgatggccaagatcctggagcacgacgacgtgagctacctgaagaagatcctgggcgagctggccatggtgctggaccagatcgagggcgccggcgaggaggaggccggcgagagaggcgccgagatgagagccgtggccctgtggctgtgcctgcacgccgacgtgctgctgggcgccaccctgcacagactgaagttcctgggcctgagcaagaagtactgggaggacggcagcagacccaacctgcagagcttcttcgagagagtgcagagaagattcgccttcagaaaggtgctgggcgacatccacaccaccctgctgagcgccgtgatccccaacgccttcagactggtgaagagaaagccccccagcttcttcggcgccagcttcctgatgggcagcctgggcggcatgggctacttcgcctactggtacctgaagaagaagtacatctag

SEQ ID NO: 21497 - DNA, 444 bp, Artificial Sequence
  Description of Artificial Sequence: Synthetic coding sequence
atggccacccccaacaacctgacccccaccaactgcagctggtggcccatcagcgccctggagagcgacgccgccaagcccgccgaggcccccgacgcccccgaggccgccagccccgcccactggcccagagagagcctggtgctgtaccactggacccagagcttcagcagccagaaggtgagactggtgatcgccgagaagggcctggtgtgcgaggagagagacgtgagcctgccccagagcgagcacaaggagccctggttcatgagactgaacctgggcgaggaggtgcccgtgatcatccacagagacaacatcatcagcgactacgaccagatcatcgactacgtggagagaaccttcaccggcggccccagactggccgccagcctggagctgagaggcgccaaccccagaggccagctgggcagagcccagtag

SEQ ID NO: 21498 - DNA, 867 bp, Artificial Sequence
  Description of Artificial Sequence: Synthetic coding sequence
atggccacccccaacaacctgacccccaccaactgcagctggtggcccatcagcgccctggagagcgacgccgccaagcccgccgaggcccccgacgcccccgaggccgccagccccgcccactggcccagagagagcctggtgctgtaccactggacccagagcttcagcagccagaaggtgagactggtgatcgccgagaagggcctggtgtgcgaggagagagacgtgagcctgccccagagcgagcacaaggagccctggttcatgagactgaacctgggcgaggaggtgcccgtgatcatccacagagacaacatcatcagcgactacgaccagatcatcgactacgtggagagaaccttcaccggcggccacctggccaacgccaccaccgacctgatgaagctggaccacgaggaggagccccagctgagcgagccctacctgagcaagcagaagaagctgatggccaagatcctggagcacgacgacgtgagctacctgaagaagatcctgggcgagctggccatggtgctggaccagatcgaggccgagctggagaagagaaagctggagaacgagggccagaagtgcgagctgtggctgtgcggctgcgccttcaccctggccgacgtgctgctgggcgccaccctgcacagactgaagttcctgggcctgagcaagaagtactgggaggacggcagcagacccaacctgcagagcttcttcgagagagtgcagagaagattcgccttcagaaaggtgctgggcgacatccacaccaccctgctgagcgccgtgatccccaacgccttcagactggtgaagagaaagccccccagcttcttcggcgccagcttctag

SEQ ID NO: 21499 - DNA, 756 bp, Artificial Sequence
  Description of Artificial Sequence: Synthetic coding sequence
tgaagcttcagcagccagaaggtgagactggtgatcgccgagaagggcctggtgtgcgaggagagagacgtgagcctgccccagagcgagcacaaggagccctggttcatgagactgaacctgggcgaggaggtgcccgtgatcatccacagagacaacatcatcagcgactacgaccagatcatcgactacgtggagagaaccttcaccggcgagcacgtggtggccctgatgcccgaggtgggcagcctgcagcacgccagagtgctgcagtacagagagctgctggacgccctgcccatggacgcctacacccacggctgcatcctgcaccccgagctgaccaccgacagcatgatccccaagtacgccaccgccgagatcagaagacacctggccaacgccaccaccgacctgatgaagctggaccacgaggaggagccccagctgagcgagccctacctgagcaagcagaagaagctgatggccaagatcctggagcacgacgacgtgagctacctgaagaagatcctgggcgagctggccatggtgctggaccagatcgaggccgagctggagaagagaaagctggagaacgagggcggctgccagccctggggcagatggggcctgcagcccacccagcccaccctgcccctgcccagcctgagcctgttcttcccccagaagagccagagaaccagccaggtggtgaagagaatgggctacggcgtgagactgagattcaagagctag

SEQ ID NO: 21500 - DNA, 372 bp, Artificial Sequence
  Description of Artificial Sequence: Synthetic coding sequence
ctggagcacgacgacgtgagctacctgaagaagatcctgggcgagctggccatggtgctggaccagatcgaggccgagctggagaagagaaagctggagaacgagggccagaagtgcgagctgtggctgtgcggctgcgccttcaccctggccgacgtgctgctgggcgccaccctgcacagactgaagttcctgggcctgagcaagaagtactgggaggacggcagcagacccaacctgcagagcttcttcgagagagtgcagagaagattcgccttcagaaaggtgagcagatggaactgcggcgactggctgggcagcgagggcaccctgccccaggacaaggccgacatcaagacccagctgctgtag

SEQ ID NO: 21501 - DNA, 528 bp, Artificial Sequence
  Description of Artificial Sequence: Synthetic coding sequence
atgaagctggaccacgaggaggagccccagctgagcgagccctacctgagcaagcagaagaagctgatggccaagatcctggagcacgacgacgtgagctacctgaagaagatcctgggcgagctggccatggtgctggaccagatcgaggccgagctggagaagagaaagctggagaacgagggccagaagtgcgagctgtggctgtgcggctgcgccttcaccctggccgacgtgctgctgggcgccaccctgcacagactgaagttcctgggcctgagcaagaagtactgggaggacggcagcagacccaacctgcagagcttcttcgagagagtgcagagaagattcgccttcagaaaggtgctgggcgacatccacaccaccctgctgagcgccgtgatccccaacgccttcagactggtgaagagaaagccccccagcttcttcggcgccagcttcctgatgggcagcctgggcggcatgggctacttcgcctactggtacctgaagaagaagtacatctag

SEQ ID NO: 21502 - DNA, 1002 bp, Artificial Sequence
  Description of Artificial Sequence: Synthetic coding sequence
cccagaagaagcagaggcggccagccccactggcccagagagagcctggtgctgtaccactggacccagagcttcagcagccagaaggtgagactggtgatcgccgagaagggcctggtgtgcgaggagagagacgtgagcctgccccagagcgagcacaaggagccctggttcatgagactgaacctgggcgaggaggtgcccgtgatcatccacagagacaacatcatcagcgactacgaccagatcatcgactacgtggagagaaccttcaccggcgagcacgtggtggccctgatgcccgaggtgggcagcctggccagaaccggcgccgccgtgagagagctgctggacgccctgcccatggacgcctacacccacggctgcatcctgcaccccgagctgaccaccgacagcatgatccccaagtacgccaccgccgagatcagaagacacctggccaacgccaccaccgacctgatgaagctggaccacgaggaggagccccagctgagcgagccctacctgagcaagcagaagaagctgatggccaagatcctggagcacgacgacgtgagctacctgaagaagatcctgggcgagctggccatggtgctggaccagatcgagggcgccggcgaggaggaggccggcgagagaggcgccgagatgagagccgtggccctgtggctgtgcctgcacgccgacgtgctgctgggcgccaccctgcacagactgaagttcctgggcctgagcaagaagtactgggaggacggcagcagacccaacctgcagagcttcttcgagagagtgcagagaagattcgccttcagaaaggtgctgggcgacatccacaccaccctgctgagcgccgtgatccccaacgccttcagactggtgaagagaaagccccccagcttcttcggcgccagcttcctgatgggcagcctgggcggcatgggctacttcgcctactggtacctgaagaagaagtacatctag

SEQ ID NO: 21503 - DNA, 1302 bp, Artificial Sequence
  Description of Artificial Sequence: Synthetic coding sequence
atgggcgactggagcttcctgggcaacatcctggaggaggtgaacgagcacagcaccgtgatcggcagagtgtggctgaccgtgctgttcatcttcagaatcctgatcctgggcaccgccgccgagttcgtgtggggcgacgagcagagcgacttcgtgtgcaacacccagcagcccggctgcgagaacgtgtgctacgacgaggccttccccatcagccacatcagactgtgggtgctgcagatcatcttcgtgagcacccccagcctgatgtacgtgggccacgccgtgcactacgtgagaatggaggagaagagaaagagcagagaggccgaggagctgggccagcaggccggcaccaacggcggccccgaccagggcagcgtgaagaagagcagcggcagcaagggcaccaagaagttcagactggagggcaccctgctgagaacctacatctgccacatcatcttcaagaccctgttcgaggtgggcttcatcgtgggccactacttcctgtacggcttcagaatcctgcccctgtacagatgcagcagatggccctgccccaacgtggtggactgcttcgtgagcagacccaccgagaagaccatcttcatcctgttcatgctgagcgtggccagcgtgagcctgttcctgaacgtgatggagctgggccacctgggcctgaagggcatcagaagcgccctgaagagacccgtggagcagcccctgggcgagatccccgagaagagcctgcacagcatcgccgtgagcagcatccagaaggccaagggctaccagctgctggaggaggagaagatcgtgagccactacttccccctgaccgaggtgggcatggtggagaccagccccctgcccgccaagcccttcaaccagttcgaggagaagatcagcaccggccccctgggcgacctgagcagaggctaccaggagaccctgcccagctacgcccaggtgggcgcccaggaggtggagggcgagggcccccccgccgaggagggcgccgagcccgaggtgggcgagaagaaggaggaggccgagagactgaccaccgaggagcaggagaaggtggccgtgcccgagggcgagaaggtggagacccccggcgtggacaaggagggcgagaaggaggagccccagagcgagaaggtgagcaagcagggcctgcccgccgagaagacccccagcctgtgccccgagctgaccaccgacgacgccagacccctgagcagactgagcaaggccagcagcagagccagaagcgacgacctgaccgtgtag

SEQ ID NO: 21504 - DNA, 1455 bp, Artificial Sequence
  Description of Artificial Sequence: Synthetic coding sequence
atgggcagcgccttcgagagagtggtgagaagagtggtgcaggagctggaccacggcggcgagttcatccccgtgaccagcctgcagagcagcaccggcttccagccctactgcctggtggtgagaaagcccagcagcagctggttctggaagcccagatacaagtgcgtgaacctgagcatcaaggacatcctggagcccgacgccgccgagcccgacgtgcagagaggcagaagcttccacttctacgacgccatggacggccagatccagggcagcgtggagctggccgcccccggccaggccaagatcgccggcggcgccgccgtgagcgacagcagcagcaccagcatgaacgtgtacagcctgagcgtggaccccaacacctggcagaccctgctgcacgagagacacctgagacagcccgagcacaaggtgctgcagcagctgagaagcagaggcgacaacgtgtacgtggtgaccgaggtgctgcagacccagaaggaggtggaggtgaccagaacccacaagagagagggcagcggcagattcagcctgcccggcgccacctgcctgcagggcgagggccagggccacctgagccagaagaagaccgtgaccatccccagcggcagcaccctggccttcagagtggcccagctggtgatcgacagcgacctggacgtgctgctgttccccgacaagaagcagagaaccttccagccccccgccaccggccacaagagaagcaccagcgagggcgcctggccccagctgcccagcggcctgagcatgatgagatgcctgcacaacttcctgaccgacggcgtgcccgccgagggcgccttcaccgaggacttccagggcctgagagccgaggtggagaccatcagcaaggagctggagctgctggacagagagctgtgccagctgctgctggagggcctggagggcgtgctgagagaccagctggccctgagagccctggaggaggccctggagcagggccagagcctgggccccgtggagcccctggacggccccgccggcgccgtgctggagtgcctggtgctgagcagcggcatgctggtgcccgagctggccatccccgtggtgtacctgctgggcgccctgaccatgctgagcgagacccagcacaagctgctggccgaggccctggagagccagaccctgctgggccccctggagctggtgggcagcctgctggagcagagcgccccctggcaggagagaagcaccatgagcctgccccccggcctgctgggcaacagctggggcgagggcgcccccgcctgggtgctgctggacgagtgcggcctggagctgggcgaggacaccccccacgtgtgctgggagccccaggcccagggcagaatgtgcgccctgtacgccagcctggccctgctgagcggcctgagccaggagccccactag

SEQ ID NO: 21505 - DNA, 345 bp, Artificial Sequence
  Description of Artificial Sequence: Synthetic coding sequence
atgggcagcgccttcgagagagtggtgagaagagtggtgcaggagctggaccacggcggcgagttcatccccgtgaccagcctgcagagcagcaccggcttccagccctactgcctggtggtgagaaagcccagcagcagctggttctggaagcccagatacaagtgcgtgaacctgagcatcaaggacatcctggagcccgacgccgccgagcccgacgtgcagagaggcagaagcttccacttctacgacgccatggacggccagatccagggcagcgtggagctggccgcccccggccaggccaagatcgccggcggcgccgccgtgagcgacagcagctag

SEQ ID NO: 21506 - DNA, 1455 bp, Artificial Sequence; identical to SEQ ID NO: 21504
  Description of Artificial Sequence: Synthetic coding sequence

SEQ ID NO: 21507 - DNA, 147 bp, Artificial Sequence
  Description of Artificial Sequence: Synthetic coding sequence
atgggcagcgccttcgagagagtggtgagaagagtggtgcaggagctggaccacggcggcgagttcatccccgtgaccagcctgcagagcagcaccggcttccagccctactgcctggtggtgagaaagcccagcagcagctggtag

SEQ ID NO: 21508 - DNA, 495 bp, Artificial Sequence
  Description of Artificial Sequence: Synthetic coding sequence
atgggcagcgccttcgagagagtggtgagaagagtggtgcaggagctggaccacggcggcgagttcatccccgtgaccagcctgcagagcagcaccggcttccagccctactgcctggtggtgagaaagcccagcagcagctggttctggaagcccagatacaagtgcgtgaacctgagcatcaaggacatcctggagcccgacgccgccgagcccgacgtgcagagaggcagaagcttccacttctacgacgccatggacggccagatccagggcagcgtggagctggccgcccccggccaggccaagatcgccggcggcgccgccgtgagcgacagcagcagcaccagcatgaacgtgtacagcctgagcgtggaccccaacacctggcagaccctgctgcacgagagacacctgagacagcccgagcacaaggtgctgcagcagctgagaagcagaggcgacaacgtgtacgtggtgaccgaggtgctgtag

SEQ ID NO: 21509 - DNA, 465 bp, Artificial Sequence
  Description of Artificial Sequence: Synthetic coding sequence
atgggcagcgccttcgagagagtggtgagaagagtggtgcaggagctggaccacggcggcgagttcatccccgtgaccagcctgcagagcagcaccggcttccagccctactgcctggtggtgagaaagcccagcagcagctggttctggaagcccagatacaagtgcgtgaacctgagcatcaaggacatcctggagcccgacgccgccgagcccgacgtgcagagaggcagaagcttccacttctacgacgccatggacggccagatccagggcagcgtggagctggccgcccccggccaggccaagatcgccggcggcgccgccgtgagcgacagcagcagcaccagcatgaacgtgtacagcctgagcgtggaccccaacacctggcagaccctgctgcacgagagacacctgagacagcccgagcacaaggtgctgcagcagctgagaagcagaggctag

SEQ ID NO: 21510 - DNA, 810 bp, Artificial Sequence
  Description of Artificial Sequence: Synthetic coding sequence
atgcccctgggcctgaagcccacctgcagcgtgtgcaagaccaccagcagcagcatgtggaagaagggcgcccagggcgagatcctgtgccaccactgcaccggcagaggcggcgccggcagcggcggcgccggcagcggcgccgccggcggcaccggcggcagcggcggcggcggcttcggcgccgccaccttcgccagcaccagcgccacccccccccagagcaacggcggcggcggcggcaagcagagcaagcaggagatccacagaagaagcgccagactgagaaacaccaagtacaagagcgcccccgccgccgagaagaaggtgagcaccaagggcaagggcagaagacacatcttcaagctgaagaaccccatcaaggcccccgagagcgtgagcaccatcatcaccgccgagagcatcttctacaagggcgtgtactaccagatcggcgacgtggtgagcgtgatcgacgagcaggacggcaagccctactacgcccagatcagaggcttcatccaggaccagtactgcgagaagagcgccgccctgacctggctgatccccaccctgagcagccccagagaccagttcgaccccgccagctacatcatcggccccgaggaggacctgcccagaaagatggagtacctggagttcgtgtgccacgcccccagcgagtacttcaagagcagaagcagccccttccccaccgtgcccaccagacccgagaagggctacatctggacccacgtgggccccacccccgccatcaccatcaaggagagcgtggccaaccacctgtag

SEQ ID NO: 21511 - DNA, 990 bp, Artificial Sequence
  Description of Artificial Sequence: Synthetic coding sequence
atggagctgcacatcctggagcacagactgcaggtggccagcgtggccaacgagagcatccccctgttcacctacggcctgatcaagctggccttcctgagcagcaagaccagatgcaagttcttcagcctgaccgagacccccgaggactacaccatcatcgtggacgaggagggcttcctggagctgcccagcagcgagcacctgagcgtggccgacgccacctggctggccctgaacgtggtgagcggcggcggcagcttcagcagcagccagcccatcggcgtgaccaagatcgccaagagcgtgatcgcccccctggccgaccagaacatcagcgtgttcatgctgagcacctaccagaccgacttcatcctggtgagagagagagacctgcccttcgtgacccacaccctgagcagcgagttcaccatcctgagagtggtgaacggcgagaccgtggccgccgagaacctgggcatcaccaacggcttcgtgaagcccaagctggtgcagagacccgtgatccaccccctgagcagccccagcaacagattctgcgtgaccagcctggaccccgacaccctgcccgccgtggccaccctgctgatggacgtgatgttctacagcaacggcgtgaaggaccccatggccaccggcgacgactgcggccacatcagattcttcagcttcagcctgatcgagggctacatcagcctggtgatggacgtgcagacccagcagagattccccagcaacctgctgttcaccagcgccagcggcgagctgtggaagatggtgagaatcggcggccagcccctgggcttcgacgagtgcggcatcgtggcccagatcagcgagcccctggccgccgccgacatccccgcctactacatcagcaccttcaagttcgaccacgccctggtgcccgaggagaacatcaacggcgtgatcagcgccctgaaggtgagccaggccgagaagcactag

SEQ ID NO: 21512 - DNA, 990 bp, Artificial Sequence
  Description of Artificial Sequence: Synthetic coding sequence
atggagctgcacatcctggagcacagactgcaggtggccagcgtggccaaggagagcatccccctgttcacctacggcctgatcaagctggccttcctgagcagcaagaccagatgcaagttcttcagcctgaccgagacccccgaggactacaccatcatcgtggacgaggagggcttcctggagctgcccagcagcgagcacctgagcgtggccgacgccacctggctggccctgaacgtggtgagcggcggcggcagcttcagcagcagccagcccatcggcgtgaccaagatcgccaagagcgtgatcgcccccctggccgaccagaacatcagcgtgttcatgctgagcacctaccagaccgacttcatcctggtgagagagagagacctgcccttcgtgacccacaccctgagcagcgagttcaccatcctgagagtggtgaacggcgagaccgtggccgccgagaacctgggcatcaccaacggcttcgtgaagcccaagctggtgcagagacccgtgatccaccccctgagcagccccagcaacagattctgcgtgaccagcctggaccccgacaccctgcccgccgtggccaccctgctgatggacgtgatgttctacagcaacggcgtgaaggaccccatggccaccggcgacgactgcggccacatcagattcttcagcttcagcctgatcgagggctacatcagcctggtgatggacgtgcagacccagcagagattccccagcaacctgctgttcaccagcgccagcggcgagctgtggaagatggtgagaatcggcggccagcccctgggcttcgacgagtgcggcatcgtggcccagatcagcgagcccctggccgccgccgacatccccgcctactacatcagcaccttcaagttcgaccacgccctggtgcccgaggagaacatcaacggcgtgatcagcgccctgaaggtgagccaggccgagaagcactag

SEQ ID NO: 21513 - DNA, 990 bp, Artificial Sequence
  Description of Artificial Sequence: Synthetic coding sequence
atggagctgcacatcctggagcacagagtgagagtgctgagcgtggccagacccggcctgtggctgtacacccaccccctgatcaagctgctgttcctgcccagaagaagcagatgcaagttcttcagcctgaccgagacccccgaggactacaccctgatggtggacgaggagggcttcaaggagctgccccccagcgagttcctgcaggtggccgaggccacctggctggtgctgaacgtgagcagccacagcggcgccgccgtgcaggccgccggcgtgaccaagatcgccagaagcgtgatcgcccccctggccgagcaccacgtgagcgtgctgatgctgagcacctaccagaccgacttcatcctggtgagagagcaggacctgagcgtggtgatccacaccctggcccaggagttcgacatctacagagaggtgggcggcgagcccgtgcccgtgaccagagacgacagcagcaacggcttccccagaacccagcacggccccagccccaccgtgcaccccatccagagcccccagaacagattctgcgtgctgaccctggaccccgagaccctgcccgccatcgccaccaccctgatcgacgtgctgttctacagccacagcacccccaaggaggccgccagcagcagccccgagcccagcagcatcaccttcttcgccttcagcctgatcgagggctacatcagcatcgtgatggacgccgagacccagaagaagttccccagcgacctgctgctgaccagcagcagcggcgagctgtggagaatggtgagaatcggcggccagcccctgggcttcgacgagtgcggcatcgtggcccagatcgccggccccctggccgccgccgacatcagcgcctactacatcagcaccttcaacttcgaccacgccctggtgcccgaggacggcatcggcagcgtgatcgaggtgctgcagagaagacaggagggcctggccagctag

SEQ ID NO: 21514 - DNA, 492 bp, Artificial Sequence
  Description of Artificial Sequence: Synthetic coding sequence
atgagctgcagaggcagaggcgccggcggcagatggaacagcaccagctggagcaccggctgcaagctgcccgccagccccagaagagtgagcagatgcagccccaccggcctgatcaagctggccttcctgttcagcaagaccagatgcaagttcttcagcctgaccgagacccccgaggactacaccatcatcgtggacgaggagggcttcctggagctgcccagcagcgagcacctgagcgtggccgacgccacctggctggccctgaacgtggtgagcggcggcggcagcttcagcagcagccagcccatcggcatgaccaagatcgccaagagcgtgatcgcccccctggccgaccagaacatcagcgtgttcatgctgagcacctaccagaccgacttcatcctggtgctgaagagagacctgcccttcgtgacccacaccctgagcagcgagttcaccatcctgtggagcgtggccagactgtag

SEQ ID NO: 21515 - DNA, 1164 bp, Artificial Sequence
  Description of Artificial Sequence: Synthetic coding sequence
atgaaggccctgatcctggtgggcggctacggcaccagactgagacccctgaccctgagcacccccaagcccctggtggacttctgcaacaagcccatcctgctgcaccaggtggaggccctggccgccgccggcgtggaccacgtgatcctggccgtgagctacatgagccaggtgctggagaaggagatgaaggcccaggagcagagactgggcatcagaatcagcatgagccacgaggaggagcccctgggcaccgccggccccctggccctggccagagacctgctgagcgagaccgccgaccccttcttcgtgctgaacagcgacgtgatctgcgacttccccttccaggccatggtgcagttccacagacaccacggccaggagggcagcatcctggtgaccaaggtggaggagcccagcaagtacggcgtggtggtgtgcgaggccgacaccggcagaatccacagattcgtggagaagccccaggtgttcgtgagcaacaagatcaacgccggcatgtacatcctgagccccgccgtgctgcagagaatccagctgcagcccaccagcatcgagaaggaggtgttccccatcatggccaaggagggccagctgtacgccatggagctgcagggcttctggatggacatcggccagcccaaggacttcctgaccggcatgtgcctgttcctgcagagcctgagacagaagcagcccgagagactgtgcagcggccccggcatcgtgggcaacgtgctggtggaccccagcgccagaatcggccagaactgcagcatcggccccaacgtgagcctgggccccggcgtggtggtggaggacggcgtgtgcatcagaagatgcaccgtgctgagagacgccagaatcagaagccacagctggctggagagctgcatcgtgggctggagatgcagagtgggccagtgggtgagcctgtgggccggcctgggcggcgagagaggcggcgagtgcgcctgcctgcccgacaaggcctaccccctgctggaggtgagaatggagaacgtgaccgtgctgggcgaggacgtgatcgtgaacgacgagctgtacctgaacggcgccagcgtgctgccccacaagagcatcggcgagagcgtgcccgagcccagaatcatcatgtag

SEQ ID NO: 21516 - DNA, 1083 bp, Artificial Sequence
  Description of Artificial Sequence: Synthetic coding sequence
atgaaggccctgatcctggtgggcggctacggcaccagactgagacccctgaccctgagcacccccaagcccctggtggacttctgcaacaagcccatcctgctgcaccaggtggaggccctggccgccgccggcgtggaccacgtgatcctggccgtgagctacatgagccaggtgctggagaaggagatgaaggcccaggagcagagactgggcatcagaatcagcatgagccacgaggaggagcccctgggcaccgccggccccctggccctggccagagacctgctgagcgagaccgccgaccccttcttcgtgctgaacagcgacgtgatctgcgacttccccttccaggccatggtgcagttccacagacaccacggccaggagggcagcatcctggtgaccaaggtggaggagcccagcaagtacggcgtggtggtgtgcgaggccgacaccggcagaatccacagattcgtggagaagccccaggtgttcgtgagcaacaagatcaacgccggcatgtacatcctgagccccgccgtgctgcagagaatccagctgcagcccaccagcatcgagaaggaggtgttccccatcatggccaaggagggccagctgtacgccatggagctgcagggcttctggatggacatcggccagcccaaggacttcctgaccggcatgtgcctgttcctgcagagcctgagacagaagcagcccgagagactgtgcagcggccccggcatcgtgggcaacgtgctggtggaccccagcgccagaatcggccagaactgcagcatcggccccaacgtgagcctgggccccggcgtggtggtggaggacggcgtgtgcatcagaagatgcaccgtgctgagagacgccagaatcagaagccacagctggctggagagctgcatcgtgggctggagatgcagagtgggccagtgggtgagaatggagaacgtgaccgtgctgggcgaggacgtgatcgtgaacgacgagctgtacctgaacggcgccagcgtgctgccccacaagagcatcggcgagagcgtgcccgagcccagaatcatcatgtag

SEQ ID NO: 21517 - DNA, 1083 bp, Artificial Sequence; identical to SEQ ID NO: 21516
  Description of Artificial Sequence: Synthetic coding sequence

SEQ ID NO: 21518 - DNA, 555 bp, Artificial Sequence
  Description of Artificial Sequence: Synthetic coding sequence
atggacctgggccccctgaacatctgcgaggagatgaccatcctgcacggcggcttcctgctggccgagcagctgttccaccccaaggccctggccgagctgaccaagagcgactgggagagagtgggcagacccatcgtggaggccctgagagagatcagcagcgccgccgcccacagccagcccttcgcctggaagaagaaggccctgatcatcatctgggccaaggtgctgcagccccaccccgtgacccccagcgacaccgagaccagatggcaggaggacctgttcttcagcgtgggcaacatgatccccaccatcaaccacaccatcctgttcgagctgctgaagagcctggaggccagcggcctgttcatccagctgctgatggccctgcccaccaccatctgccacgccgagctggagagattcctggagcacgtgaccgtggacaccagcgccgaggacgtggccttcttcctggacgtgtggtgggagagaaccacccccagaagatgcctgcagccctgcatctggaccaactggcccagatag

SEQ ID NO: 21519 - DNA, 1188 bp, Artificial Sequence
  Description of Artificial Sequence: Synthetic coding sequence
atggacgaggagcccgagagaaccaagagatgggagggcggctacgagagaacctgggagatcctgaaggaggacgagagcggcagcctgaaggccaccatcgaggacatcctgttcaaggccaagagaaagagagtgttcgagcaccacggccaggtgagactgggcatgatgagacacctgtacgtggtggtggacggcagcagaaccatggaggaccaggacctgaagcccaacagactgacctgcaccctgaagctgctggagtacttcgtggaggagtacttcgaccagaaccccatcagccagatcggcatcatcgtgaccaagagcaagagagccgagaagctgaccgagctgagcggcaaccccagaaagcacatcaccagcctgaagaaggccgtggacatgacctgccacggcgagcccagcctgtacaacagcctgagcatcgccatgcagaccctgaagcacatgcccggccacaccagcagagaggtgctgatcatcttcagcagcctgaccacctgcgaccccagcaacatctacgacctgatcaagaccctgaaggccgccaagatcagagtgagcgtgatcggcctgagcgccgaggtgagagtgtgcaccgtgctggccagagagaccggcggcacctaccacgtgatcctggacgagagccactacaaggagctgctgacccaccacgtgagccccccccccgccagcagcagcagcgagtgcagcctgatcagaatgggcttcccccagcacaccatcgccagcctgagcgaccaggacgccaagcccagcttcagcatggcccacctggacggcaacaccgagcccggcctgaccctgggcggctacttctgcccccagtgcagagccaagtactgcgagctgcccgtggagtgcaagatctgcggcctgaccctggtgagcgccccccacctggccagaagctaccaccacctgttccccctggacgccttccaggagatccccctggaggagtacaacggcgagagattctgctacggctgccagggcgagctgaaggaccagcacgtgtacgtgtgcgccgtgtgccagaacgtgttctgcgtggactgcgacgtgttcgtgcacgacagcctgcactgctgccccggctgcatccacaagatccccgcccccagcggcgtgtag

SEQ ID NO: 21520 - DNA, 1188 bp, Artificial Sequence
  Description of Artificial Sequence: Synthetic coding sequence
atggacgaggagcccgagagaaccaagagatgggagggcggctacgagagaacctgggagatcctgaaggaggacgagagcggcagcctgaaggccaccatcgaggacatcctgttcaaggccaagagaaagagagtgttcgagcaccacggccaggtgagactgggcatgatgagacacctgtacgtggtggtggacggcagcagaaccatggaggaccaggacctgaagcccaacagactgacctgcaccctgaagctgctggagtacttcgtggaggagtacttcgaccagaaccccatcagccagatcggcatcatcgtgaccaagagcaagagagccgagaagctgaccgagctgagcggcaaccccagaaagcacatcaccagcctgaaggaggccgtggacatgacctgccacggcgagcccagcctgtacaacagcctgagcatggccatgcagaccctgaagcacatgcccggccacaccagcagagaggtgctgatcatcttcagcagcctgaccacctgcgaccccagcaacatctacgacctgatcaagaccctgaaggccgccaagatcagagtgagcgtgatcggcctgagcgccgaggtgagagtgtgcaccgtgctggccagagagaccggcggcacctaccacgtgatcctggacgagagccactacaaggagctgctgacccaccacctgagccccccccccgccagcagcagcagcgagtgcagcctgatcagaatgggcttcccccagcacaccatcgccagcctgagcgaccaggacgccaagcccagcttcagcatggcccacctggacggcaacaccgagcccggcctgaccctgggcggctacttctgcccccagtgcagagccaagtactgcgagctgcccgtggagtgcaagatctgcggcctgaccctggtgagcgccccccacctggccagaagctaccaccacctgttccccctggacgccttccaggagatccccctggaggagtacaacggcgagagattctgctacggctgccagggcgagctgaaggaccagcacgtgtacgtgtgcgccgtgtgccagaacgtgttctgcgtggactgcgacgtgttcgtgcacgacagcctgcactgctgccccggctgcatccacaagatccccgcccccagcggcgtgtag

SEQ ID NO: 21521 - DNA, 537 bp, Artificial Sequence
  Description of Artificial Sequence: Synthetic coding sequence
cagtacatctgcagcttcgaggactgcaagaagaccttcaagaagcaccagcagctgaagatccaccagtgccagcacaccaacgagcccctgttcaagtgcacccaggagggctgcggcaagcacttcgccagccccagcaagctgaagagacacgccaaggcccacgagggctacgtgtgccagaagggctgcagcttcgtggccaagacctggaccgagctgctgaagcacgtgagagagacccacaaggaggagagcagacccttcgtgtgcgagcacgccggctgcggcaagaccttcgccatgaagcagagcctgaccagacacgccgtggtgcacgaccccgacaagaagaagatgaagctgaaggtgaagaagagcagagagaagagaagcctggccagccacctgagcggctacatcccccccaagagaaagcagggccagggcctgagcctgtgccagaacggcgagagccccaactgcgtggaggacaagatgctgagcaccgtggccgtgctgaccctgggctag

SEQ ID NO: 21522 - DNA, 1098 bp, Artificial Sequence
  Description of Artificial Sequence: Synthetic coding sequence
ctggacccccccgccgtggtggccgagagcgtgagcagcctgaccatcgccgacgccttcatcgccgccggcgagagcagcgcccccaccccccccagacccgccctgcccagaagattcatctgcagcttccccgactgcagcgccaactacagcaaggcctggaagctggacgcccacctgtgcaagcacaccggcgagagacccttcgtgtgcgactacgagggctgcggcaaggccttcatcagagactaccacctgagcagacacatcctgacccacaccggcgagaagcccttcgtgtgcgccgccaacggctgcgaccagaagttcaacaccaagagcaacctgaagaagcacttcgagagaaagcacgagaaccagcagaagcagtacatctgcagcttcgaggactgcaagaagaccttcaagaagcaccagcagctgaagatccaccagtgccagcacaccaacgagcccctgttcaagtgcacccaggagggctgcggcaagcacttcgccagccccagcaagctgaagagacacgccaaggcccacgagggctacgtgtgccagaagggctgcagcttcgtggccaagacctggaccgagctgctgaagcacgtgagagagacccacaaggaggagatcctgtgcgaggtgtgcagaaagaccttcaagagaaaggactacctgaagcagcacatgaagacccacgcccccgagagagacgtgtgcagatgccccagagagggctgcggcagaacctacaccaccgtgttcaacctgcagagccacatcctgagcttccacgaggagagcagacccttcgtgtgcgagcacgccggctgcggcaagaccttcgccatgaagcagagcctgaccagacacgccgtggtgcacgaccccgacaagaagaagatgaagctgaaggtgaagaagagcagagagaagagaagcctggccagccacctgagcggctacatcccccccaagagaaagcagggccagggcctgagcctgtgccagaacggcgagagccccaactgcgtggaggacaagatgctgagcaccgtggccgtgctgaccctgggctag

SEQ ID NO: 21523 - DNA, 1089 bp, Artificial Sequence
  Description of Artificial Sequence: Synthetic coding sequence
atgagcgaccccagccagctgacccagaacgtgtgcctgacccaggagatggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccgccctgctgcacccccagagctggaagcagttcagagccctgagaagcagcggcaccgccgccgccaagggcgagagatgcagaagcttcatcgagctgaccccccccgccaagagagagatcctgtggctgagcctgggcacccagatcacctacatcggcctgcagttcatcagcttcctgctgctgctgaccgacctgctgctgaccggcaaccccgcctgcggcctgaagctgagcgccttcgccgccgtgagcagcgtgctgagcggcctgctgggcatggtggcccacatgatgtacagccaggtgttccaggccaccgtgaacctgggccccgaggactggagaccccacgtgtggaactacggctgggccttctacatggcctggctgagcttcacctgctgcatggccagcgccgtgaccaccttcaacacctacaccagaatggtgctggagttcaagtgcaagcacagcaagagcttcaaggagaaccccaactgcctgccccaccaccaccagtgcttccccagaagactgagcagcgccgcccccaccgtgggccccctgaccagctaccaccagtaccacaaccagcccatccacagcgtgagcgagggcgtggacttctacagcgagctgagaaacaagggcttccagagaggcgccagccaggagctgaaggaggccgtgagaagcagcgtggaggaggagcagtgctag

SEQ ID NO: 21524 - DNA, 981 bp, Artificial Sequence
  Description of Artificial Sequence: Synthetic coding sequence
atggccaagatggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccggcgagagatgcagaagcttcatcgagctgaccccccccgccaagagagagatcctgtggctgagcctgggcacccagatcacctacatcggcctgcagttcatcagcttcctgctgctgctgaccgacctgctgctgaccggcaaccccgcctgcggcctgaagctgagcgccttcgccgccgtgagcagcgtgctgagcggcctgctgggcatggtggcccacatgatgtacagccaggtgttccaggccaccgtgaacctgggccccgaggactggagaccccacgtgtggaactacggctgggccttctacatggcctggctgagcttcacctgctgcatggccagcgccgtgaccaccttcaacacctacaccagaatggtgctggagttcaagtgcaagcacagcaagagcttcaaggagaaccccaactgcctgccccaccaccaccagtgcttccccagaagactgagcagcgccgcccccaccgtgggccccctgaccagctaccaccagtaccacaaccagcccatccacagcgtgagcgagggcgtggacttctacagcgagctgagaaacaagggcttccagagaggcgccagccaggagctgaaggaggccgtgagaagcagcgtggaggaggagcagtgctag

SEQ ID NO: 21525 - DNA, 966 bp, Artificial Sequence
  Description of Artificial Sequence: Synthetic coding sequence
atgagcgaccccagccagctgacccagaacgtgtgcctgacccaggagatggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccgccctgctgcacccccagagctggaagcagttcagagccctgagaagcagcggcaccgccgccgccaagggcgagagatgcagaagcttcatcgagctgaccccccccgccaagagaggcgagaagggcctgctggagttcgccaccctgcagggcccctgccaccccaccctgagattcggcggcaagagactgatggagaaggccagcctgcccagcccccccctgggcctgtgcggcaagaaccccatggtgatccccggcaacgccgaccacctgcacagaaccagcatccaccagctgccccccgccaccaacagactggccacccactgggagccctgcctgtgggcccagaccgagagactgtgctgctgcttcctgtgccccgtgagaagccccggcgacggcggcccccacgacgtgttcaccagcctgcccagcgactgccagctgggcagcagaagactggagaccacctgcctggagctgtggctgggcctgctgcacggcctggccctgctgcacctgctgcacggcgtgggctgccaccacctgcagcacgtgcaccaggacggcgccggcgtgcaggtgcaggcctag

SEQ ID NO: 21526 - DNA, 858 bp, Artificial Sequence
  Description of Artificial Sequence: Synthetic coding sequence
atggccaagatggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccggcgagagatgcagaagcttcatcgagctgaccccccccgccaagagaggcgagaagggcctgctggagttcgccaccctgcagggcccctgccaccccaccctgagattcggcggcaagagactgatggagaaggccagcctgcccagcccccccctgggcctgtgcggcaagaaccccatggtgatccccggcaacgccgaccacctgcacagaaccagcatccaccagctgccccccgccaccaacagactggccacccactgggagccctgcctgtgggcccagaccgagagactgtgctgctgcttcctgtgccccgtgagaagccccggcgacggcggcccccacgacgtgttcaccagcctgcccagcgactgccagctgggcagcagaagactggagaccacctgcctggagctgtggctgggcctgctgcacggcctggccctgctgcacctgctgcacggcgtgggctgccaccacctgcagcacgtgcaccaggacggcgccggcgtgcaggtgcaggcctag

SEQ ID NO: 21527 - DNA, 888 bp, Artificial Sequence
  Description of Artificial Sequence: Synthetic coding sequence
atggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccgccctgctgcacccccagagctggaagcagttcagagccctgagaagcagcggcaccgccgccgccaagggcgagagatgcagaagcttcatcgagctgaccccccccgccaagagaggcctgctgggcatggtggcccacatgatgtacagccaggtgttccaggccaccgtgaacctgggccccgaggactggagaccccacgtgtggaactacggctgggccttctacatggcctggctgagcttcacctgctgcatggccagcgccgtgaccaccttcaacacctacaccagaatggtgctggagttcaagtgcaagcacagcaagagcttcaaggagaaccccaactgcctgccccaccaccaccagtgcttccccagaagactgagcagcgccgcccccaccgtgggccccctgaccagctaccaccagtaccacaaccagcccatccacagcgtgagcgagggcgtggacttctacagcgagctgagaaacaagggcttccagagaggcgccagccaggagctgaaggaggccgtgagaagcagcgtggaggaggagcagtgctag

SEQ ID NO: 21528 - DNA, 1023 bp, Artificial Sequence
  Description of Artificial Sequence: Synthetic coding sequence
atggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccggcgagagatgcagaagcttcatcgagctgaccccccccgccaagagaggcgagaagggcctgctggagttcgccaccctgcagggcccctgccaccccaccctgagattcggcggcaagagactgatggagaaggccagcctgcccagcccccccctgggcctgtgcggcaagaaccccatggtgatccccggcaacgccgaccacctgcacagaaccagcatccaccagctgccccccgccaccaacagactggccacccactgggagccctgcctgtgggcccagaccgagagactgtgctgctgcttcctgtgccccgtgagaagccccggcgacggcggcccccacgacgtgttcaccagcctgcccagcgactgccagctgggcagcagaagactggagaccacctgcctggagctgtggctgggcctgctgcacggcctggccctgctgcacctgctgcacggcgtgggctgccaccacctgcagcacgaccaccaccagtgcttccccagaagactgagcagcgccgcccccaccgtgggccccctgaccagctaccaccagtaccacaaccagcccatccacagcgtgagcgagggcgtggacttctacagcgagctgagaaacaagggcttccagagaggcgccagccaggagctgaaggaggccgtgagaagcagcgtggaggaggagcagtgctag

SEQ ID NO: 21529 - DNA, 1020 bp, Artificial Sequence
  Description of Artificial Sequence: Synthetic coding sequence
atgagcgaccccagccagctgacccagaacgtgtgcctgacccaggagatggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccggcgagagatgcagaagcttcatcgagctgaccccccccgccaagagagagatcctgtggctgagcctgggcacccagatcacctacatcggcctgcagttcatcagcttcctgctgctgctgaccgacctgctgctgaccggcaaccccgcctgcggcctgaagctgagcgccttcgccgccgtgagcagcgtgctgagcggcctgctgggcatggtggcccacatgatgtacagccaggtgttccaggccaccgtgaacctgggccccgaggactggagaccccacgtgtggaactacggctgggccttctacatggcctggctgagcttcacctgctgcatggccagcgccgtgaccaccttcaacacctacaccagaatggtgctggagttcaagtgcaagcacagcaagagcttcaaggagaaccccaactgcctgccccaccaccaccagtgcttccccagaagactgagcagcgccgcccccaccgtgggccccctgaccagctaccaccagtaccacaaccagcccatccacagcgtgagcgagggcgtggacttctacagcgagctgagaaacaagggcttccagagaggcgccagccaggagctgaaggaggccgtgagaagcagcgtggaggaggagcagtgctag

SEQ ID NO: 21530 - DNA, 828 bp, Artificial Sequence
  Description of Artificial Sequence: Synthetic coding sequence
atggccaagatggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccggcgagagatgcagaagcttcatcgagctgaccccccccgccaagagaggcctgctgggcatggtggcccacatgatgtacagccaggtgttccaggccaccgtgaacctgggccccgaggactggagaccccacgtgtggaactacggctgggccttctacatggcctggctgagcttcacctgctgcatggccagcgccgtgaccaccttcaacacctacaccagaatggtgctggagttcaagtgcaagcacagcaagagcttcaaggagaaccccaactgcctgccccaccaccaccagtgcttccccagaagactgagcagcgccgcccccaccgtgggccccctgaccagctaccaccagtaccacaaccagcccatccacagcgtgagcgagggcgtggacttctacagcgagctgagaaacaagggcttccagagaggcgccagccaggagctgaaggaggccgtgagaagcagcgtggaggaggagcagtgctag

SEQ ID NO: 21531 - DNA, 897 bp, Artificial Sequence
  Description of Artificial Sequence: Synthetic coding sequence
atggccaagatggagctgagcaaggccttcagcggccagagaaccctgctgagcgccatcctgagcatgctgagcctgagcttcagcaccaccagcctgctgagcaactactggttcgtgggcacccagaaggtgcccaagcccctgtgcgagaagggcctggccgccaagtgcttcgacatgcccgtgagcctggacggcgacaccaacaccagcacccaggaggtggtgcagtacaactgggagaccggcgacgacagattcagcttcagaagcttcagaagcggcatgtggctgagctgcgaggagaccgtggaggagcccgccctgctgcacccccagagctggaagcagttcagagccctgagaagcagcggcaccgccgccgccaagggcgagagatgcagaagcttcatcgagctgaccccccccgccaagagaggcctgctgggcatggtggcccacatgatgtacagccaggtgttccaggccaccgtgaacctgggccccgaggactggagaccccacgtgtggaactacggctgggccttctacatggcctggctgagcttcacctgctgcatggccagcgccgtgaccaccttcaacacctacaccagaatggtgctggagttcaagtgcaagcacagcaagagcttcaaggagaaccccaactgcctgccccaccaccaccagtgcttccccagaagactgagcagcgccgcccccaccgtgggccccctgaccagctaccaccagtaccacaaccagcccatccacagcgtgagcgagggcgtggacttctacagcgagctgagaaacaagggcttccagagaggcgccagccaggagctgaaggaggccgtgagaagcagcgtggaggaggagcagtgctag

SEQ ID NO: 21532 - DNA, 462 bp, Artificial Sequence
  Description of Artificial Sequence: Synthetic coding sequence
atgagcgagagcctggtggtgtgcgacgtggccgaggacctggtggagaagctgagaaagttcagattcagaaaggagaccaacaacgccgccatcatcatgaagatcgacaaggacaagagactggtggtgctggacgaggagctggagggcatcagccccgacgagctgaaggacgagctgcccgagagacagcccagattcatcgtgtacagctacaagtaccagcacgacgacggcagagtgagctaccccctgtgcttcatcttcagcagccccgtgggctgcaagcccgagcagcagatgatgtacgccggcagcaagaacaagctggtgcagaccgccgagctgaccaaggtgttcgagatcagaaacaccgaggacctgaccgaggagtggctgagagagaagctgttcttcaccaacgtgaacttctgcgtgagcaaggtgttcatgtactag

SEQ ID NO: 21533 - DNA, 429 bp, Artificial Sequence
  Description of Artificial Sequence: Synthetic coding sequence
atgagcgagagcctggtggtgtgcgacgtggccgaggacctggtggagaagctgagaaagttcagattcagaaaggagaccaacaacgccgccatcatcatgaagatcgacaaggacaagagactggtggtgctggacgaggagctggagggcatcagccccgacgagctgaaggacgagctgcccgagagacagcccagattcatcgtgtacagctacaagtaccagcacgacgacggcagagtgagctaccccctgtgcttcatcttcagcagccccgtgggctgcaagcccgagcagcagatgatgtacgccggcagcaagaacaagctggtgcagaccgccgagctgaccaaggtgttcgagatcagaaacaccgaggacctgaccgaggagtggctgagagagaagctgggcttcttccactag

SEQ ID NO: 21534 - DNA, 1785 bp, Artificial Sequence
  Description of Artificial Sequence: Synthetic coding sequence
atggccgtggaggagctgcagagcatcatcaagagatgccagatcctggaggagcaggacttcaaggaggaggacttcggcctgttccagctggccggccagagatgcatcgaggagggccacaccgaccagctgctggagatcatccagaacgagaagaacaaggtgatcatcaagaacatgggctggaacctggtgggccccgtggtgagatgcctgctgtgcaaggacaaggaggacagcaagagaaaggtgtacttcctgatcttcgacctgctggtgaagctgtgcaaccccaaggagctgctgctgggcctgctggagctgatcgaggagcccagcggcaagcagatcagccagagcatcctgctgctgctgcagcccctgcagaccgtgatccagaagctgcacaacaaggcctacagcatcggcctggccctgagcaccctgtggaaccagctgagcctgctgcccgtgccctacagcaaggagcagatccagatggacgactacggcctgtgccagtgctgcaaggccctgatcgagttcaccaagcccttcgtggaggaggtgatcgacaacaaggagaacagcctggagaacgagaagctgaaggacgagctgctgaagttctgcttcaagagcctgaagtgccccctgctgaccgcccagttcttcgagcagagcgaggagggcggcaacgaccccttcagatacttcgccagcgagatcatcggcttcctgagcgccatcggccaccccttccccaagatgatcttcaaccacggcagaaagaagagaacctggaactacctggagttcgaggaggaggagaacaagcagctggccgacagcatggccagcctggcctacctggtgttcgtgcagggcatccacatcgaccagctgcccatggtgctgagccccctgtacctgctgcagttcaacatgggccacatcgaggtgttcctgcagagaaccgaggagagcgtgatcagcaagggcctggagctgctggagaacagcctgctgagaatcgaggacaacagcctgctgtaccagtacctggagatcaagagcttcctgaccgtgccccagggcctggtgaaggtgatgaccctgtgccccatcgagaccctgagaaagaagagcctggccatgctgcagctgtacatcaacaagctggacagccagggcaagtacaccctgttcagatgcctgctgaacaccagcaaccacagcggcgtggaggccttcatcatccagaacatcaagaaccagatcgacatgagcctgaagagaaccagaaacaacaagtggttcaccggcccccagctgatcagcctgctggacctggtgctgttcctgcccgagggcgccgagaccgacctgctgcagaacagcgacagaatcatggccagcctgaacctgctgagatacctggtgatcaaggacaacgagaacgacaaccagaccggcctgtggaccgagctgggcaacatcgagaacaacttcctgaagcccctgcacatcggcctgaacatgagcaaggcccactacgaggccgagatcaagaacagccaggaggcccagaagagcaaggacctgtgcagcatcaccgtgagcggcgaggagatccccaacatgccccccgagatgcagctgaaggtgctgcacagcgccctgttcaccttcgacctgatcgagagcgtgctggccagagtggaggagctgatcgagatcaagaccaagagcaccagcgaggagaacatcggcatcaagtag

SEQ ID NO: 21535 - DNA, 1743 bp, Artificial Sequence
  Description of Artificial Sequence: Synthetic coding sequence
atggccgtggaggagctgcagagcatcatcaagagatgccagatcctggaggagcaggacttcaaggaggaggacttcggcctgttccagctggccggccagagatgcatcgaggagggccacaccgaccagctgctggagatcatccagaacgagaagaacaaggtgatcatcaagaacatgggctggaacctggtgggccccgtggtgagatgcctgctgtgcaaggacaaggaggacagcaagagaaaggtgtacttcctgatcttcgacctgctggtgaagctgtgcaaccccaaggagctgctgctgggcctgctggagctgatcgaggagcccagcggcaagcagatcagccagagcatcctgctgctgctgcagcccctgcagaccgtgatccagaagctgcacaacaaggcctacagcatcggcctggccctgagcaccctgtggaaccagctgagcctgctgcccgtgccctacagcaaggagcagatccagatggacgactacggcctgtgccagtgctgcaaggccctgatcgagttcaccaagcccttcgtggaggaggtgatcgacaacaaggagaacagcctggagaacgagaagctgaaggacgagctgctgaagttctgcttcaagagcctgaagtgccccctgctgaccgcccagttcttcgagcagagcgaggagggcggcaacgaccccttcagatacttcgccagcgagatcatcggcttcctgagcgccatcggccaccccttccccaagatgatcttcaaccacggcagaaagaagagaacctggaactacctggagttcgaggaggaggagaacaagcagctggccgacagcatggccagcctggcctacctggtgttcgtgcagggcatccacatcgaccagctgcccatggtgctgagccccctgtacctgctgcagttcaacatgggccacatcgaggtgttcctgcagagaaccgaggagagcgtgatcagcaagggcctggagctgctggagaacagcctgctgagaatcgaggacaacagcctgctgtaccagtacctggagatcaagagcttcctgaccgtgccccagagaaagaagagcctggccatgctgcagctgtacatcaacaagctggacagccagggcaagtacaccctgttcagatgcctgctgaacaccagcaaccacagcggcgtggaggccttcatcatccagaacatcaagaaccagatcgacatgagcctgaagagaaccagaaacaacaagtggttcaccggcccccagctgatcagcctgctggacctggtgctgttcctgcccgagggcgccgagaccgacctgctgcagaacagcgacagaatcatggccagcctgaacctgctgagatacctggtgatcaaggacaacgagaacgacaaccagaccggcctgtggaccgagctgggcaacatcgagaacaacttcctgaagcccctgcacatcggcctgaacatgagcaaggcccactacgaggccgagatcaagaacagccaggaggcccagaagagcaaggacctgtgcagcatcaccgtgagcggcgaggagatccccaacatgccccccgagatgcagctgaaggtgctgcacagcgccctgttcaccttcgacctgatcgagagcgtgctggccagagtggaggagctgatcgagatcaagaccaagagcaccagcgaggagaacatcggcatcaagtag

SEQ ID NO: 21536 - DNA, 768 bp, Artificial Sequence
  Description of Artificial Sequence: Synthetic coding sequence
aacggcaagaccgtgcaggtgctgcccagcgccctgagcaccatgttcggcatcgacagctgcccctactacgtgctggagaaccactacatcaccacccccctgagcaccgaggaggccgccttccccctggcctacgtgatgaccatcagccaggacttcgacaccttcgagtggctgttctgggccatctacatgccccagaacgtgtactgcatccacgtggacaaggccgccaccatcgacttcaagatcgccgtgagcgagctgctggagtgcttcagcaacgccttcatcagcagccagagcgagtacatcatctacggcggcaagagcagactgcaggccgacctggcctgcatgagagacctgatcgccagcaccgtgcagtggagatacgtgaccaacaccggcgaccacgacttccccctgaagaccaacagagagatcgtgcagtacctgaagaccatgaactggaccaacatcacccccaacctggtgagcgtgctgaagagcaccgagagaatcaagtacacccacagagagtacagaaccagagcccacgccttcgtgctgaagaagcacaagaagaagagccccccccccagacagctgaagatccacttcggcagcagctacgtggccctgaccagagagttcgtgcacttcgccctgtacaacaagatcgccatcgagctgctgcagagaagccaggacacctacagccccgacaagcacttctggatcaccctgaacaacatcccctag

SEQ ID NO: 21537 - DNA, 1176 bp, Artificial Sequence
  Description of Artificial Sequence: Synthetic coding sequence
atgaaggtgtggagctgctacctgtgcatcatcaccctgcagatcatcatcatcgtgaccgtgctgtacaacgtgcacgtgagccagcccgacagcggccagatcgacgacgtgggcggcgagtaccaggccctgagcagactgcacatctgcgacgccgccctgaacggcaagaccgtgcaggtgctgcccagcgccctgagcaccatgttcggcatcgacagctgcccctactacgtgctggagaaccactacatcaccacccccctgagcaccgaggaggccgccttccccctggcctacgtgatgaccatcagccaggacttcgacaccttcgagtggctgttctgggccatctacatgccccagaacgtgtactgcatccacgtggacaaggccgccaccatcgacttcaagatcgccgtgagcgagctgctggagtgcttcagcaacgccttcatcagcagccagagcgagtacatcatctacggcggcaagagcagactgcaggccgacctggcctgcatgagagacctgatcgccagcaccgtgcagtggagatacgtgaccaacaccggcgaccacgacttccccctgaagaccaacagagagatcgtgcagtacctgaagaccatgaactggaccaacatcacccccaacctggtgagcgtgctgaagagcaccgagagaatcaagtacacccacagagagtacagaaccagagcccacgccttcgtgctgaagaagcacaagaagaagagccccccccccagacagctgaagatccacttcggcagcagctacgtggccctgaccagagagttcgtgcacttcgccctgtacaacaagatcgccatcgagctgctgcagagaagccaggacacctacagccccgacaagcacttctggatcaccctgaacaacatccccgtggagtgcaccggcccctggatcctggccgtgaacagcggcagctgccagaacagacacatctgccccagaggcctggagttccagcagcagtaccccgtgaacagcttcggcggcaacaactgcagcatcgccgccggcaccgccgcccccagagaggccctgggccccttccacctgaaggccgcctgcagcgcccaccagaacaagtggggcttctggaactgctacctgcacctgaagtag

SEQ ID NO: 21538 - DNA, 909 bp, Artificial Sequence
  Description of Artificial Sequence: Synthetic coding sequence
atgtgcctgcagcccctgcaggagcagaagcagtgggccctggacggcgccgagtacagaaccatccaggccaactgcaccggcaccggcatcggctacaacatcatctgggtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccaccagactgaagaccaagggcgccggcaacggcaagggccccctgaagggccagcccagagacatctaccaccagacctgggccagatacatcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacggcacccaccacaacgtgagactgctgatgctggacgaccagagactgctgctgccccactgggccaaggtggtgctgaccgaccccgaggccgccaagtacgtgcacggcatcgccgtgcactggtacctggacttcctggcccccgccaaggccaccctgagagagacccaccacctgttccccaacaccatgctgttcgccagcgaggcctgcgtgggcagcaagttctgggagcagagcgtgagactgggcagctgggacagaggcatgcagtacagccacagcatcatcaccaacctgctgtaccacgtggtgggctggaccgactggaaccccagcctgtag

SEQ ID NO: 21539 - DNA, 1080 bp, Artificial Sequence
  Description of Artificial Sequence: Synthetic coding sequence
atgtgcctgcagcccctgcaggagcagaagcagtgggccctggacggcgccgagtacagaaccatccaggccaactgcaccggcaccggcatcggctacaacatcatctgggtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccaccagactgaagaccaagggcgccggcaacggcaagggccccctgaagggccagcccagagacatctaccaccagacctgggccagatacatcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacggcacccaccacaacgtgagactgctgatgctggacgaccagagactgctgctgccccactgggccaaggtggtgctgaccgaccccgaggccgccaagggcctgtgcggcttccaggtgctgggcgccgagtgcgccgccagactgctgggcagcagagacgccgtgcagccccagcaccaccacaagccccccgtgccctgcggcagactggacagactggagcccatcatcgtggacatcaccaagcacaccttctacaagcagcccatgttctaccacctgggccacttcagcaagttcatccccgagggcagccagagagtgggcctggtggccagccagaagaacgaccccgacgccgtggccctgatgcaccccgacggcagccccgtggtggtggtgctgaacagaagcagcaaggacgtgcccctgaccatcaaggaccccgccgtgggcttcctggagaccatcagccccggctacagcatccacacctacctgtggagaagacagtag

SEQ ID NO: 21540 - DNA, 1566 bp, Artificial Sequence
  Description of Artificial Sequence: Synthetic coding sequence
atgagcagcgacagcgacagacagtgccccgtggacggcgacatcgaccagcaggagatgatccccagcaagaagaacgccgtgctggtggacggcgtggtgctgaacggccccaccaccgacgccaaggccggcgagaagttcgtggaggaggcctgcagactgatcatggaggaggtggtgctgaaggccaccgacgtgaacgagaaggtgtgcgagtggagaccccccgagcagctgaagcagctgctggacctggagatgagagacagcggcgagcccccccacaagctgctggagctgtgcagagacgtgatccactacagcgtgaagaccaaccaccccagattcttcaaccagctgtacgccggcctggactactacagcctggtggccagattcatgaccgaggccctgaaccccagcgtgtacacctacgaggtgagccccgtgttcctgctggtggaggaggccgtgctgaagaagatgatcgagttcatcggctggaaggagggcgacggcatcttcaaccccggcggcagcgtgagcaacatgtacgccatgaacctggccagatacaagtactgccccgacatcaaggagaagggcctgagcggcagccccagactgatcctgttcaccagcgccgagtgccactacagcatgaagaaggccgccagcttcctgggcatcggcaccgagaacgtgtgcttcgtggagaccgacggcagaggcaagatgatccccgaggagctggagaagcaggtgtggcaggccagaaaggagggcgccgcccccttcctggtgtgcgccaccagcggcaccaccgtgctgggcgccttcgaccccctggacgagatcgccgacatctgcgagagacacagcctgtggctgcacgtggacgccagctggggcggcagcgccctgatgagcagaaagcacagaaagctgctgcacggcatccacagagccgacagcgtggcctggaacccccacaagatgctgatggccggcatccagtgctgcgccctgctggtgaaggacaagagcgacctgctgaagaagtgctacagcgccaaggccagctacctgttccagcaggacaagttctacgacgtgagctacgacaccggcgacaagagcatccagtgcagcagaagacccgacgccttcaagttctggatgacctggaaggccctgggcaccctgggcctggaggagagagtgaacagagccctggccctgagcagatacctggtggacgagatcaagaagagagagggcttcaagctgctgatggagcccgagtacgccaacatctgcttctggtacatcccccccagcctgagagagatggaggagggccccgagttctgggccaagctgaacctggtggcccccgccatcaaggagagaatgatgaagaagggcagcctgatgctgggctaccagccccacagaggcaaggtgaacttcttcagacaggtggtgatcagcccccaggtgagcagagaggacatggacttcctgctggacgagatcgacctgctgggcaaggacatgtag

SEQ ID NO: 21541 - DNA, 1116 bp, Artificial Sequence
  Description of Artificial Sequence: Synthetic coding sequence
atgagccacgagaagagcttcctggtgagcggcgacaactaccccccccccaaccccggctaccccggcggcccccagccccccatgcccccctacgcccagcccccctaccccggcgccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgttccccggccaggaccccgacagcccccagcacggcaactaccaggaggagggcccccccagctactacgacaaccaggacttccccgccaccaactgggacgacaagagcatcagacaggccttcatcagaaaggtgttcctggtgctgaccctgcagctgagcgtgaccctgagcaccgtgagcgtgttcaccttcgtggccgaggtgaagggcttcgtgagagagaacgtgtggacctactacgtgagctacgccgtgttcttcatcagcctgatcgtgctgagctgctgcggcgacttcagaagaaagcacccctggaacctggtggccctgagcgtgctgaccgccagcctgagctacatggtgggcatgatcgccagcttctacaacaccgaggccgtgatcatggccgtgggcatcaccaccgccgtgtgcttcaccgtggtgatcttcagcatgcagaccagatacgacttcaccagctgcatgggcgtgctgctggtgagcatggtggtgctgttcatcttcgccatcctgtgcatcttcatcagaaacagaatcctggagatcgtgtacgccagcctgggcgccctgctgttcacctgcttcctggccgtggacacccagctgctgctgggcaacaagcagctgagcctgagccccgaggagtacgtgttcgccgccctgaacctgtacaccgacatcatcaacatcttcctgtacatcctgaccatcatcggcagagccaaggagtag

SEQ ID NO: 21542 - DNA, 1332 bp, Artificial Sequence
  Description of Artificial Sequence: Synthetic coding sequence
atggccgcccacagaaagcacgtgttcgtggagaaggtgctgcagagactgttcccccccgtgcccagcggccagggcaagagagagccccagaccctggccgtgcagaacccccccaagaaggtgaccagcgagaaggtgagccagaagcacgccgagcccctgaccgacaccggcagcgagacccccaccgccagaagactgtacaccgccagcggcccccccgagggctacgtgccctgctggcccgagcccagcagctgcggcagccccgagaacgccagcagcggcgacgacaccgaggaccaggacccccacgaccagcccaagagaagaagaatcagaaagcacaagagcaagaagaagttcaagaaccccaacaacgtgctgatcgagcaggccgagctggagaagcagcagagcctgctgcaggagaagagccagagacagcacaccgacggcaccaccatcagcaagaacaagaagagaaagctgaagaagaagcagcagatcaagagaaagaaggccgccggcctggccgccaaggccgccggcgtgagcttcatgtaccagcccgaggacagcagcaacgagggcgagggcgtgggcgaggcctgcgaggaggacggcgtggacaccagcgaggaggaccccaccctggccggcgaggaggacgtgaaggacaccagagaggaggacggcgccgacgccagcgaggaggacctgaccagagccagacaggaggagggcgccgacgccagcgaggaggaccccacccccgccggcgaggaggacgtgaaggacgccagagaggaggacggcgtggacaccatcgaggaggacctgaccagagccggcgaggaggacggcaaggacaccagagaggaggacggcgccgacgccagcgaggaggaccccacctgggccggcgaggaggagggcgccgacagcggcgaggaggacggcgccgacgccagcgaggaggacgacaccatcaccaacgagaaggcccacagcatcctgaacttcctgaagagcacccaggagatgtacttctacgacggcgtgagcagagacgccgccagcgccgccctggccgacgccgccgaggagctgctggacagactggccagccacagcatgctgcccagcgacgtgagcatcctgtaccacatgaagaccctgctgctgctgcaggacaccgagagactgaagcacgccctggagatgttccccgagcactgcaccatgccccccgaccacgccagagtgatcagcgccttcttcagctactggatcacccacatcctgcccgagaagagcagcgactag

SEQ ID NO: 21543 - DNA, 1269 bp, Artificial Sequence
  Description of Artificial Sequence: Synthetic coding sequence
atggccgcccacagaaagcacgtgttcgtggagaaggtgctgcagagactgttcccccccgtgcccagcggccagggcaagagagagccccagaccctggccgtgcagaacccccccaagaaggtgaccagcgagaaggtgagccagaagcacgccgagcccctgaccgacaccggcagcgagacccccaccgccagaagactgtacaccgccagcggcccccccgagggctacgtgccctgctggcccgagcccagcagctgcggcagccccgagaacgccagcagcggcgacgacaccgaggaccaggacccccacgaccagcccaagagaagaagaatcagaaagcacaagagcaagaagaagttcaagaaccccaacaacgtgctgatcgagcaggccgagctggagaagcagcagagcctgctgcaggagaagagccagagacagcacaccgacggcaccaccatcagcaagaacaagaagagaaagctgaagaagaagcagcagatcaagagaaagaaggccgccggcctggccgccaaggccgccggcgtgagcttcatgtaccagcccgaggacagcagcaacgagggcgagggcgtgggcgaggcctgcgaggaggacggcgtggacaccagcgaggaggaccccaccctggccggcgaggaggacgtgaaggacaccagagaggaggacggcgccgacgccagcgaggaggacctgaccagagccagacaggaggagggcgccgacgccagcgaggaggaccccacccccgccggcgaggaggacgtgaaggacgccagagaggaggacggcgtggacaccatcgaggaggacctgaccagagccggcgaggaggacggcaaggacaccagagaggaggacggcgccgacgccagcgaggaggaccccacctgggccggcgaggaggagggcgccgacagcggcgaggaggacggcgccgacgccagcgaggaggacgacaccatcaccaacgagaaggcccacagcatcctgaacttcctgaagagcacccaggagatgtacttctacgacggcgtgagcagagacgccgccagcgccgccctggccgacgccgccgaggagctgctggacagactggccagccacagcatgctgcccagcgacgtgagcatcctgtaccacatgaagaccctgctgctgctgcaggacaccgagagactgaagcacgccctggagatgttccccgagcactgcaccatgccccccgccctgacctag

SEQ ID NO: 21544 - DNA, 3948 bp, Artificial Sequence
  Description of Artificial Sequence: Synthetic coding sequence
atgaacttcctgagcaccgccgagagcagaaccgcccaggccgccgccagcggcaccaccctgctgccccagttcagagcccccagctggcagaccggcatgcacagcagcgccgccaccgagctgttcgccaccggccccctgcccagcaccggcaccctgccccccagcctgagcgcctaccagcaccccaccaccttcagcaacagaaacttcgccaccaccagccccctggtgctgcaggacagcaccttcaacaccaccagcaacggcatcctgagccaccacgaccccctgctgcagatcaagaccagccagggcaccgtgcccaccgccctggccttcgagagactgggcagcagcgtgctgagcaacagcatccccccccagagcagcacctacagaagcgcccaggagagcgccccccacctgctgcagccccagttcagcctgctgcccagcgccctgggcggcagccagcagaccccccaggcctacagcagcaccctgttcaccagcagcaccgccagcatcgagagagccctgctgagagagtgcagcgtgatcaagcaccaccagagacccagcggcacccagagcatccaggcccagctgaccggcagccagcacagcctgcacagctacctgagcaacagcagcgtggtgaacttccaggagaccaccagacagagcagcctgagctgcagccccatcggcgacagcacccagaacctgcccgacagcagccccacccagaactacatcagcatgcacagcagccagaacgtgcagacccaggagagcagcagcccccagagccagaagttcctgcccgccgtgcagagcagcagcttcgccagcagcacccactgccagaccctgcagaacaacatcaccagccccgaccccaagagctacgccgagagaaagctggacagcgacgtgtaccccagcagcaagcaggaggacggcttccccatgcaggagctgcaggtgctgcagccccaggccagcctggagagcagcacccagagactgagcgacggcgagatcaacgcccaggagagcacctacaaggtgagcaaggccgacgacagatacagccagagcgtgatcagaagcaacagcagactggaggaccaggtgatcggcgtggccctgcaggccagcaagaaggaggagagcgtggtgggcagcgtgacccagctgaaccagcagatcggccaggtgaacaacgccgccaccctggacctgaagaacagcaccaacctgatccagaccccccagatcagactgaacaccaaggacctgaagcagcagcaccccctgatcctgaaggtgcacgagagcaaggtgcaggagcagcacgaccagatcatcaacgccagcagccagatccagatccccaaccacgccctgggccacggccaccaggccagcctgcccaacacccaggtgctgctggacagcgcctgcgacctgcagatcctgcagcagagcatcctgcaggccggcctgggccaggtgaaggccagcctgcaggcccagagagtgcagagcccccagcagatcgtgcaccccttcctgcagatggagggccacgtgatccagagcaacggcgaccacagccagcagcagctgcacccccagaacagcgaggtgatgaagatggacctgagcgagagcagcaagcccctgcagcagcacctgaccaccaagggccacttcagcgagaccaaccagcacgacagcaagaaccagttcgtgagcctgggcagcatgtgcttccccgaggccgtgctgctgagcgacgagagaaacatcctgagcaacgtggacgacatcctggccgccaccgccgccgcctgcggcgtgacccccaccgacttcagcaagagcaccagcaacgagaccatgcaggccgtggaggacggcgacagcaagagccacttccagcagagcctggacgtgagacacgtgaccagcgacttcaacagcatgaccgccaccgtgggcaagccccagaacatcaacgacaccagcctgaacggcaaccaggtgaccgtgaacctgagccccgtgcccgccctgcagagcaagatgaccctggaccagcagcacatcgagacccccggccagaacatccccaccaaggtgaccagcgccgtggtgggccccagccacgaggtgcaggagcagagcagcggccccttcaagaagcagagcgccaccaacctggagagcgaggaggacagcgaggcccccgtggacagcaccctgaacaacaacagaaaccaggagttcgtgagcagcagcagaagcatcagcggcgagaacgccaccagcgagagcgagttcaccctgggcggcgacgacagcggcgtgagcatgaaccccgccagaagcgccctggccctgctggccatggcccagagcggcgacgccgtgagcgtgaagatcgaggaggagaaccaggacctgatgcacttcaacctgcagaagaagagagccaagggcaagggccaggtgaaggaggaggacaacagcaaccagaagcagctgaagagacccgcccagggcaagagacagaaccccagaggcaccgacatctacctgccctacaccccccccagcagcgagagctgccacgacggctaccagcaccaggagaagatgagacagaagatcaaggaggtggaggagaagcagcccgaggtgaagaccggcttcatcgccagcttcctggacttcctgaagagcggccccaagcagcagttcagcaccctggccgtgagaatgcccaacagaaccagaagacccggcacccagatggtgagaaccttctgccccccccccctgcccaagcccagcagcaccacccccacccccctggtgagcgagaccggcggcaacagccccagcgacaaggtggacaacgagctgaagaacctggagcacctgagcagcttcagcagcgacgaggacgaccccggctacagccaggacgcctacaagagcgtgagcacccccctgaccaccctggacgccaccagcgacaagaagaagaagaccgaggccctgcaggtggccaccaccagccccaccgccaacaccaccggcaccgccaccaccagcagcaccaccgtgggcgccgtgaagcaggagcccctgcacagcaccagctacgccgtgaacatcctggagaacatcagcagcagcgagagcagcaagcccatcgagctggacggcctgcccagcgaccagttcgccaagggccaggacaccgtggccatcgagggcttcaccgacgaggaggacaccgagagcggcggcgagggccagtacagagagagagacgagttcgtggtgaagatcgaggacatcgagaccttcaaggaggccctgaagaccggcaaggagccccccgccatctggaaggtgcagaaggccctgctgcagaagttcgtgcccgagatcagagacggccagagagagttcgccgccaccaacagctacctgggctacttcggcgacgccaagagcaagtacaagagaatctacgtgaagttcatcgagaacgccaacaagaaggagtacgtgagagtgtgcagcaagaagcccagaaacaagcccagccagaccatcagaaccgtgcaggccaagcccagcagcagcagcaagaccagcgaccccctggccagcaagaccaccaccaccaaggcccccagcgtgaagcccaaggtgaagcagcccaaggtgaaggccgagcccccccccaagaagagaaagaagtggaaggaggagttcagcagcagccagagcgacagcagccccgagatccacaccagcagcagcgacgacgaggagttcgagccccccgcccccttcgtgaccagattcctgaacaccagagccatgaaggagaccttcaagagctacatggagtag

SEQ ID NO: 21545 - DNA, 5208 bp, Artificial Sequence
  Description of Artificial Sequence: Synthetic coding sequence
atgaacttcctgagcaccgccgagagcagaaccgcccaggccgccgccagcggcaccaccctgctgccccagttcagagcccccagctggcagaccggcatgcacagcagcgccgccaccgagctgttcgccaccggccccctgcccagcaccggcaccctgccccccagcctgagcgcctaccagcaccccaccaccttcagcaacagaaacttcgccaccaccagccccctggtgctgcaggacagcaccttcaacaccaccagcaacggcatcctgagccaccacgaccccctgctgcagatcaagaccagccagggcaccgtgcccaccgccctggccttcgagagactgggcagcagcgtgctgagcaacagcatccccccccagagcagcacctacagaagcgcccaggagagcgccccccacctgctgcagccccagttcagcctgctgcccagcgccctgggcggcagccagcagaccccccaggcctacagcagcaccctgttcaccagcagcaccgccagcatcgagagagccctgctgagagagtgcagcgtgatcaagcaccaccagagacccagcggcacccagagcatccaggcccagctgaccggcagccagcacagcctgcacagctacctgagcaacagcagcgtggtgaacttccaggagaccaccagacagagcagcctgagctgcagccccatcggcgacagcacccaggtgagcaacggcggcctgcagcagaagaccagccaggtgagcgtggagctggcccagagctacagcagcgccatccccagcagcggctacccccccagcaccaccaagatcaagagctgcagcaccgagcagcccctgaccagcaccaagacccccaagccccagagcatcatcccccccgtgcagaccctgagctacagcaagcccctgcacaaccagagcagcgtgatcagcggccaggcccagatctacagcaccgcccagctgcccagcctgctgagcgtgagccagagccagaactacggcctggtgcagccccacaacgtgcccagcatcgtgcacagccaggtgtacagaagcagcaaggtggagaagctgccccccctgtacaagaccctgaccttcagcggcagcagccagaccgtgacccccgagaaccagaccctgaactacagcagcaaccagcaggaggtgctgagcagcgtgaccaacgagaactaccccgcccagaccagagacctgagcagcgtgagccagagccagagctacagcagcggccacagccagggcctgagccccgtgagccagacccaggtgagctacagcagccagagccaggtgctgagcgtggtgagcctgagcgagagctacgccagcggcgagagcctgaccctgaccgcccccagcctgagctacagcagcgccagcagagcccagaacctgcccgacagcagccccacccagaactacatcagcatgcacagcagccagaacgtgcagacccaggagagcagcagcccccagagccagaagttcctgcccgccgtgcagagcagcagcttcgccagcagcacccactgccagaccctgcagaacaacatcaccagccccgaccccaagagctacgccgagagaaagctggacagcgacgtgtaccccagcagcaagcaggaggacggcttccccatgcaggagctgcaggtgctgcagccccaggccagcctggagagcagcacccagagactgagcgacggcgagatcaacgcccaggagagcacctacaaggtgagcaaggccgacgacagatacagccagagcgtgatcagaagcaacagcagactggaggaccaggtgatcggcgtggccctgcaggccagcaagaaggaggagagcgtggtgggcagcgtgacccagctgaaccagcagatcggccaggtgaacaacgccgccaccctggacctgaagaacagcaccaacctgatccagaccccccagatcagactgaacaccaaggacctgaagcagcagcaccccctgatcctgaaggtgcacgagagcaaggtgcaggagcagcacgaccagatcatcaacgccagcagccagatccagatccccaaccacgccctgggccacggccaccaggccagcctgcccaacacccaggtgctgctggacagcgcctgcgacctgcagatcctgcagcagagcatcctgcaggccggcctgggccaggtgaaggccagcctgcaggcccagagagtgcagagcccccagcagatcgtgcaccccttcctgcagatggagggccacgtgatccagagcaacggcgaccacagccagcagcagctgcacccccagaacagcgaggtgatgaagatggacctgagcgagagcagcaagcccctgcagcagcacctgaccaccaagggccacttcagcgagaccaaccagcacgacagcaagaaccagttcgtgagcctgggcagcatgtgcttccccgaggccgtgctgctgagcgacgagagaaacatcctgagcaacgtggacgacatcctggccgccaccgccgccgcctgcggcgtgacccccaccgacttcagcaagagcaccagcaacgagaccatgcaggccgtggaggacggcgacagcaagagccacttccagcagagcctggacgtgagacacgtgaccagcgacttcaacagcatgaccgccaccgtgggcaagccccagaacatcaacgacaccagcctgaacggcaaccaggtgaccgtgaacctgagccccgtgcccgccctgcagagcaagatgaccctggaccagcagcacatcgagacccccggccagaacatccccaccaaggtgaccagcgccgtggtgggccccagccacgaggtgcaggagcagagcagcggccccttcaagaagcagagcgccaccaacctggagagcgaggaggacagcgaggcccccgtggacagcaccctgaacaacaacagaaaccaggagttcgtgagcagcagcagaagcatcagcggcgagaacgccaccagcgagagcgagttcaccctgggcggcgacgacagcggcgtgagcatgaaccccgccagaagcgccctggccctgctggccatggcccagagcggcgacgccgtgagcgtgaagatcgaggaggagaaccaggacctgatgcacttcaacctgcagaagaagagagccaagggcaagggccaggtgaaggaggaggacaacagcaaccagaagcagctgaagagacccgcccagggcaagagacagaaccccagaggcaccgacatctacctgccctacaccccccccagcagcgagagctgccacgacggctaccagcaccaggagaagatgagacagaagatcaaggaggtggaggagaagcagcccgaggtgaagaccggcttcatcgccagcttcctggacttcctgaagagcggccccaagcagcagttcagcaccctggccgtgagaatgcccaacagaaccagaagacccggcacccagatggtgagaaccttctgccccccccccctgcccaagcccagcagcaccacccccacccccctggtgagcgagaccggcggcaacagccccagcgacaaggtggacaacgagctgaagaacctggagcacctgagcagcttcagcagcgacgaggacgaccccggctacagccaggacgcctacaagagcgtgagcacccccctgaccaccctggacgccaccagcgacaagaagaagaagaccgaggccctgcaggtggccaccaccagccccaccgccaacaccaccggcaccgccaccaccagcagcaccaccgtgggcgccgtgaagcaggagcccctgcacagcaccagctacgccgtgaacatcctggagaacatcagcagcagcgagagcagcaagcccatcgagctggacggcctgcccagcgaccagttcgccaagggccaggacaccgtggccatcgagggcttcaccgacgaggaggacaccgagagcggcggcgagggccagtacagagagagagacgagttcgtggtgaagatcgaggacatcgagaccttcaaggaggccctgaagaccggcaaggagccccccgccatctggaaggtgcagaaggccctgctgcagaagttcgtgcccgagatcagagacggccagagagagttcgccgccaccaacagctacctgggctacttcggcgacgccaagagcaagtacaagagaatctacgtgaagttcatcgagaacgccaacaagaaggagtacgtgagagtgtgcagcaagaagcccagaaacaagcccagccagaccatcagaaccgtgcaggccaagcccagcagcagcagcaagaccagcgaccccctggccagcaagaccaccaccaccaaggcccccagcgtgaagcccaaggtgaagcagcccaaggtgaaggccgagcccccccccaagaagagaaagaagtggaaggaggagttcagcagcagccagagcgacagcagccccgagatccacaccagcagcagcgacgacgaggagttcgagccccccgcccccttcgtgaccagattcctgaacaccagagccatgaaggagaccttcaagagctacatggagctgctggtgagcatcgccctggaccccgacaccatgcaggccctggagaagagcaacgacgagctgctgctgccccacatgaagaagatcgacggcatgctgaacgacaacagaaagagactgctgctgaacctgcacctggaccagagcttcaagaacgccctggagagcttccccgagctgaccatcatcaccagagacagcaaggccaagagcggcggcaccgccatcagcaagatcaagatgaacggcaaggcctacaacaagaagaccctgagaaccagcaagaccaccaccaagagcgcccaggagttcgccgtggaccccgagaagatccagctgtacagcctgtaccacagcctgcaccactacaagtaccacgtgtacctgatctgcaaggacgagatcagcagcgtgcagaagaagaacgaggacctgggccaggaggagatcgtgcagctgtgcatgaagaacgtgaagtgggtggaggacctgttcgagaagttcggcgagctgctgaaccacgtgcagcagaagtgcagctag

SEQ ID NO: 21546 - DNA, 195 bp, Artificial Sequence
  Description of Artificial Sequence: Synthetic coding sequence
atgaacttcctgagcaccgccgagagcagaaccgcccaggccgccgccagcggcaccaccctgctgccccagttcagagcccccagctggcagaccggcatgcacagcagcgccgccaccgagctgttcgccaccggccccctgcccagcaccggcaccctgccccccagcctgagcgcctaccagcacccctag

SEQ ID NO: 21547 - DNA, 4992 bp, Artificial Sequence
  Description of Artificial Sequence: Synthetic coding sequence
atgaaggacgccgccgaggagctgagcttcgccagagtgctgctgcagagagtggacgagctggagaagctgttcaaggacagagagcagttcctggagctggtgagcagaaagctgagcctggtgcccggcgccgaggaggtgaccatggtgacctgggaggagctggagcaggccatcaccgacggctggagagccagccaggccggcagcgagaccctgatgggcttcagcaagcacggcggcttcaccagcctgaccagccccgagggcaccctgagcggcgacagcaccaagcagcccagcatcgagcaggccctggacagcgccagcggcctgggccccgacagaaccgccagcggcagcggcggcaccgcccaccccagcgacggcgtgagcagcagagagcagagcaaggtgcccagcggcaccggcagacagcagcagcccagagccagagacgaggccggcgtgcccagactgcaccagagcagcaccttccagttcaagagcgacagcgacagacacagaagcagagagaagctgaccagcacccagcccagaagaaacgccagacccggccccgtgcagcaggacctgcccctggccagagaccagcccagcagcgtgcccgccagccagagccaggtgcacctgagacccgacagaagaggcctggagcccaccggcatgaaccagcccggcctggtgcccgccagcacctacccccacggcgtggtgcccctgagcatgggccagctgggcgtgcccccccccgagatggacgacagagagctgatccccttcgtggtggacgagcagagaatgctgccccccagcgtgcccggcagagaccagcagggcctggagctgcccagcaccgaccagcacggcctggtgagcgtgagcgcctaccagcacggcatgaccttccccggcaccgaccagagaagcatggagcccctgggcatggaccagagaggctgcgtgatcagcggcatgggccagcagggcctggtgccccccggcatcgaccagcagggcctgaccctgcccgtggtggaccagcacggcctggtgctgcccttcaccgaccagcacggcctggtgagccccggcctgatgcccatcagcgccgaccagcagggcttcgtgcagcccagcctggaggccaccggcttcatccagcccggcaccgagcagcacgacctgatccagagcggcagattccagagagccctggtgcagagaggcgcctaccagcccggcctggtgcagcccggcgccgaccagagaggcctggtgagacccggcatggaccagagcggcctggcccagcccggcgccgaccagagaggcctggtgtggcccggcatggaccagagcggcctggcccagcccggcagagaccagcacggcctgatccagcccggcaccggccagcacgacctggtgcagagcggcaccggccagggcgtgctggtgcagcccggcgtggaccagcccggcatggtgcagcccggcagattccagagagccctggtgcagcccggcgcctaccagcccggcctggtgcagcccggcgccgaccagatcgacgtggtgcagcccggcgccgaccagcacggcctggtgcagagcggcgccgaccagagcgacctggcccagcccggcgccgtgcagcacggcctggtgcagcccggcgtggaccagagaggcctggcccagcccagagccgaccaccagagaggcctggtgccccccggcgccgaccagagaggcctggtgcagcccggcgccgaccagcacggcctggtgcagcccggcgtggaccagcacggcctggcccagcccggcgaggtgcagagaagcctggtgcagcccggcatcgtgcagagaggcctggtgcagcccggcgccgtgcagagaggcctggtgcagcccggcgccgtgcagagaggcctggtgcagcccggcgtggaccagagaggcctggtgcagcccggcgccgtgcagagaggcctggtgcagcccggcgccgtgcagcacggcctggtgcagcccggcgccgaccagagaggcctggtgcagcccggcgtggaccagagaggcctggtgcagcccggcgtggaccagagaggcctggtgcagcccggcatggaccagagaggcctgatccagcccggcgccgaccagcccggcctggtgcagcccggcgccggccagctgggcatggtgcagcccggcatcggccagcagggcatggtgcagccccaggccgacccccacggcctggtgcagcccggcgcctaccccctgggcctggtgcagcccggcgcctacctgcacgacctgagccagagcggcacctaccccagaggcctggtgcagcccggcatggaccagtacggcctgagacagcccggcgcctaccagcccggcctgatcgcccccggcaccaagctgagaggcagcagcaccttccaggccgacagcaccggcttcatcagcgtgagaccctaccagcacggcatggtgccccccggcagagagcagtacggccaggtgagccccctgctggccagccagggcctggccagccccggcatcgacagaagaagcctggtgccccccgagacctaccagcagggcctgatgcaccccggcaccgaccagcacagccccatccccctgagcaccggcctgggcagcacccaccccgaccagcagcacgtggccagccccggccccggcgagcacgaccaggtgtaccccgacgccgcccagcacggccacgccttcagcctgttcgacagccacgacagcatgtaccccggctacagaggccccggctacctgagcgccgaccagcacggccaggagggcctggaccccaacagaaccagagccagcgacagacacggcatccccgcccagaaggcccccggccaggacgtgaccctgttcagaagccccgacagcgtggacagagtgctgagcgagggcagcgaggtgagcagcgaggtgctgagcgagagaagaaacagcctgagaagaatgagcagcagcttccccaccgccgtggagaccttccacctgatgggcgagctgagcagcctgtacgtgggcctgaaggagagcatgaaggacctggacgaggagcaggccggccagaccgacctggagaagatccagttcctgctggcccagatggtgaagagaaccatcccccccgagctgcaggagcagctgaagaccgtgaagaccctggccaaggaggtgtggcaggagaaggccaaggtggagagactgcagagaatcctggagggcgagggcaaccaggaggccggcaaggagctgaaggccggcgagctgagactgcagctgggcgtgctgagagtgaccgtggccgacatcgagaaggagctggccgagctgagagagagccaggacagaggcaaggccgccatggagaacagcgtgagcgaggccagcctgtacctgcaggaccagctggacaagctgagaatgatcatcgagagcatgctgaccagcagcagcaccctgctgagcatgagcatggccccccacaaggcccacaccctggcccccggccagatcgaccccgaggccacctgccccgcctgcagcctggacgtgagccaccaggtgagcaccctggtgagaagatacgagcagctgcaggacatggtgaacagcctggccgtgagcagacccagcaagaaggccaagctgcagagacaggacgaggagctgctgggcagagtgcagagcgccatcctgcaggtgcagggcgactgcgagaagctgaacatcaccaccagcaacctgatcgaggaccacagacagaagcagaaggacatcgccatgctgtaccagggcctggagaagctggagaaggagaaggccaacagagagcacctggagatggagatcgacgtgaaggccgacaagagcgccctggccaccaaggtgagcagagtgcagttcgacgccaccaccgagcagctgaaccacatgatgcaggagctggtggccaagatgagcggccaggagcaggactggcagaagatgctggacagactgctgaccgagatggacaacaagctggacagactggagctggaccccgtgaagcagctgctggaggacagatggaagagcctgagacagcagctgagagagagaccccccctgtaccaggccgacgaggccgccgccatgagaagacagctgctggcccacttccactgcctgagctgcgacagacccctggagacccccgtgaccggccacgccatccccgtgacccccgccggccccggcctgcccggccaccacagcatcagaccctacaccgtgttcgagctggagcaggtgagacagcacagcagaaacctgaagctgggcagcgccttccccagaggcgacctggcccagatggagcagagcgtgggcagactgagaagcatgcacagcaagatgctgatgaacatcgagaaggtgcagatccacttcggcggcagcaccaaggccagcagccagatcatcagagagctgctgcacgcccagtgcctgggcagcccctgctacaagagagtgaccgacatggccgactacacctacagcaccgtgcccagaagatgcggcggcagccacaccctgacctacccctaccacagaagcagaccccagcacctgcccagaggcctgtaccccaccgaggagatccagatcgccatgaagcacgacgaggtggacatcctgggcctggacggccacatctacaagggcagaatggacaccagactgcccggcatcctgagaaaggacagcagcggcaccagcaagagaaagagccagcagcccagaccccacgtgcacagaccccccagcctgagcagcaacggccagctgcccagcagaccccagagcgcccagatcagcgccggcaacaccagcgagagatag

SEQ ID NO: 21548 - DNA, 4290 bp, Artificial Sequence
  Description of Artificial Sequence: Synthetic coding sequence
atgaaggacgccgccgaggagctgagcttcgccagagtgctgctgcagagagtggacgagctggagaagctgttcaaggacagagagcagttcctggagctggtgagcagaaagctgagcctggtgcccggcgccgaggaggtgaccatggtgacctgggaggagctggagcaggccatcaccgacggctggagagccagccaggccggcagcgagaccctgatgggcttcagcaagcacggcggcttcaccagcctgaccagccccgagggcaccctgagcggcgacagcaccaagcagcccagcatcgagcaggccctggacagcgccagcggcctgggccccgacagaaccgccagcggcagcggcggcaccgcccaccccagcgacggcgtgagcagcagagagcagagcaaggtgcccagcggcaccggcagacagcagcagcccagagccagagacgaggccggcgtgcccagactgcaccagagcagcaccttccagttcaagagcgacagcgacagacacagaagcagagagaagctgaccagcacccagcccagaagaaacgccagacccggccccgtgcagcaggacctgcccctggccagagaccagcccagcagcgtgcccgccagccagagccaggtgcacctgagacccgacagaagaggcctggagcccaccggcatgaaccagcccggcctggtgcccgccagcacctacccccacggcgtggtgcccctgagcatgggccagctgggcgtgcccccccccgagatggacgacagagagctgatccccttcgtggtggacgagcagagaatgctgccccccagcgtgcccggcagagaccagcagggcctggagctgcccagcaccgaccagcacggcctggtgagcgtgagcgcctaccagcacggcatgaccttccccggcaccgaccagagaagcatggagcccctgggcatggaccagagaggctgcgtgatcagcggcatgggccagcagggcctggtgccccccggcatcgaccagcagggcctgaccctgcccgtggtggaccagcacggcctggtgctgcccttcaccgaccagcacggcctggtgagccccggcctgatgcccatcagcgccgaccagcagggcttcgtgcagcccagcctggaggccaccggcttcatccagcccggcaccgagcagcacgacctgatccagagcggcagattccagagagccctggtgcagagaggcgcctaccagcccggcctggtgcagcccggcgccgaccagagaggcctggtgagacccggcatggaccagagcggcctggcccagcccggcgccgaccagagaggcctggtgtggcccggcatggaccagagcggcctggcccagcccggcagagaccagcacggcctgatccagcccggcaccggccagcacgacctggtgcagagcggcaccggccagggcgtgctggtgcagcccggcgtggaccagcccggcatggtgcagcccggcagattccagagagccctggtgcagcccggcgcctaccagcccggcctggtgcagcccggcgccgaccagatcgacgtggtgcagcccggcgccgaccagcacggcctggtgcagagcggcgccgaccagagcgacctggcccagcccggcgccgtgcagcacggcctggtgcagcccggcgtggaccagagaggcctggcccagcccagagccgaccaccagagaggcctggtgccccccggcgccgaccagagaggcctggtgcagcccggcgccgaccagcacggcctggtgcagcccggcgtggaccagcacggcctggcccagcccggcgaggtgcagagaagcctggtgcagcccggcatcgtgcagagaggcctggtgcagcccggcgccgtgcagagaggcctggtgcagcccggcgccgtgcagagaggcctggtgcagcccggcgtggaccagagaggcctggtgcagcccggcgccgtgcagagaggcctggtgcagcccggcgccgtgcagcacggcctggtgcagcccggcgccgaccagagaggcctggtgcagcccggcgtggaccagagaggcctggtgcagcccggcgtggaccagagaggcctggtgcagcccggcatggaccagagaggcctgatccagcccggcgccgaccagcccggcctggtgcagcccggcgccggccagctgggcatggtgcagcccggcatcggccagcagggcatggtgcagccccaggccgacccccacggcctggtgcagcccggcgcctaccccctgggcctggtgcagcccggcgcctacctgcacgacctgagccagagcggcacctaccccagaggcctggtgcagcccggcatggaccagtacggcctgagacagcccggcgcctaccagcccggcctgatcgcccccggcaccaagctgagaggcagcagcaccttccaggccgacagcaccggcttcatcagcgtgagaccctaccagcacggcatggtgccccccggcagagagcagtacggccaggtgagccccctgctggccagccagggcctggccagccccggcatcgacagaagaagcctggtgccccccgagacctaccagcagggcctgatgcaccccggcaccgaccagcacagccccatccccctgagcaccggcctgggcagcacccaccccgaccagcagcacgtggccagccccggccccggcgagcacgaccaggtgtaccccgacgccgcccagcacggccacgccttcagcctgttcgacagccacgacagcatgtaccccggctacagaggccccggctacctgagcgccgaccagcacggccaggagggcctggaccccaacagaaccagagccagcgacagacacggcatccccgcccagaaggcccccggccaggacgtgaccctgttcagaagccccgacagcgtggacagagtgctgagcgagggcagcgaggtgagcagcgaggtgctgagcgagagaagaaacagcctgagaagaatgagcagcagcttccccaccgccgtggagaccttccacctgatgggcgagctgagcagcctgtacgtgggcctgaaggagagcatgaaggacctggacgaggagcaggccggccagaccgacctggagaagatccagttcctgctggcccagatggtgaagagaaccatcccccccgagctgcaggagcagctgaagaccgtgaagaccctggccaaggaggtgtggcaggagaaggccaaggtggagagactgcagagaatcctggagggcgagggcaaccaggaggccggcaaggagctgaaggccggcgagctgagactgcagctgggcgtgctgagagtgaccgtggccgacatcgagaaggagctggccgagctgagagagagccaggacagaggcaaggccgccatggagaacagcgtgagcgaggccagcctgtacctgcaggaccagctggacaagctgagaatgatcatcgagagcatgctgaccagcagcagcaccctgctgagcatgagcatggccccccacaaggcccacaccctggcccccggccagatcgaccccgaggccacctgccccgcctgcagcctggacgtgagccaccaggtgagcaccctggtgagaagatacgagcagctgcaggacatggtgaacagcctggccgtgagcagacccagcaagaaggccaagctgcagagacaggacgaggagctgctgggcagagtgcagagcgccatcctgcaggtgcagggcgactgcgagaagctgaacatcaccaccagcaacctgatcgaggaccacagacagaagcagaaggacatcgccatgctgtaccagggcctggagaagctggagaaggagaaggccaacagagagcacctggagatggagatcgacgtgaaggccgacaagagcgccctggccaccaaggtgagcagagtgcagttcgacgccaccaccgagcagctgaaccacatgatgcaggagctggtggccaagatgagcggccaggagcaggactggcagaagatgctggacagactgctgaccgagatggacaacaagctgcccggcatcctgagaaaggacagcagcggcaccagcaagagaaagagccagcagcccagaccccacgtgcacagaccccccagcctgagcagcaacggccagctgcccagcagaccccagagcgcccagatcagcgccggcaacaccagcgagagatag

SEQ ID NO: 21549 - DNA, 2331 bp, Artificial Sequence
  Description of Artificial Sequence: Synthetic coding sequence
atgaacaacagcctggagaacaccatcagcttcgaggagtacatcagagtgaaggccagaagcgtgccccagcacagaatgaaggagttcctggacagcctggccagcaagggccccgaggccctgcaggagttccagcagaccgccaccaccaccatggtgtaccagcagggcggcaactgcatctacaccgacagcaccgaggtggccggcagcctgctggagctggcctgccccgtgaccaccagcgtgcagccccagacccagcaggagcagcagatccaggtgcagcagccccagcaggtgcaggtgcaggtgcaggtgcagcagagcccccagcaggtgagcgcccagctgagcccccagctgaccgtgcaccagcccaccgagcagcccatccaggtgcaggtgcagatccagggccaggccccccagagcgccgcccccagcatccagacccccagcctgcagagccccagccccagccagctgcaggccgcccagatccaggtgcagcacgtgcaggccgcccagcagatccaggccgccgagatccccgaggagcacatcccccaccagcagatccaggcccagctggtggccggccagagcctggccggcggccagcagatccagatccagaccgtgggcgccctgagccccccccccagccagcagggcagccccagagagggcgagagaagagtgggcaccgccagcgtgctgcagcccgtgaagaagagaaaggtggacatgcccatcaccgtgagctacgccatcagcggccagcccgtggccaccgtgctggccatcccccagggccagcagcagagctacgtgagcctgagacccgacctgctgaccgtggacagcgcccacctgtacagcgccaccggcaccatcaccagccccaccggcgagacctggaccatccccgtgtacagcgcccagcccagaggcgacccccagcagcagagcatcacccacatcgccatcccccaggaggcctacaacgccgtgcacgtgagcggcagccccaccgccctggccgccgtgaagctggaggacgacaaggagaagatggtgggcaccaccagcgtggtgaagaacagccacgaggaggtggtgcagaccctggccaacagcctgttccccgcccagttcatgaacggcaacatccacatccccgtggccgtgcaggccgtggccggcacctaccagaacaccgcccagaccgtgcacatctgggacccccagcagcagccccagcagcagaccccccaggagcagaccccccccccccagcagcagcagcagcagctgcaggtgacctgcagcgcccagaccgtgcaggtggccgaggtggagccccagagccagccccagcccagccccgagctgctgctgcccaacagcctgaagcccgaggagggcctggaggtgtggaagaactgggcccagaccaagaacgccgagctggagaaggacgcccagaacagactggcccccatcggcagaagacagctgctgagattccaggaggacctgatcagcagcgccgtggccgagctgaactacggcctgtgcctgatgaccagagaggccagaaacggcgagggcgagccctacgaccccgacgtgctgtactacatcttcctgtgcatccagaagtacctgttcgagaacggcagagtggacgacatcttcagcgacctgtactacgtgagattcaccgagtggctgcacgaggtgctgaaggacgtgcagcccagagtgacccccctgggctacgtgctgcccagccacgtgaccgaggagatgctgtgggagtgcaagcagctgggcgcccacagccccagcaccctgctgaccaccctgatgttcttcaacaccaagtacttcctgctgaagaccgtggaccagcacatgaagctggccttcagcaaggtgctgagacagaccaagaagaaccccagcaaccccaaggacaagagcaccagcatcagatacctgaaggccctgggcatccaccagaccggccagaaggtgaccgacgacatgtacgccgagcagaccgagaaccccgagaaccccctgagatgccccatcaagctgtacgacttctacctgttcaagtgcccccagagcgtgaagggcagaaacgacaccttctacctgacccccgagcccgtggtggcccccaacagccccatctggtacagcgtgcagcccatcagcagagagcagatgggccagatgctgaccagaatcctggtgatcagagagatccaggaggccatcgccgtggccaacgccagcaccatgcactag

SEQ ID NO: 21550 - DNA, 2331 bp, Artificial Sequence; identical to SEQ ID NO: 21549
  Description of Artificial Sequence: Synthetic coding sequence

SEQ ID NO: 21551 - DNA, 2331 bp, Artificial Sequence; identical to SEQ ID NO: 21549
  Description of Artificial Sequence: Synthetic coding sequence

SEQ ID NO: 21552 - DNA, 747 bp, Artificial Sequence
  Description of Artificial Sequence: Synthetic coding sequence
atggaggaccccgagaagaagctgaaccagaagagcgacggcaagcccagaaaggtgagattcaagatcagcagcagctacagcggcagagtgctgaagcaggtgttcgaggacggccaggagctggagagccccaaggaggagtacccccacagcttcctgcaggagagcctggagaccatggacggcgtgtacggcagcggcgaggtgcccagaccccagatgtgcagccccaagctgaccgcccagagaatcagcgtgttcagagagggcaacgcctacaccctggccggcggccagcccagattcaacgactacaaggccaacgaccacaagcccctgcccatcatcgacttcggcaagatcatcatctacaccaacaacctgaagatcatcagaacccccatggacaagagagacttcgtgagaaagatcctgcagaaggaggaggaggccgaggaggagagcctgatgaacaaggaggagagctacggcggcagagaccagcacgacagacccctggtggaggccgagagcaccctgccccagaacagatacacccaggagggcgacatccccgaggacagctgcttccactgcagaggcagcggcagcgccacctgcagcctgtgccacggcagcaagttcagcatgctggccaacagattcaaggagagctacagagccctgagatgccccgcctgcaacgagaacggcctgcagccctgccagatctgcaaccagtag

SEQ ID NO: 21553 - DNA, 666 bp, Artificial Sequence
  Description of Artificial Sequence: Synthetic coding sequence
  Description of Combined DNA/RNA Molecule: Synthetic coding sequence
atgttccagcagttccaggccagctgcctggtgctgttcttcctggtgggcttcgcccagcagaccctgaagccccagaacagaaaggtggactgcaacaagggcgtgaccggcaccatctacgagtacggcgccctgaccctgaacggcgaggagtacatccagttcaagcagttcgccggcaagcacgtgctgttcgtgaacgtggccgcctacugaggcctggccgcccagtaccccgagctgaacgccctgcaggaggagctgaagaacttcggcgtgatcgtgctggccttcccctgcaaccagttcggcaagcaggagcccggcaccaacagcgagatcctgctgggcctgaagtacgtgtgccccggcagcggcttcgtgcccagcttccagctgttcgagaagggcgacgtgaacggcgagaaggagcagaaggtgttcaccttcctgaagaacagctgcccccccaccagcgacctgctgggcagcagcagccagctgttctgggagcccatgaaggtgcacgacatcagatggaacttcgagaagttcctggtgggccccgacggcgtgcccgtgatgcactggttccaccaggcccccgtgagcaccgtgaagagcgacatcctggagtacctgaagcagttcaacacccactag

SEQ ID NO: 21554 - DNA, 216 bp, Artificial Sequence
  Description of Artificial Sequence: Synthetic coding sequence
ctgaccagcttcagagtggtgcacaccatccccatgatcaagagcttcttcaactacctgagccccaagcacctgaagttccaggtggactgcaacaagggcgtgaccggcaccatctacgagtacggcgccctgaccctgaacggcgaggagtacatccagttcaagcagttcgccggcaagcacgtgctgttcgtgaacgtggccgcctactag

SEQ ID NO: 21555 - DNA, 1590 bp, Artificial Sequence
  Description of Artificial Sequence: Synthetic coding sequence
atgagcggcctgctgaccgaccccgagcagagagcccaggagcccagataccccggcttcgtgctgggcctggacgtgggcagcagcgtgatcagatgccacgtgtacgacagagccgccagagtgtgcggcagcagcgtgcagaaggtggagaacctgtacccccagatcggctgggtggagatcgaccccgacgtgctgtggatccagttcgtggccgtgatcaaggaggccgtgaaggccgccggcatccagatgaaccagatcgtgggcctgggcatcagcacccagagagccaccttcatcacctggaacaagaagaccggcaaccacttccacaacttcatcagctggcaggacctgagagccgtggagctggtgaagagctggaacaacagcctgctgatgaagatcttccacagcagctgcagagtgctgcacttcttcaccagaagcaagagactgttcaccgccagcctgttcaccttcaccacccagcagaccagcctgagactggtgtggatcctgcagaacctgaccgaggtgcagaaggccgtggaggaggagaactgctgcttcggcaccatcgacacctggctgctgtacaagctgaccaagggcagcgtgtacgccaccgacttcagcaacgccagcaccaccggcctgttcgacccctacaagatgtgctggagcggcatgatcaccagcctgatcagcatccccctgagcctgctgccccccgtgagagacaccagccacaacttcggcagcgtggacgaggagatcttcggcgtgcccatccccatcgtggccctggtggccgaccagcagagcgccatgttcggcgagtgctgcttccagaccggcgacgtgaagctgaccatgggcaccggcaccttcctggacatcaacaccggcaacagcctgcagcagaccaccggcggcttctaccccctgatcggctggaagatcggccaggaggtggtgtgcctggccgagagcaacgccggcgacaccggcaccgccatcaagtgggcccagcagctggacctgttcaccgacgccgccgagaccgagaagatggccaagagcctggaggacagcgagggcgtgtgcttcgtgcccagcttcagcggcctgcaggcccccctgaacgacccctgggcctgcgccagcttcatgggcctgaagcccagcaccagcaagtaccacctggtgagagccatcctggagagcatcgccttcagaaacaagcagctgtacgagatgatgaagaaggagatccacatccccgtgagaaagatcagagccgacggcggcgtgtgcaagaacggcttcgtgatgcagatgaccagcgacctgatcaacgagaacatcgacagacccgccgacatcgacatgagctgcctgggcgccgccagcctggccggcctggccgtgggcttctggaccgacaaggaggagctgaagaagctgagacagagcgaggtggtgttcaagccccagaagaagtgccaggagtacgagatgagcctggagaactgggccaaggccgtgaagagaagcatgaactggtacaacaagacctag

SEQ ID NO: 21556 - DNA, 906 bp, Artificial Sequence
  Description of Artificial Sequence: Synthetic coding sequence
atgagcggcctgctgaccgaccccgagcagagagcccaggagcccagataccccggcttcgtgctgggcctggacgtgggcagcagcgtgatcagatgccacgtgtacgacagagccgccagagtgtgcggcagcagcgtgcagaaggtggagaacctgtacccccagatcggctgggtggagatcgaccccgacgtgctgtggatccagttcgtggccgtgatcaaggaggccgtgaaggccgccggcatccagatgaaccagatcgtgggcctgggcatcagcacccagagagccaccttcatcacctggaacaagaagaccggcaaccacttccacaacttcatcagctggcaggacctgagagccgtggagctggtgaagagctggaacaacagcctgctgatgaagatcttccacagcagctgcagagtgctgcacttcttcaccagaagcaagagactgttcaccgccagcctgttcaccttcaccacccagcagaccagcctgagactggtgtggatcctgcagaacctgaccgaggtgcagaaggccgtggaggaggagaactgctgcttcggcaccatcgacacctggctgctgtacaagctgaccaagggcagcgtgtacgccaccgacttcagcaacgccagcaccaccggcctgttcgacccctacaagatgtgctggagcggcatgatcaccagcctgatcagcatccccctgagcctgctgccccccgtgagagacaccagccacaacttcggcagcgtggacgaggagatcttcggcgtgcccatccccatcgtggccctgctgaaggtgcccggctacgaccagaacatctgctacatcttcggcaagggcaccatcgagcccgtgttctaccacggcagcaccctgtag

SEQ ID NO: 21557 - DNA, 360 bp, Artificial Sequence
  Description of Artificial Sequence: Synthetic coding sequence
atgagcgtgaccgaccaggccttcgtgaccctggccaccgacgacatctactgccagggcgccctggtgctgggccagagcctgagaagacacagactgaccagaaagctggtggtgctgatcaccccccaggtgagcagcctgctgagagacatggacgaggccggcaaccacgacagcgagcagaccatcgccggcatcgagaaccagaccctgcacgtgctgacccacagatgggagctgaacaacgagaacacctggacccagggcggcgagcaccacaccctggagcccgtggtgggcagaggcgagggcggcggcatcgccctgggcgacatccccaacgtgaacgacgagtag

SEQ ID NO: 21558 - DNA, 291 bp, Artificial Sequence
  Description of Artificial Sequence: Synthetic coding sequence
atgagcggcagccacagcgtgacccaggccggcgtggagtggtacaaccacagcagcctgcagccccagacccccagactgaagtacccccccaccagcgccagccaggtggccgtgaccaccgtgaccgaccaggccttcgtgaccctggccaccgacgacatctactgccagggcgccctggtgctgggccagagcctgagaagacacagactgaccagaaagctggtggtgctgatcaccccccaggtgagcagcctgctgagagtgagcctggtggcccaggcctag

SEQ ID NO: 21559 - DNA, 195 bp, Artificial Sequence
  Description of Artificial Sequence: Synthetic coding sequence
atgagcgtgaccgaccaggccttcgtgaccctggccaccgacgacatctactgccagggcgccctggtgctgggccagagcctgagaagacacagactgaccagaaagctggtggtgctgatcaccccccaggtgagcagcctgctgagacccgccgccagcctggtgctgagcagagtgagcagcagaccctag

SEQ ID NO: 21560 - DNA, 192 bp, Artificial Sequence
  Description of Artificial Sequence: Synthetic coding sequence
atgagcgtgaccgaccaggccttcgtgaccctggccaccgacgacatctactgccagggcgccctggtgctgggccagagcctgagaagacacagactgaccagaaagctggtggtgctgatcaccccccaggtgagcagcctgctgagcctgagcaagagatgcaagatcagcagcagccacctggactag

SEQ ID NO: 21561 - DNA, 966 bp, Artificial Sequence
  Description of Artificial Sequence: Synthetic coding sequence
atgagccccagccccaccgccctgttctgcctgggcctgtgcctgggcagagtgcccgcccagagcggccccctgcccaagcccagcctgcaggccctgcccagcagcctggtgcccctggagaagcccgtgaccctgagatgccagggcccccccggcgtggacctgtacagactggagaagctgagcagcagcagataccaggaccaggccgtgctgttcatccccgccatgaagagaagcctggccggcagatacagatgcagctaccagaacggcagcctgtggagcctgcccagcgaccagctggagctggtggccaccggcgtgttcgccaagcccagcctgagcgcccagcccggccccgccgtgagcagcggcggcgacgtgaccctgcagtgccagaccagatacggcttcgaccagttcgccctgtacaaggagggcgaccccgccccctacaagaaccccgagagatggtacagagccagcttccccatcatcaccgtgaccgccgcccacagcggcacctacagatgctacagcttcagcagcagagacccctacctgtggagcgcccccagcgaccccctggagctggtggtgaccgagttcagcgaggccaccgccgagctgaccgtgagcttcaccaacgaggtgttcaccaccgagaccagcagaagcatcaccgccagccccaaggagagcgacagccccgccggccccgccagacagtactacaccaagggcaacctggtgagaatctgcctgggcgccgtgatcctgatcatcctggccggcttcctggccgaggactggcacagcagaagaaagagactgagacacagaggcagagccgtgcagagacccctgccccccctgccccccctgcccctgaccagaaagagcaacggcggccaggacggcggcagacaggacgtgcacagcagaggcctgtgcagctag

SEQ ID NO: 21562 - DNA, 966 bp, Artificial Sequence; identical to SEQ ID NO: 21561
  Description of Artificial Sequence: Synthetic coding sequence

SEQ ID NO: 21563 - DNA, 966 bp, Artificial Sequence; identical to SEQ ID NO: 21561
  Description of Artificial Sequence: Synthetic coding sequence

SEQ ID NO: 21564 - DNA, 966 bp, Artificial Sequence; identical to SEQ ID NO: 21561
  Description of Artificial Sequence: Synthetic coding sequence

SEQ ID NO: 21565 - DNA, 966 bp, Artificial Sequence; identical to SEQ ID NO: 21561
  Description of Artificial Sequence: Synthetic coding sequence

SEQ ID NO: 21566 - DNA, 966 bp, Artificial Sequence; identical to SEQ ID NO: 21561
  Description of Artificial Sequence: Synthetic coding sequence

SEQ ID NO: 21567 - DNA, 966 bp, Artificial Sequence; identical to SEQ ID NO: 21561
  Description of Artificial Sequence: Synthetic coding sequence

SEQ ID NO: 21568 - DNA, 966 bp, Artificial Sequence; identical to SEQ ID NO: 21561
  Description of Artificial Sequence: Synthetic coding sequence

SEQ ID NO: 21569 - DNA, 1116 bp, Artificial Sequence
  Description of Artificial Sequence: Synthetic coding sequence
atgagcttcagaaaggtgaacatcatcatcctggtgctggccgtggccctgttcctgctggtgctgcaccacaacttcctgagcctgagcagcctgctgagaaacgaggtgaccgacagcggcatcgtgggcccccagcccatcgacttcgtgcccaacgccctgagacacgccgtggacggcagacaggaggagatccccgtggtgatcgccgccagcgaggacagactgggcggcgccatcgccgccatcaacagcatccagcacaacaccagaagcaacgtgatcttctacatcgtgaccctgaacaacaccgccgaccacctgagaagctggctgaacagcgacagcctgaagagcatcagatacaagatcgtgaacttcgaccccaagctgctggagggcaaggtgaaggaggaccccgaccagggcgagagcatgaagcccctgaccttcgccagattctacctgcccatcctggtgcccagcgccaagaaggccatctacatggacgacgacgtgatcgtgcagggcgacatcctggccctgtacaacaccgccctgaagcccggccacgccgccgccttcagcgaggactgcgacagcgccagcaccaaggtggtgatcagaggcgccggcaaccagtacaactacatcggctacctggactacaagaaggagagaatcagaaagctgagcatgaaggccagcacctgcagcttcaaccccggcgtgttcgtggccaacctgaccgagtggaagagacagaacatcaccaaccagctggagaagtggatgaagctgaacgtggaggagggcctgtacagcagaaccctggccggcagcatcaccaccccccccctgctgatcgtgttctaccagcagcacagcaccatcgaccccatgtggaacgtgagacacctgggcagcagcgccggcaagagatacagcccccagttcgtgaaggccgccaagctgctgcactggaacggccacctgaagccctggggcagaaccgccagctacaccgacgtgtgggagaagtggtacatccccgaccccaccggcaagttcaacctgatcagaagatacaccgagatcagcaacatcaagtag

SEQ ID NO: 21570 - DNA, 1116 bp, Artificial Sequence; identical to SEQ ID NO: 21569
  Description of Artificial Sequence: Synthetic coding sequence

SEQ ID NO: 21571 - DNA, 681 bp, Artificial Sequence
  Description of Artificial Sequence: Synthetic coding sequence
atggacgacgacgtgatcgtgcagggcgacatcctggccctgtacaacaccgccctgaagcccggccacgccgccgccttcagcgaggactgcgacagcgccagcaccaaggtggtgatcagaggcgccggcaaccagtacaactacatcggctacctggactacaagaaggagagaatcagaaagctgagcatgaaggccagcacctgcagcttcaaccccggcgtgttcgtggccaacctgaccgagtggaagagacagaacatcaccaaccagctggagaagtggatgaagctgaacgtggaggagggcctgtacagcagaaccctggccggcagcatcaccaccccccccctgctgatcgtgttctaccagcagcacagcaccatcgaccccatgtggaacccccccccctggttccagtgctggaagaccatcttcaccagcgtgtgcaagggctgccaggtgacccactggaacggccacctgaagccctggggcagaaccgccagctacacctgcctgggcaagatggtgtacagcagacccaacagacagatccagcccaaccccaagatctacagagacctgaagcacaaggtgaagcagaacctgaactgcaagcaggccttcctgagaaagagctggaagatcgcctgcgtgggcagcaacagctgctag

SEQ ID NO: 21572 - DNA, 1116 bp, Artificial Sequence; identical to SEQ ID NO: 21569
  Description of Artificial Sequence: Synthetic coding sequence

SEQ ID NO: 21573 - DNA, 93 bp, Artificial Sequence
  Description of Artificial Sequence: Synthetic coding sequence
atgagcttcagaaaggtgaacatcatcatcctggtgctggccgtggccctgttcctgctggtgctgcaccacaacttcctgagcctgagctag

SEQ ID NO: 21574 - DNA, 1116 bp, Artificial Sequence; identical to SEQ ID NO: 21569
  Description of Artificial Sequence: Synthetic coding sequence

SEQ ID NO: 21575 - DNA, 525 bp, Artificial Sequence
  Description of Artificial Sequence: Synthetic coding sequence
atgagcttcagaaaggtgaacatcatcatcctggtgctggccgtggccctgttcctgctggtgctgcaccacaacttcctgagcctgagcagcctgctgagaaacgaggtgaccgacagcggcatcgtgggcccccagcccatcgacttcgtgcccaacgccctgagacacgccgtggacggcagacaggaggagatccccgtggtgatcgccgccagcgaggacagactgggcggcgccatcgccgccatcaacagcatccagcacaacaccagaagcaacgtgatcttctacatcgtgaccctgaacaacaccgccgaccacctgagaagctggctgaacagcgacagcctgaagagcatcagatacaagatcgtgaacttcgaccccaagctgctggagggcaaggtgaaggaggaccccgaccagggcgagagcatgaagcccctgaccttcgccagattctacctgcccatcctggtgcccagcgccaagaaggccatctacatggacgacgacgtgtag

SEQ ID NO: 21576 - DNA, 189 bp, Artificial Sequence
  Description of Artificial Sequence: Synthetic coding sequence
atgagcttcagaaaggtgaacatcatcatcctggtgctggccgtggccctgttcctgctggtgctgcaccacaacttcctgagcctgagcagcctgctgagaaacgaggtgaccgacagcggcatcgtgggcccccagcccatcgacttcgtgcccaacgccctgagacacgccgtggacggcagatag

SEQ ID NO: 21577 - DNA, 333 bp, Artificial Sequence
  Description of Artificial Sequence: Synthetic coding sequence
atgagcttcagaaaggtgaacatcatcatcctggtgctggccgtggccctgttcctgctggtgctgcaccacaacttcctgagcctgagcagcctgctgagaaacgaggtgaccgacagcggcatcgtgggcccccagcccatcgacttcgtgcccaacgccctgagacacgccgtggacggcagacaggaggagatccccgtggtgatcgccgccagcgaggacagactgggcggcgccatcgccgccatcaacagcatccagcacaacaccagaagcaacgtgatcttctacatcgtgaccctgaacaacaccgccgaccacctgagatag

SEQ ID NO: 21578 - DNA, 1116 bp, Artificial Sequence; identical to SEQ ID NO: 21569
  Description of Artificial Sequence: Synthetic coding sequence

SEQ ID NO: 21579 - DNA, 270 bp, Artificial Sequence
  Description of Artificial Sequence: Synthetic coding sequence
atgagcttcagaaaggtgaacatcatcatcctggtgctggccgtggccctgttcctgctggtgctgcaccacaacttcctgagcctgagcagcctgctgagaaacgaggtgaccgacagcggcatcgtgggcccccagcccatcgacttcgtgcccaacgccctgagacacgccgtggacggcagacaggaggagatccccgtggtgatcgccgccagcgaggacagactgggcggcgccatcgccgccatcaacagcatccagcactag

SEQ ID NO: 21580 - DNA, 192 bp, Artificial Sequence
  Description of Artificial Sequence: Synthetic coding sequence
atgagcttcagaaaggtgaacatcatcatcctggtgctggccgtggccctgttcctgctggtgctgcaccacaacttcctgagcctgagcagcctgctgagaaacgaggtgaccgacagcggcatcgtgggcccccagcccatcgacttcgtgcccaacgccctgagacacgccgtggacggcagacagtag

SEQ ID NO: 21581 - DNA, 483 bp, Artificial Sequence
  Description of Artificial Sequence: Synthetic coding sequence
atgctgagacacctgcccagcagactgcccgtgaagatgtggggcagaaccctggagaagcagagctggagagacagcagccagaccccccccccctgcctgatcagaagactggaccacatcgtgatgaccgtgaagagcatcaaggacaccaccatgttctacagcaagatcctgggcatggaggtgatgaccttcaaggaggacagaaaggccctgtgcttcggcgaccagaagttcaacctgcacgaggtgggcaaggagttcgagcccaaggccgcccaccccgtgcccggcagcctggacatctgcctgatcaccgaggtgcccctggaggagatgatccagcacctgaaggcctgcgacgtgcccatcgaggagggccccgtgcccagaaccggcgccaagggccccatcatgagcatctacttcagagaccccgacagaaacctgatcgaggtgagcaactacatcagcagctag

SEQ ID NO: 21582 - DNA, 384 bp, Artificial Sequence
  Description of Artificial Sequence: Synthetic coding sequence
tgaatcagaagactggaccacatcgtgatgaccgtgaagagcatcaaggacaccaccatgttctacagcaagatcctgggcatggaggtgatgaccttcaaggaggacagaaaggccctgtgcttcggcgaccagaagttcaacctgcacgaggtgggcaaggagttcgagcccaaggccgcccaccccgtgcccggcagcctggacatctgcctgatcaccgaggtgcccctggaggagatgatccagcacctgaaggcctgcgacgtgcccatcgaggagggccccgtgcccagaaccggcgccaagggccccatcatgagcatctacttcagagaccccgacagaaacctgatcgaggtgagcaactacatcagcagctag

SEQ ID NO: 21583 - DNA, 2082 bp, Artificial Sequence
  Description of Artificial Sequence: Synthetic coding sequence
atgtggccccagccctacctgcccccccaccccatgatgctggaggagagcagacagaacaagctggccgccgccaagaagaagctgaaggagtaccagcagagaaagagccccggcatccccgccggcgccaagaccaagaagaagaagaccgacagcagccccgagaccaccaccagcggcggctgccacagccccggcgacagccagtaccaggagctggccgtggccctggagagcagcagcgtgaccatcagccagctgaacgagaacatcgagagcctgaagcagcagaagaagcaggtggagcaccagctggaggaggccaagaagaccaacaacgagatccacaaggcccagatggagagactggagaccatcaacatcctgaccctggagaaggccgacctgaagaccaccctgtaccacaccaagagagccgccagacacttcgaggaggagagcaaggacctggccggcagactgcagtacagcctgcagagaatccaggagctggagagagccctgtgcgccgtgagcacccagcagcaggaggaggacagaagcagcagctgcagagaggccgtgctgcagagatggctgcagcagaccatcaaggagagagccctgctgaacgcccacgtgacccaggtgaccgagagcctgaagcaggtgcagctggagagagacgagtacgccaagcacatcaagggcgagagagccagatggcaggagagaatgtggaagatgagcgtggaggccagaaccctgaaggaggagaagaagagagacatccacagaatccaggagctggagagaagcctgagcgagctgaagaaccagatggccgagccccccagcctggccccccccgccgtgaccagcgtggtggagcagctgcaggacgaggccaagcacctgagacaggaggtggagggcctggagggcaagctgcagagccaggtggagaacaaccaggccctgagcctgctgagcaaggagcagaagcagagactgcaggagcaggaggagatgctgagagagcaggaggcccagagagtgagagagcaggagagactgtgcgagcagaacgagagactgagagagcagcagaagaccctgcaggagcagggcgagagactgagaaagcaggagcagagactgagaaagcaggaggagagactgagaaaggaggaggagagactgcagaagcaggagaagagactgtgggaccaggaggagagactgtggaagaaggaggagagactgcagaagcaggaggagagactggccctgagccagaaccacaagctggacaagcagctggccgagccccagtgcagcttcgaggacctgaacaacgagaagaagagcgccctgcagctggagcagcaggtgaaggagctgcaggagaagctggacgaggagcacctggaggccgccagccaccagaaccagcagctggagacccagctgagcctggtggccctgcccggcgagggcgacggcggccagcacctggacagcgaggaggaggaggcccccagacccacccccaacatccccgaggacctggagagcagagaggccaccagcagcttcatggacctgcccaaggagaaggccgacggcaccgagcaggtggagagaagagagctgggcttcgtgcagcccagcggcgtgaccgacggcatgagagagagcttcaccgtgtacgagagccagggcgccgtgcccaacaccagacaccaggagatggaggacgtgatcagactggcccagaaggaggaggagatgaaggtgaagctgctggagctgcaggagctggtgctgcccctggtgggcaaccacgagggccacggcaagttcctgatcgccgcccagaaccccgccgacgagcccacccccggcgcccccgccccccaggagctgggcgccgccggcgagcaggacgtgttctacgaggtgagcctggacaacaacgtggagcccgcccccggcgccgccagagagggcagcccccacgacaaccccaccgtgcagcagatcgtgcagctgagccccgtgatgcaggacacctag

SEQ ID NO: 21584 - DNA, 2082 bp, Artificial Sequence
  Description of Artificial Sequence: Synthetic coding sequence
atgtggccccagccctacctgcccccccaccccatgatgctggaggagagcagacagaacaagctggccgccgccaagaagaagctgaaggagtaccagcagagaaagagccccggcatccccgccggcgccaagaccaagaagaagaagaccgacagcagccccgagaccaccaccagcggcggcggccacagccccggcgacagccagtaccaggagctggccgtggccctggagagcagcagcgtgaccatcagccagctgaacgagaacatcgagagcctgaagcagcagaagaagcaggtggagcaccagctggaggaggccaagaagaccaacaacgagatccacaaggcccagatggagagactggagaccatcaacatcctgaccctggagaaggccgacctgaagaccaccctgtaccacaccaagagagccgccagacacttcgaggaggagagcaaggacctggccggcagactgcagtacagcctgcagagaatccaggagctggagagagccctgtgcgccgtgagcacccagcagcaggaggaggacagaagcagcagctgcagagaggccgtgctgcacagaagactgcagcagaccatcaaggagagagccctgctgaacgcccacgtgacccaggtgaccgagagcctgaagcaggtgcagctggagagagacgagtacgccaagcacatcaagggcgagagagccagatggcaggagagaatgtggaagatgagcgtggaggccagaaccctgaaggaggagaagaagagagacatccacagaatccaggagctggagagaagcctgagcgagctgaagaaccagatggccaagccccccagcctggccccccccgccgtgaccagcgtggtggagcagctgcaggacgaggccaagcacctgagacaggaggtggagggcctggagggcaagctgcagagccaggtggagaacaaccaggccctgagcctgctgagcaaggagcagaagcagagactgcaggagcaggaggagatgctgagagagcaggaggtgcagagagtgagagagcaggagagactgtgcgagcagaacgagagactgagagagcagcagaagaccctgcaggagcagggcgagagactgagaaagcaggagcagagactgagaaagcaggaggagagactgagaaaggaggaggagagactgcagaagcaggagaagagactgtgggaccaggaggagagactgtggaagaaggaggagagactgcagaagcaggaggagagactggccctgagccagaaccacaagctggacaagcagctggccgagccccagtgcagcttcgaggacctgaacaacgagaagaagagcgccctgcagctggagcagcaggtgaaggagctgcaggagaagctggacgaggagcacctggaggccgccagccagcagaaccagcagctggagacccagctgagcctggtggccctgcccggcgagggcgacggcggccagcacctggacagcgaggaggaggaggcccccagacccacccccaacatccccgaggacctggagagcagagaggccaccagcagcttcatggacctgcccaaggagaaggccgacggcaccgagcaggtggagagaagagagctgggcttcgtgcagcccagcggcgtgaccgacggcatgagagagagcttcaccgtgtacgagagccagggcgccgtgcccaacaccagacaccaggagatggaggacgtgatcagactggcccagaaggaggaggagatgaaggtgaagctgctggagctgcaggagctggtgctgcccctggtgggcaaccacgagggccacggcaagttcctgatcgccgcccagaaccccgccgacgagcccacccccggcgcccccgccccccaggagctgggcgccgccggcgagcaggacgacttctacgaggtgagcctggacaacaacgtggagcccgcccccggcgccgccagagagggcagcccccacgacaaccccaccgtgcagcagatcgtgcagctgagccccgtgatgcaggacacctag

SEQ ID NO: 21585 - DNA, 2082 bp, Artificial Sequence
  Description of Artificial Sequence: Synthetic coding sequence
atgtggccccagccctacctgcccccccaccccatgatgctggaggagagcagacagaacaagctggccgccgccaagaagaagctgaaggagtaccagcagagaaagagccccggcatccccgccggcgccaagaccaagaagaagaagaccgacagcagccccgagaccaccaccagcggcggcggccacagccccggcgacagccagtaccaggagctggccgtggccctggagagcagcagcgtgaccatcaaccagctgaacgagaacatcgagagcctgaagcagcagaagaagcaggtggagcaccagctggaggaggccaagaagaccaacaacgagatccacaaggcccagatggagcagctggagaccatcaacatcctgaccctggagaaggccgacctgaagaccaccctgtaccacaccaagagagccgccagacacttcgaggaggagagcaaggacctggccggcagactgcagtacagcctgcagagaatccaggagctggagagagccctgagcgccgtgagcacccagcagcaggaggaggacagaagcagcagctgcagagaggccgtgctgcagagaagactgcagcagaccatcaaggagagagccctgctgaacgcccacgtgacccaggtgaccgagagcctgaagcaggtgcagctggagagagacgagtacgccaagcacatcaagggcgagagagccagatggcaggagagaatgtggaagatgagcgtggaggccagaaccctgaaggaggagaagaagagagacatccacagaatccaggagctggagagaagcctgagcgagctgaagaaccagatggccgagccccccagcctggccccccccgccgtgaccagcgtggtggagcagctgcaggacgaggccaagcacctgagacaggaggtggagggcctggagggcaagctgcagagccaggtggagaacaaccaggccctgagcctgctgagcaaggagcagaagcagagactgcaggagcaggaggagatgctgagagagcaggaggcccagagagtgagagagcaggagagactgtgcgagcagaacgagagactgagagagcagcagaagaccctgcaggagcagggcgagagactgagaaagcaggagcagagactgagaaagcaggaggagagactgagaaaggaggaggagagactgcagaagcaggagaagagactgtgggaccaggaggagagactgtggaagaaggaggagagactgcagaagcaggaggagagactggccctgagccagaaccacaagctggacaagcagctggccgagccccagtgcagcttcgaggacctgaacaacgagaagaagagcgccctgcagctggagcagcaggtgaaggagctgcaggagaagctggacgaggagcacctggaggccgccagccagagaaaccagcagctggagacccagctgagcctggtggccctgcccggcgagggcgacggcggccagcacctggacagcgaggaggaggaggcccccagacccacccccaacatccccgaggacctggagagcagagaggccaccagcagcttcatggacctgcccaaggagaaggccgacggcaccgagcaggtggagagaagagagctgggcttcgtgcagcccagcggcgtgaccgacggcatgagagagagcttcaccgtgtacgagagccagggcgccgtgcccaacaccagacaccaggagatggaggacgtgatcagactggcccagaaggaggaggagatgaaggtgaagctgctggagctgcaggagctggtgctgcccctggtgggcaaccacgagggccacggcaagttcctgatcgccgcccagaaccccgccgacgagcccacccccggcgcccccgccccccaggagctgggcgccgccggcgagcaggacgacttctacgaggtgagcctggacaacaacgtggagcccgcccccggcgccgccagagagggcagcccccacgacaacccccccgtgcagcagatcgtgcagctgagccccgtgatgcaggacacctag

SEQ ID NO: 21586 - DNA, 2082 bp, Artificial Sequence
  Description of Artificial Sequence: Synthetic coding sequence
atgtggccccagccctacctgcccccccaccccatgatgctggaggagagcagacagaacaagctggccgccgccaagaagaagctgaaggagtaccagcagagaaagagccccggcatccccgccggcgccaagaccaagaagaagaagaccgacagcagccccgagaccaccaccagcggcggcggccacagccccggcgacagccagtaccaggagctggccgtggccctggagagcagcagcgtgaccatcaaccagctgaacgagaacatcgagagcctgaagcagcagaagaagcaggtggagcaccagctggaggaggccaagaagaccaacaacgagatccacaaggcccagatggagcagctggagaccatcaacatcctgaccctggagaaggccgacctgaagaccaccctgtaccacaccaagagagccgccagacacttcgaggaggagagcaaggacctggccggcagactgcagtacagcctgcagcacatccaggagctggagagagccctgtgcgccgtgagcacccagcagcaggaggaggacagaagcagcagctgcagagaggccgtgctgcagagaagactgcagcagaccatcaaggagagagccctgctgaacgcccacgtgacccaggtgaccgagagcctgaagcaggtgcagctggagagagacgagtacgccaagcacatcaagggcgagagagccagatggcaggagagaatgtggaagatgagcgtggaggccagaaccctgaaggaggagaagaagagagacatccacagaatccaggagctggagagaagcctgagcgagctgaagaaccagatggccgagccccccagcctggccccccccgccgtgaccagcgtggtggagcagctgcaggacgaggccaagcacctgagacaggaggtggagggcctggagggcaagctgcagagccaggtggagaacaaccaggccctgagcctgctgagcaaggagcagaagcagagactgcaggagcaggaggagatgctgagagagcaggaggcccagagagtgagagagcaggagagactgtgcgagcagaacgagagactgagagagcagcagaagaccctgcaggagcagggcgagagactgagaaagcaggagcagagactgagaaagcaggaggagagactgagaaaggaggaggagagactgcagaagcaggagaagagactgtgggaccaggaggagagactgtggaagaaggaggagagactgcagaagcaggaggagagactggccctgagccagaaccacaagctggacaagcagctggccgagccccagtgcagcttcgaggacctgaacaacgagaagaagagcgccctgcagctggagcagcaggtgaaggagctgcaggagaagctggacgaggagcacctggaggccgccagccagagaaaccagcagctggagacccagctgagcctggtggccctgcccggcgagggcgacggcggccagcacctggacagcgaggaggaggaggcccccagacccacccccaacatccccgaggacctggagagcagagaggccaccagcagcttcatggacctgcccaaggagaaggccgacggcaccgagcaggtggagagaagagagctgggcttcgtgcagcccagcggcgtgaccgacggcatgagagagagcttcaccgtgtacgagagccagggcgccgtgcccaacaccagacaccaggagatggaggacgtgatcagactggcccagaaggaggaggagatgaaggtgaagctgctggagctgcaggagctggtgctgcccctggtgggcaaccacgagggccacggcaagttcctgatcgccgcccagaaccccgccgacgagcccacccccggcgcccccgccccccaggagctgggcgccgccggcgagcaggacgtgttctacgaggtgagcctggacaacaacgtggagcccgcccccggcgtggccagagagggcagcccccacaacaaccccaccgtgcagcagatcgtgcagctgagccccgtgatgcaggacacctag

SEQ ID NO: 21587 - DNA, 2007 bp, Artificial Sequence
  Description of Artificial Sequence: Synthetic coding sequence
atgctgatgtggccccagccccacctgcccacccacccccacctgcccacccacccccacctgcccacccacccccacctgcccacccacccccacctgcccacccacccccacctgcccacccacccccacctgcccacccaccccatgatgagcaaggagaccagacagagcaagctggccgaggccaaggagcagctgaccgaccaccacccccagaccaaccccagcgtgggcaccgccgccagcgacaccaagaagaagaagatcaacaacggcaccaaccccgagaccaccaccagcggcggctgccacagccccgaggacgagcagaaggccagccaccagcaccaggaggccctgagaagagagctggaggcccaggtgcacaccatcagaatcctgacctgccagaagaccgagctgcagatggccctgtactacagccagcacgccgtgaagcagctggagggcgaggccagagacctgatcagcagactgcacgacagctggaagttcgccggcgagctggagcaggccctgagcgccgtggccacccagaagaagaaggccgacagatacatcgaggagctgaccaaggagagagacgccctgagcctggagctgtacagaaacaccatcaccgacgaggagctgaaggagaagaacgccaagctgcaggagaagctgcagctggtggagagcgagaagagcgagatccagctgaacgtgaaggagctgaagagaaagctggagagagccaagctgctgctgccccagcagcagctgcaggccgaggccgaccacctgggcaaggagctgcagagcgtgagcgccaagctgcaggcccaggtggaggagaacgagctgtggaacagactgaaccagcagcaggaggagaagatgtggagacaggaggagaagatccaggagtgggaggagaagatccaggagcaggaggagaagatcagagagcaggaggagaagatcagagagcaggaggagaagatgagaagacaggaggagatgatgtgggagaaggaggagaagatgagaagacaggaggagatgatgtgggagaaggaggagaagatgagaagactggaggagatgatgtgggagaaggaggagaagatcagagagctggaggagaagatgcacgagcaggagaagatcagagagcaggaggagaagagacaggaggaggagaagatcagagagcaggagaagagacaggagcaggaggccaagatgtggagacaggaggagaagatcagagagcaggaggagaagatcagagagcaggagaagaagatgtggagacaggaggagaagatccacgagcaggagaagatcagagaggaggagaagagacaggagcaggaggagatgtggagacaggaggagaagatcagagagcaggaggagatctggagacagaaggagaagatgcacgagcaggagaagatcagaaagcaggaggagaaggtgtggagacaggaggagaagatgcacgaccaggaggagaagatcagagagcaggaggagaagatgtggagacaggaggagaagatcagagagcaggaggagaagatcagagagcaggaggagaagatcagagagcaggaggagatgatgcaggagcaggaggagaagatgggcgagcaggaggagaagatgcaggagcaggagaagatgagaagacaggaggagaagatcagagagcaggaggagaagatcagagagcagaaggagaagatcagagagcaggaggagaagatctgggagcaggaggagaagatcagagagcaggaggagatgatgcaggagcaggaggagaagatgtgggagcaggaggagaagatgtgcgagcaggaggagaagatgcaggagcaggaggagaagatgagaagacaggaggagaagatgtgggagcaggaggtgagactgagacagcaggaggagaagatgcaggagcaccaggagcacctggaggccgccatctag

SEQ ID NO: 21588 - DNA, 1857 bp, Artificial Sequence
  Description of Artificial Sequence: Synthetic coding sequence
atgatgagcaaggagaccagacagagcaagctggccgaggccaaggagcagctgaccgaccaccacccccagaccaaccccagcgtgggcaccgccgccagcgacaccaagaagaagaagatcaacaacggcaccaaccccgagaccaccaccagcggcggctgccacagccccgaggacgagcagaaggccagccaccagcaccaggaggccctgagaagagagctggaggcccaggtgcacaccatcagaatcctgacctgccagaagaccgagctgcagatggccctgtactacagccagcacgccgtgaagcagctggagggcgaggccagagacctgatcagcagactgcacgacagctggaagttcgccggcgagctggagcaggccctgagcgccgtggccacccagaagaagaaggccgacagatacatcgaggagctgaccaaggagagagacgccctgagcctggagctgtacagaaacaccatcaccgacgaggagctgaaggagaagaacgccaagctgcaggagaagctgcagctggtggagagcgagaagagcgagatccagctgaacgtgaaggagctgaagagaaagctggagagagccaagctgctgctgccccagcagctgcaggccgaggccgaccacctgggcaaggagctgcagagcgtgagcgccaagctgcaggcccaggtggaggagaacgagctgtggaacagactgaaccagcagcaggaggagaagatgtggagacaggaggagaagatccaggagtgggaggagaagatccaggagcaggaggagaagatcagagagcaggaggagaagatcagagagcaggaggagaagatgagaagacaggaggagatgatgtgggagaaggaggagaagatgagaagacaggaggagatgatgtgggagaaggaggagaagatgagaagactggaggagatgatgtgggagaaggaggagaagatcagagagctggaggagaagatgcacgagcaggagaagatcagagagcaggaggagaagagacaggaggaggagaagatcagagagcaggagaagagacaggagcaggaggccaagatgtggagacaggaggagaagatcagagagcaggaggagaagatcagagagcaggagaagaagatgtggagacaggaggagaagatccacgagcaggagaagatcagagaggaggagaagagacaggagcaggaggagatgtggagacaggaggagaagatcagagagcaggaggagatctggagacagaaggagaagatgcacgagcaggagaagatcagaaagcaggaggagaaggtgtggagacaggaggagaagatgcacgaccaggaggagaagatcagagagcaggaggagaagatgtggagacaggaggagaagatcagagagcaggaggagaagatcagagagcaggaggagaagatcagagagcaggaggagatgatgcaggagcaggaggagaagatgggcgagcaggaggagaagatgcaggagcaggagaagatgagaagacaggaggagaagatcagagagcaggaggagaagatcagagagcagaaggagaagatcagagagcaggaggagaagatctgggagcaggaggagaagatcagagagcaggaggagatgatgcaggagcaggaggagaagatgtgggagcaggaggagaagatgtgcgagcaggaggagaagatgcaggagcaggaggagaagatgagaagacaggaggagaagatgtgggagcaggaggtgagactgagacagcaggaggagaagatgcaggagcaccaggagcacctggaggccgccatctag

SEQ ID NO: 21589 - DNA, 1143 bp, Artificial Sequence
  Description of Artificial Sequence: Synthetic coding sequence
atgtggccccagcccagactgcccccccaccccgccatgagcgagaagacccagcagggcaagctggccgccgccaagaagaagctgaaggcctactggcagagaaagagccccggcatccccgccggcgccaacagaaagaagaaggtgaacggcagcagccccgacaccgccaccagcggcggctaccacagccccggcgacagcgccaccggcatctacggcgagggcagagccagcagcaccaccctgcaggacctggagagccagtaccaggagctggccgtggccctggacagcagcagcgccatcatcagccagctgaccgagaacatcaacagcctggtgagaaccagcaaggaggagaagaagcacgagatccacctggtgcagaagctgggcagaagcctgttcaagctgaagaaccagaccgccgagcccctggcccccgagccccccgccggccccagcaaggtggagcagctgcaggacgagaccaaccacctgagaaaggagctggagagcgtgggcagacagctgcaggccgaggtggagaacaaccagatgctgagcctgctgaacagaagacaggaggagagactgagagagcaggaggagagactgcacgagcaggaggagagactgcacgagcaggaggagagactgtgcgagcaggaggagagactgtgcgagcaggaggagagactgagagagcaggaggagagactgagagagcaggaggagagactgcacgagcaggaggagagactgtgcgagcaggaggagagactgtgcgagcaggaggagagactgtgcgagcaggagaagctgcccggccaggagagactgctggaggaggtggagaagctgctggagcaggagagaagacaggaggagcaggagagactgctggagagagagagactgtggaccagatggagaagcagctggagcagaagaggcttcggcaacagaatgagaggctgcggcagcagaagactgtgcggcagctggagaggctgcggcagctggagaggctgcggcagctggagaggctgcggcagctggagaggctgctggagctggggcggcaagccctgcaccagcagcggccccagccacgccgccgccagcagaagctag

SEQ ID NO: 21590 - DNA, 1440 bp, Artificial Sequence
  Description of Artificial Sequence: Synthetic coding sequence
atgtggccccagcccagactgcccccccaccccgccatgagcgagaagacccagcagggcaagctggccgccgccaagaagaagctgaaggcctactggcagagaaagagccccggcatccccgccggcgccaacagaaagaagaaggtgaacggcagcagccccgacaccgccaccagcggcggctaccacagccccggcgacagcgccaccggcatctacggcgagggcagagccagcagcaccaccctgcaggacctggagagccagtaccaggagctggccgtggccctggacagcagcagcgccatcatcagccagctgaccgagaacatcaacagcctggtgagaaccagcaaggaggagaagaagcacgagatccacctggtgcagaagctgggcagaagcctgttcaagctgaagaaccagaccgccgagcccctggcccccgagccccccgccggccccagcaaggtggagcagctgcaggacgagaccaaccacctgagaaaggagctggagagcgtgggcagacagctgcaggccgaggtggagaacaaccagatgctgagcctgctgaacagaagacaggaggagagactgagagagcaggaggagagactgcacgagcaggaggagagactgcacgagcaggaggagagactgtgcgagcaggaggagagactgtgcgagcaggaggagagactgagagagcaggaggagagactgagagagcaggaggagagactgcacgagcaggaggagagactgtgcgagcaggaggagagactgtgcgagcaggaggagagactgtgcgagcaggagaagctgcccggccaggagagactgctggaggaggtggagaagctgctggagcaggagagaagacaggaggagcaggagagactgctggagagagagagactgctggacgaggtggaggagctgctggagcaggagagactgagacagcaggacgagagactgtggcagcaggagaccctgagagagctggagagactgagagagctggagagactgagagagctggagagactgagagagctggagagaatgctggagctgggctgggaggccctgtacgagcagagagccgagcccagaagcggcttcgaggagctgaacaacgagaacaagagcaccctgcagctggagcagcaggtgaaggagctggagaagagcggcggcgccgaggagcccagaggcagcgagagcgccgccgccgccagacccgtgcccggcgcccccgtgccccagggcgcctggatgtgcggccaggccggctggaccccccaggagcaccccggcctgagcggcgaggccgtgggcaccggcgaggccgccggcggcgccgaggaggccgcctgccacagcttcagagccgccgagaacagagagctgaacatcaccatcatctag

SEQ ID NO: 21591 - DNA, 1953 bp, Artificial Sequence
  Description of Artificial Sequence: Synthetic coding sequence
atgtggccccagccccacctgcccccccaccccatgatgagcgagaagaccagacagaacaagctggccgaggccaagaagaagttcaccgactacagacagtggaacatcgccggcgtgggcaccagagccaccgacaccaagaagaagaagatcaacaacggcaccaaccccgagaccaccaccagcgagggctgccacagccccgaggacacccagcagaacagagcccagctgaaggaggagaagaaggccagccaccagcaccaggaggccctgagaagagagatcgaggcccaggaccacaccatcagaatcctgacctgccagaagaccgagctggagaccgccctgtactacagccaggacgccgccagaaagttcgaggacggcaacctgggcacccccagcagcttcaacctggccctgagccaggccttcagaggcagccccctgggctgcgtgagcaccagcctgatccccggcgagagcaaggacctggccggcagactgcaccacagctggcacttcgccggcgagctgcagagagccctgagcgccgtgagcacctggcacaagaaggccgacagatacatcgaggagctgaccaaggagagagacgccctgagcctggagctgtacagaaacaccatcaccaacgaggagctgaagaagaagaacgccgagctgcaggagaagctgagactggccgagagcgagaagagcgagatccagctgaacgtgaaggagctgaagagaaagctggagagagccaagttcctgctgccccaggtgcagaccaacaccctgcaggaggagatgtggagacaggaggaggagctgagagagcaggagaagaagatcagaaagcaggaggagaagatgtggagacaggaggagagactgagagagcaggagggcaagatgagagagcaggaggagaagatgagaagacaggagaagagactgagagagcaggagaaggagctgagagagcaggagaaggagctgagagagcagaagaagctgagagagcaggaggagcagatgcaggagcaggaggagaagatgtgggagcaggaggagaagatgagagagcaggaggagaagatgtggagacaggaggagagactgtgggagcaggagaagcagatgagagagcaggagcagaagatgagagaccaggaggagagaatgtgggagcaggacgagagactgagagagaaggaggagagaatgagagagcaggagaagatgtgggagcaggtggagaagatgagagaggagaagaagatgcaggagcaggagaagaagaccagagaccaggaggagaagatgcaggaggaggagagaatcagagagagagagaagaagatgagagaggaggaggagaccatgagagagcaggaggagaagatgcagaagcaggaggagaacatgtgggagcaggaggagaaggagtggcagcagcagagactgcccgagcagaaggagaagctgtgggagcaggagaagatgcaggagcaggaggagaagatctgggagcaggaggagaagatcagagaccaggaggagatgtggggccaggagaagaagatgtggagacaggagaagatgagagagcaggaggacgagatgagagagaaggaggagagaatcagagaccagaaggagaagatgcaggagagactgcccgagcacgaggagagatgcagcgagccctgcctgccccccagcaaggtgctgtgcaacatgagccacaccggcagcgtggagcccgccggcggcgaggccggcgagggcagcccccaggacaaccccaccgcccaggagatcatgcagctgttctgcggcatgaagaacgcccagcagtgccccggcctgggcagcaccagctgcatccccttcttctacagaggcgacaagagaaagatgaagatcatcaacatctag

SEQ ID NO: 21592 - DNA, 945 bp, Artificial Sequence
  Description of Artificial Sequence: Synthetic coding sequence
atgtggagacaggaggaggagctgagagagcaggagaagaagatcagaaagcaggaggagaagatgtggagacaggaggagagactgagagagcaggagggcaagatgagagagcaggaggagaagatgagaagacaggagaagagactgagagagcaggagaaggagctgagagagcaggagaaggagctgagagagcagaagaagctgagagagcaggaggagcagatgcaggagcaggaggagaagatgtgggagcaggaggagaagatgagagagcaggaggagaagatgtggagacaggaggagagactgtgggagcaggagaagcagatgagagagcaggagcagaagatgagagaccaggaggagagaatgtgggagcaggacgagagactgagagagaaggaggagagaatgagagagcaggagaagatgtgggagcaggtggagaagatgagagaggagaagaagatgcaggagcaggagaagaagaccagagaccaggaggagaagatgcaggaggaggagagaatcagagagagagagaagaagatgagagaggaggaggagaccatgagagagcaggaggagaagatgcagaagcaggaggagaacatgtgggagcaggaggagaaggagtggcagcagcagagactgcccgagcagaaggagaagctgtgggagcaggagaagatgcaggagcaggaggagaagatctgggagcaggaggagaagatcagagaccaggaggagatgtggggccaggagaagaagatgtggagacaggagaagatgagagagcaggaggacgtgggcgccggcggcgacgccagagagggcggcgaggacaccagaagcgagagagaggacgccggcgaggccgccagagccagaggcgccgtgctgagagccctgccccccagcctgcagagcagcctgtag

SEQ ID NO: 21593 - DNA, 753 bp, Artificial Sequence
  Description of Artificial Sequence: Synthetic coding sequence
atgctgagcctgctgaacagaagacaggaggagagactgagagagcaggaggagagactgagagagcaggaggagagactgagagagcaggaggagagactgtgcgagcaggaggagagactgagagagcaggaggagagactgtgcgagcaggagaagctgcccggccaggagagactgctggaggaggtggagaagctgctggagcaggagagaagacaggaggagcaggagagactgctggagagagagagactgctggaggaggtggagaagctgctggagcaggagagactgagacagcaggacgagagactgtggcagcaggagaccctgcaggagctggagagactgagagagctggagagactgagagagctggagagaatgctggagctgggctgggaggccctgtacgagcagagagccgagcccagaagcggcttcgaggagctgaacaacgagaacaagagcaccctgcagctggagcagcaggtgaaggagctgaagaagagcggcggcgccgaggagcccagaggcagcgagagcgccgccgccgccagacccgtggccggcgcccccgtgccccagggcgcctggatgtgcggccaggccggctggaccccccaggagcaccccggcctgagcggcgaggccgtgggcaccggcgaggccgccggcggcgccggcgaggccgcctgccacagcttcagagccgccgagaacagagagctgaacatcaccatcatctag

SEQ ID NO: 21594 - DNA, 348 bp, Artificial Sequence
  Description of Artificial Sequence: Synthetic coding sequence
cacctgagactgagacagcaggacgagagactgtggcagcaggagaccctgcaggagctggagagactgagagagctggagagactgagagagctggagagaatgctggagctgggctgggaggccctgtacgagcagagagccgagcccagaagcggcttcgaggagctgaacaacgagaacaagagcaccctgcagctggagcagcaggtgaaggagctgaagaagagcggcgagctgaaggagaccgtgaccagcgaccccagcaagaagatgtgggaggccggcaccagcctgtggggcggcgaggtgcccggccacagacagctgcagcccggcgacagatag

SEQ ID NO: 21595 - DNA, 2253 bp, Artificial Sequence
  Description of Artificial Sequence: Synthetic coding sequence
atgctgatgtggccccagccccacctgcccacccacccccacctgcccacccacccccacctgcccacccacccccacctgcccacccacccccacctgcccacccacccccacctgcccacccacccccacctgcccacccaccccatgatgagcaaggagaccagacagagcaagctggccgaggccaaggagcagctgaccgaccaccacccccagaccaaccccagcgtgggcaccgccgccagcgacaccaagaagaagaagatcaacaacggcaccaaccccgagaccaccaccagcggcggctgccacagccccgaggacgagcagaaggccagccaccagcaccaggaggccctgagaagagagctggaggcccaggtgcacaccatcagaatcctgacctgccagaagaccgagctgcagatggccctgtactacagccagcacgccgtgaagcagctggagggcgaggccagagacctgatcagcagactgcacgacagctggaagttcgccggcgagctggagcaggccctgagcgccgtggccacccagaagaagaaggccgacagatacatcgaggagctgaccaaggagagagacgccctgagcctggagctgtacagaaacaccatcaccgacgaggagctgaaggagaagaacgccaagctgcaggagaagctgcagctggtggagagcgagaagagcgagatccagctgaacgtgaaggagctgaagagaaagctggagagagccaagctgctgctgccccagcagcagctgcaggccgaggccgaccacctgggcaaggagctgcagagcgtgagcgccaagctgcaggcccaggtggaggagaacgagctgtggaacagactgaaccagcagcaggaggagaagatgtggagacaggaggagaagatccaggagtgggaggagaagatccaggagcaggaggagaagatcagagagcaggaggagaagatcagagagcaggaggagaagatgagaagacaggaggagatgatgtgggagaaggaggagaagatgagaagacaggaggagatgatgtgggagaaggaggagaagatgagaagacaggaggagatgatgtgggagaaggaggagaagatgagaagacaggaggagatgatgtgggagaaggaggagaagatcagagagctggaggagaagatgcacgagcaggagaagatcagagagcaggaggagaagagacaggaggaggagaagatcagagagcaggagaagagacaggagcaggaggccaagatgtggagacaggaggagaagatcagagagcaggaggagaagatcagagagcaggagaagaagatgtggagacaggaggagaagatccacgagcaggagaagatcagagaggaggagaagagacaggagcaggaggagatgtggagacaggaggagaagatccacgagcaggaggagatctggagacagaaggagaagatgcacgagcaggaggagaagatcagaaagcaggaggagaaggtgtggagacaggaggagaagatcagagagcaggaggagaagatcagagagcaggaggagaagatgtggagacaggaggagaagatcagagagcaggaggagatgtggagagaggaggagaagatgcacgagcaggagaagatctgggaggaggagaagagacaggagcaggaggacaagatgtggagacaggaggagaagatcagagagcaggaggagaaggtgtggagacaggaggagaagatcagagagcaggaggagaagagacaggagcaggaggagaagatgtggaagcaggaggagaagatcagagagcaggaggagaagatccaggagcaggaggagaagatcagagagcaggaggagaagatcagagagcaggaggagatgacccaggagcaggaggagaagatgggcgagcaggaggagaagatgtgcgagcaggaggagaagatgcaggagcaggaggagaccatgtggagacaggaggagaagatcagagagcaggagaagaagatcagagagcaggaggagaagatcagagagcaggaggagatgatgcaggagcaggaggagaagatgtgggagcaggaggagaagatgtgcgagcaggaggagaagatgcaggagcaggaggagaagatgagaagacaggaggagaagatgtgggagcaggaggtgagactgagacagcaggaggagaagatgcaggagcactag

SEQ ID NO: 21596 - DNA, 1299 bp, Artificial Sequence
  Description of Artificial Sequence: Synthetic coding sequence
atgtggccccagcccagactgcccccccaccccgccatgagcgagaagacccagcagggcaagctggccgccgccaagaagaagctgaaggcctactggcagagaaagagccccggcatccccgccggcgccaacagaaagaagaaggtgaacggcagcagccccgacaccgccaccagcggcggctaccacagccccggcgacagcgccaccggcatctacggcgagggcagagccagcagcaccaccctgcaggacctggagagccagtaccaggagctggccgtggccctggacagcagcagcgccatcatcagccagctgaccgagaacatcaacagcctggtgagaaccagcaaggaggagaagaagcacgagatccacctggtgcagaagctgggcagaagcctgttcaagctgaagaaccagaccgccgagcccctggccccccagccccccgccggccccagcaaggtggagcagctgcaggacgagaccaaccacctgagaaaggagctggagagcgtgggcagacagctgcaggccgaggtggagaacaaccagatgctgagcctgctgaacagaagacaggaggagagactgagagagcaggaggagagactgagagagcaggaggagagactgtgcgagcaggaggagagactgtgcgagcaggaggagagactgagagagcaggaggagagactgtgcgagcaggagaagctgcccggccaggagagactgctggaggaggtggagaagctgctgaagcaggagagaagacaggaggagcaggagagactgctggagagagagagactgctggacgaggtggaggagctgctggagcaggagagactgagacagcaggacgagagactgtggcagcaggagaccctgagagagctggagagactgagagagctggagagaatgctggagctgggctgggaggccctgtacgagcagagagccgagcccagaagcggcttcgaggagctgaacaacgagaacaagagcaccctgcagctggagcagcaggtgaaggagctggagaagagcggcggcgccgaggagcccagaggcagcgagagcgccgccgccgccagacccgtgcccggcgcccccgtgccccagggcgcctggatgtgcggccaggccggctggaccccccaggagcaccccggcctgagcggcgaggccgtgggcaccggcgaggccgccggcggcgccggcgaggccgcctgccacagcttcagagccgccgagaacagagagctgaacatcaccatcatctag

SEQ ID NO: 21597 - DNA, 1812 bp, Artificial Sequence
  Description of Artificial Sequence: Synthetic coding sequence
atggccgaggagaccggccagagcaagctggccgccgccaagaagaagttcaaggagtactggcagagaaacagacccggcgtgcccgccgccgccaagagaaacaccaaggccaacggcagcagccccgagaccgccgccagcggcggctgccacagcagcgaggccagcagcagcgccagcagcagcctgcacgccagacagagcccctgccaggagcaggccgccgtgctgaacagcagaagcatcaagatcagcagactgaacgacaccatcaagagcctgaagcagcagaagaagcaggtggagcaccagctggaggaggagaagaaggccaacaacgagaagcagaaggccgagagagagctggagggccagatccagagactgaacaccgagaagaagaagctgaacaccgacctgtaccacatgaagcacagcctgagatacttcgaggaggagagcaaggacctggccggcagactgcagagaagcagccagagaatcggcgagctggagtggagcctgtgcgccgtggccgccacccagaagaagaagcccgacggcttcagcagcagaagcaaggccctgctgaagagacagctggagcagagcatcagagagcagatcctgctgaagggccacgtgacccagctgaaggagagcctgaaggaggtgcagctggagagagaccagtacgccgagcagatcaagggcgagagagcccagtggcagcagagaatgagaaagatgagccaggaggtgtgcaccctgaaggaggagaagaagcacgacacccacagagtggaggagctggagagaagcctgagcagactgaagaaccagatggccgagcccctgccccccgacgcccccgccgtgagcagcgaggtggagctgcaggacctgagaaaggagctggagagagtggccggcgagctgcaggcccaggtggagaacaaccagtgcatcagcctgctgaacagaggccagaaggagagactgagagagcaggaggagagactgcaggagcagcaggagagactgagagagagagagaagagactgcagcagctggccgagccccagagcgacctggaggagctgaagcacgagaacaagagcgccctgcagctggagcagcaggtgaaggagctgcaggagaagctgggccaggtgatggagaccctgaccagcgccgagaaggagcccgaggccgccgtgcccgccagcggcaccggcggcgagagcagcggcctgatggacctgctggaggagaaggccgacctgagagagcacgtggagaagctggagctgggcttcatccagtacagaagagagagatgccaccagaaggtgcacagactgctgaccgagcccggcgacagcgccaaggacgccagccccggcggcggccaccaccaggccggccccggccagggcggcgaggagggcgaggccgccggcgccgccggcgacggcgtggccgcctgcggcagctacagcgagggccacggcaagttcctggccgccgccagaaaccccgccgccgagcccagccccggcgcccccgccccccaggagctgggcgccgccgacaagcacggcgacctgtgcgaggccagcctgaccaacagcgtggagcccgcccagggcgaggccagagagggcagcagccaggacaaccccaccgcccagcccgtggtgcagctgctgggcgagatgcaggaccaccaggagcaccccggcctgggcagcaactgctgcgtgccctgcttctgctgggcctggctgcccagaagaagaagatag

SEQ ID NO: 21598 - DNA, 1812 bp, Artificial Sequence; identical to SEQ ID NO: 21597
  Description of Artificial Sequence: Synthetic coding sequence

SEQ ID NO: 21599 - DNA, 1902 bp, Artificial Sequence
  Description of Artificial Sequence: Synthetic coding sequence
atgctgcccgtggacggcgaggagagaaagagcgagggcagcgacaccgagggcgacagaaccagcccctgcgccggccccaccagcagcgccaccctgaaggacctggaggtgggcggcagcggcagaagatgcagcgaccccgccggccagcccagcaacctgctgccccagagaggcctgggcgcccccctgcccgccgagaccgcccacacccagcccagccccaacgacagaagcctgtacctgagccccaagagcagcagcgccagcagcagcctgcacgccagacagagcccctgccaggagcaggccgccgtgctgaacagcagaagcatcaagatcagcagactgaacgacaccatcaagagcctgaagcagcagaagaagcaggtggagcaccagctggaggaggagaagaaggccaacaacgagaagcagaaggccgagagagagctggagggccagatccagagactgaacaccgagaagaagaagctgaacaccgacctgtaccacatgaagcacagcctgagatacttcgaggaggagagcaaggacctggccggcagactgcagagaagcagccagagaatcggcgagctggagtggagcctgtgcgccgtggccgccacccagaagaagaagcccgacggcttcagcagcagaagcaaggccctgctgaagagacagctggagcagagcatcagagagcagatcctgctgaagggccacgtgacccagctgaaggagagcctgaaggaggtgcagctggagagagaccagtacgccgagcagatcaagggcgagagagcccagtggcagcagagaatgagaaagatgagccaggaggtgtgcaccctgaaggaggagaagaagcacgacacccacagagtggaggagctggagagaagcctgagcagactgaagaaccagatggccgagcccctgccccccgacgcccccgccgtgagcagcgaggtggagctgcaggacctgagaaaggagctggagagagtggccggcgagctgcaggcccaggtggagaacaaccagtgcatcagcctgctgaacagaggccagaaggagagactgagagagcaggaggagagactgcaggagcagcaggagagactgagagagagagagaagagactgcagcagctggccgagccccagagcgacctggaggagctgaagcacgagaacaagagcgccctgcagctggagcagcaggtgaaggagctgcaggagaagctgggccaggtgatggagaccctgaccagcgccgagaaggagcccgaggccgccgtgcccgccagcggcaccggcggcgagagcagcggcctgatggacctgctggaggagaaggccgacctgagagagcacgtggagaagctggagctgggcttcatccagtacagaagagagagatgccaccagaaggtgcacagactgctgaccgagcccggcgacagcgccaaggacgccagccccggcggcggccaccaccaggccggccccggccagggcggcgaggagggcgaggccgccggcgccgccggcgacggcgtggccgcctgcggcagctacagcgagggccacggcaagttcctggccgccgccagaaaccccgccgccgagcccagccccggcgcccccgccccccaggagctgggcgccgccgacaagcacggcgacctgtgcgaggccagcctgaccaacagcgtggagcccgcccagggcgaggccagagagggcagcagccaggacaaccccaccgcccagcccgtggtgcagctgctgggcgagatgcaggaccaccaggagcaccccggcctgggcagcaactgctgcgtgccctgcttctgctgggcctggctgcccagaagaagaagatag

SEQ ID NO: 21600 - DNA, 1383 bp, Artificial Sequence
  Description of Artificial Sequence: Synthetic coding sequence
atgaagcacagcctgagatacttcgaggaggagagcaaggacctggccggcagactgcagagaagcagccagagaatcggcgagctggagtggagcctgtgcgccgtggccgccacccagaagaagaagcccgacggcttcagcagcagaagcaaggccctgctgaagagacagctggagcagagcatcagagagcagatcctgctgaagggccacgtgacccagctgaaggagagcctgaaggaggtgcagctggagagagaccagtacgccgagcagatcaagggcgagagagcccagtggcagcagagaatgagaaagatgagccaggaggtgtgcaccctgaaggaggagaagaagcacgacacccacagagtggaggagctggagagaagcctgagcagactgaagaaccagatggccgagcccctgccccccgacgcccccgccgtgagcagcgaggtggagctgcaggacctgagaaaggagctggagagagtggccggcgagctgcaggcccaggtggagaacaaccagtgcatcagcctgctgaacagaggccagaaggagagactgagagagcaggaggagagactgcaggagcagcaggagagactgagagagagagagaagagactgcagcagctggccgagccccagagcgacctggaggagctgaagcacgagaacaagagcgccctgcagctggagcagcaggtgaaggagctgcaggagaagctgggccaggtgatggagaccctgaccagcgccgagaaggagcccgaggccgccgtgcccgccagcggcaccggcggcgagagcagcggcctgatggacctgctggaggagaaggccgacctgagagagcacgtggagaagctggagctgggcttcatccagtacagaagagagagatgccaccagaaggtgcacagactgctgaccgagcccggcgacagcgccaaggacgccagccccggcggcggccaccaccaggccggccccggccagggcggcgaggagggcgaggccgccggcgccgccggcgacggcgtggccgcctgcggcagctacagcgagggccacggcaagttcctggccgccgccagaaaccccgccgccgagcccagccccggcgcccccgccccccaggagctgggcgccgccgacaagcacggcgacctgtgcgaggccagcctgaccaacagcgtggagcccgcccagggcgaggccagagagggcagcagccaggacaaccccaccgcccagcccgtggtgcagctgctgggcgagatgcaggaccaccaggagcaccccggcctgggcagcaactgctgcgtgccctgcttctgctgggcctggctgcccagaagaagaagatag

SEQ ID NO: 21601 - DNA, 1899 bp, Artificial Sequence
  Description of Artificial Sequence: Synthetic coding sequence
atggccgaggagacccagcacaacaagctggccgccgccaagaagaagctgaaggagtactggcagaagaacagccccagagtgcccgccggcgccaacagaaacagaaagaccaacggcagcatcccccagaccgccaccagcggcggctgccagccccccggcgacagcgccaccggcttccacagagagggccccaccagcagcgccaccctgaaggacctggagagcccctgccaggagagagccgtggtgctggacagcagaagcgtggagatcagccagctgaagaacaccatcaagagcctgaagcagcagaagaagcaggtggagcaccagctggaggaggagaagaaggccaacatcaagaagcagaaggccaagagagtgctggaggtgcagatccagaccctgaacatccagaaggaggagctgaacaccgacctgtaccacatgaagagaagcctgagatacttcgaggagaagagcaaggacctggccgtgagactgcagcacagcctgcagagaaagggcgagctggagagcgtgctgagcgacgtgatggccacccagaagaagaaggccaaccagctgagcagccccagcaaggccggcaccgagtggaagctggagcagagcatgagagaggaggccctgctgaaggtgcagctgacccagctgaaggagagcttccagcagctgcagctggagagacacgagtacgccgagcacctgaagggcgagagagccagatggcagcagagaatgagaaagatgagccaggagatctgcaccctgaagaaggagaagcagcaggacatgagaagagtggagaagctggagagaagcctgagcaagctgaagaaccagatggccgagcccctgccccccgagccccccgccgtgcccagcgaggtggagctgcagcacctgagaaaggagctggagagagtggccggcgccctgcaggcccaggtgaagaacaaccagagaatcagcctgctgaacagaggccaggaggagagaatcagagagcaggaggagagactgagaaagcaggaggagagaatccaggagcagcacaagagcctgcagcagctggccaagccccagagcgtgttcgaggagcccaacaacgagaacaagagcgccctgcagctggagcagcaggtgaaggagctgcaggagaagctgggcgaggagcacctggaggccgccagccagcagaaccagcagctgaccgcccagctgagcctgatggccctgcccggcgagggccacggcggcgagcacctggacagcgagggcgaggaggccccccagcccatgcccagcgtgcccgaggacctggagagcagagaggccatgagcagcttcatggaccacctggaggagaaggccgacctgagcgagctggtgaagaagaaggagctgtgcttcatccaccactggagagagagatgccaccagaagacccaccacctgctgagcgagcccggcggcagagccaaggacgccgccctgggcggcggccaccaccaggccggcgcccagggcggcgacgagggcgaggccgccggcgccgccgccgacggcatcgccgcctacagcaactacaacaacggccacagaaagttcctggccgccgcccacaaccccgccgacgagcccggccccggcgcccccgccccccaggagctgggcgccgccgacaagcacggcgacctgtgcgaggtgagcctgaccagcagcgcccagggcgaggccagagaggaccccctgctggacaagcccaccgcccagcccatcgtgcaggaccaccaggagcaccccggcctgggcagcaactgctgcgtgcccttcttctgctgggcctggctgcccagaagaagaagatag

SEQ ID NO: 21602 - DNA, 1338 bp, Artificial Sequence
  Description of Artificial Sequence: Synthetic coding sequence
atggccacccagaagaagaaggccaaccagctgagcagcagaagcaaggccagaaccgagtggaagctggagcagagcatgagagaggaggccctgctgaaggtgcagctgacccagttcaaggagagcttccagcaggtgcagctggagagagacgagtacagcgagcacctgaagggcgagagagccagatggcagcagagaatgagaaagatgagccaggagatctgcaccctgaagaaggagaagcagcaggacatgagaagagtggagaagctggagagaagcctgagcaagctgaagaaccagatggccgagcccctgccccccgagccccccgccgtgcccagcgaggtggagctgcagcacctgagaaaggagctggagagagtggccggcgagctgcaggcccaggtgaagaacaaccagagaatcagcctgctgaaccagagacaggaggagagaatcagagagcaggaggagagactgagaaagcaggaggagagaatccaggagcagcacaagagcctgcagcagctggccaagccccagagcgtgttcaaggagcccaacaacgagaacaagaacgccctgcagctggagcagcaggtgaaggagctgcaggagaagctgggcgaggagcacctggaggccgccagccagcagaaccagcagctgaccgcccagctgagcctgatggccctgcccggcgagggccacggcggcgagcacctggacagcgagggcgaggaggcccccagacccatgcccagcgtgcccgaggaccccgagagcagagaggccatgagcagcttcatggaccacctggaggagaaggccgacctgagcgagctggtgaagaagaaggagctgtgcttcatccaccactggagagagagatgccaccagaagacccaccacctgctgagcgagcccggcggcagagccaaggacgccgccctgggcggcggccaccaccaggccggcgcccagggcggcgacgagggcgaggccgccggcgccgccgccgacggcatcgccgcctacagcaactacaacaacggccacagaaagttcctggccgccgcccacaacagcgccgacgagcccggccccggcgcccccgccccccaggagctgggcgccgccgacaagcacggccacctgtgcgaggtgagcctgaccagcagcgcccagggcgaggccagagaggaccccctgctggacaagcccaccgcccagcccatcgtgcaggaccaccaggagcaccccggcctgggcagcaactgctgcgtgcccttcctgtgctgggcctggctgcccagaagaagaagatag

SEQ ID NO: 21603 - DNA, 1299 bp, Artificial Sequence; identical to SEQ ID NO: 21596
  Description of Artificial Sequence: Synthetic coding sequence

SEQ ID NO: 21604 - DNA, 1896 bp, Artificial Sequence
  Description of Artificial Sequence: Synthetic coding sequence
atggccgaggagacccagcacaacaagctggccgccgccaagaagaagctgaaggagtactggcagaagaacagacccagagtgcccgccggcgtgaacagaaacagaaagaccaacggcagcatccccgagaccgccaccagcggcggctgccagccccccggcgacagcgccaccggcttccacagagagggccccaccagcagcgccaccctgaaggacctggagagcccctgccaggagagagccgtggtgctggacagcaccagcgtgaagatcagcagactgaagaacaccatcaagagcctgaagcagcagaagaagcaggtggagcaccagctggaggaggagaagaaggccaacaacgagagacagaaggccgagagagtgctggaggtgcagatccagaccctgatcatccagaaggaggagctgaacaccgacctgtaccacatggagagaagcctgagatacttcgaggaggagagcaaggacctggccgtgagactgcagcacagcctgcagtgcaagggcgagctggagagagccctgagcgccgtgatcgccaccgagaagaagaaggccaaccagctgagcagctgcagcaaggcccacaccgagtgggagctggagcagagcctgcaggaccaggccctgctgaaggcccagctgacccagctgaaggagagcttccagcagctgcagctggagagagacgagtgcgccgagcacatcgagggcgagagagccagatggcaccagagaatgagcaagatgagccaggagatctgcaccctgaagaaggagaagcaggacatgagatgggtggagcagctggagtggagcctgagcaagctgaagaaccagaccgccgagcccctgccccccgagccccccgccgtgcccagcgaggtggagctgcagcacctgagaaaggagctggagagagtggccggcgagctgcagagccaggtgaagaacaaccagcacatcagcctgctgaacagaagacaggaggagagaatcagagagcaggaggagagactgagaaagcaggaggagagactgcaggagcagcacgagaagctgagacagctggccaagccccagagcgtgttcgaggagctgaacaacgagaacaagagcaccctgcagctggagcagcaggtgaaggagctgcaggagaagctgggcgaggagcacctggaggtggccagccagcagaaccagcagctgaccgcccagctgagcctgatggccctgcccggcgagggccacggcggcgagcacctggacagcgagggcgaggaggccccccagcccatgcccagcgtgcccgaggaccccgagagcagagaggccatgagcagcttcatggaccacctgaaggagaaggccgacctgagcgagctgctgaagaagcaggagctgagattcatccagtactggcaggagagatgccaccagaagatccaccacctgctgagcgagcccggcggcagagccaaggacgccgccctgggcggcggccaccaccaggccggcgcccagggcggcgacgagggcgaggccgccggcgccgccgccgacggcatcgccgcctacagcaactacaacaacggccacagaaagttcctggccgccgcccacaacagcgccgacgagcccggccccggcgcccccgccccccaggagctgggcgccgccgacaagcacggcgacctgagagaggtgaccctgaccagcagcgcccagggcgaggccagagaggaccccctgctggacaagcccaccgcccagcccatcgtgcaggaccaccaggagcaccccggcctgggcagcaactgctgcgtgcccctgttctgctgggcctggctgcccagaagaagaagatag

SEQ ID NO: 21605 - DNA, 885 bp, Artificial Sequence
  Description of Artificial Sequence: Synthetic coding sequence
atggccgaggagacccagcacaacaagctggccgccgccaagaagaagctgaaggagtactggcagaagaacagacccagagtgcccgccggcgtgaacagaaacagaaagaccaacggcagcatccccgagaccgccaccagcggcggctgccagccccccggcgacagcgccaccggcttccacagagagggccccaccagcagcgccaccctgaaggacctggagagcccctgccaggagagagccgtggtgctggacagcaccagcgtgaagatcagcagactgaagaacaccatcaagagcctgatctgcaccctgaagaaggagaagcaggacatgagatgggtggagcagctggagtggagcctgagcaagctgaagaaccagaccgccgagcccctgccccccgagccccccgccgtgcccagcgaggtggagctgcagcacctgagaaaggagctggagagagtggccggcgagctgcagagccaggtgaagaacaaccagcacatcagcctgctgaacagaagacaggaggagagaatcagagagcaggaggagagactgagaaagcaggaggagagactgcaggagcagcacgagaagctgagacagctggccaagccccagagcgtgttcgaggagctgaacaacgagaacaagagcaccctgcagctggagcagcaggtgaaggagctgcaggagaagctgggcgaggtgaaggagaccgagaccagcacccccagcaagaagggctgggaggccggcagcagcctgctgggcggcgaggtgcccggccagagacagctgcccgcctggggcctggtgaccaccgcccccagaagagccgtgctgagactgttcctgaccagctgcctgtag

SEQ ID NO: 21606 - DNA, 519 bp, Artificial Sequence
  Description of Artificial Sequence: Synthetic coding sequence
atggccggcgccgcccccaccaccgccttcggccaggccgtgatcggcccccccggcagcggcaagaccacctactgcctgggcatgagcgagttcctgagagccctgggcagaagagtggccgtggtgaacctggaccccgccaacgagggcctgccctacgacatcttcagccagatggcccagtgggacctgagactgaccgccgtgcacctggtggacagccactactgcaccgaccccgccaagttcatcagcgtgctgtgcaccagcctggccaccatgctgcacgtggagctgccccacatcaacctgctgagcaagatggacctgatcgagcactacggcaagctggccttcaacctggactactacaccgaggtgctggacctgagctacctgctggaccacctggccagcgaccccttcttcagacactacagacagctgaacgagaagctggtgcagctgatcgaggactacagcctggtgagcttcatccccctgaacatccagtag

SEQ ID NO: 21607 - DNA, 396 bp, Artificial Sequence
  Description of Artificial Sequence: Synthetic coding sequence
atgctggccggcctggagctgctgaccagcgccttcaacctggactactacaccgaggtgctggacctgagctacctgctggaccacctggccagcgaccccttcttcagacactacagacagctgaacgagaagctggtgcagctgatcgaggactacagcctggtgagcttcatccccctgaacatccaggacaaggagagcatccagagagtgctgcaggccgtggacaaggccaacggctactgcttcagagcccaggagcagagaagcctggaggccatgatgagcgccgccatgggcgccgacttccacttcagcagcaccctgggcatccaggagaagtacctggcccccagcaaccagagcgtggagcaggaggccatgcagctgtag

SEQ ID NO: 21608 - DNA, 933 bp, Artificial Sequence
  Description of Artificial Sequence: Synthetic coding sequence
atggccggcgccgcccccaccaccgccttcggccaggccgtgatcggcccccccggcagcggcaagaccacctactgcctgggcatgagcgagttcctgagagccctgggcagaagagtggccgtggtgaacctggaccccgccaacgagggcctgccctacgagtgcgccgtggacgtgggcgagctggtgggcctgggcgacgtgatggacgccctgagactgggccccaacggcggcctgctgtactgcatggagtacctggaggccaacctggactggctgagagccaagctggaccccctgagaggccactacttcctgttcgactgccccggccaggtggagctgtgcacccaccacggcgccctgagaagcatcttcagccagatggcccagtgggacctgagactgaccgccgtgcacctggtggacagccactactgcaccgaccccgccaagttcatcagcgtgctgtgcaccagcctggccaccatgctgcacgtggagctgccccacatcaacctgctgagcaagatggacctgatcgagcactacggcaagctggccttcaacctggactactacaccgaggtgctggacctgagctacctgctggaccacctggccagcgaccccttcttcagacactacagacagctgaacgagaagctggtgcagctgatcgaggactacagcctggtgagcttcatccccctgaacatccaggacaaggagagcatccagagagtgctgcaggccgtggacaaggccaacggctactgcttcagagcccaggagcagagaagcctggaggccatgatgagcgccgccatgggcgccgacttccacttcagcagcaccctgggcatccaggagaagtacctggcccccagcaaccagagcgtggagcaggaggccatgcagctgtag

SEQ ID NO: 21609 - DNA, 519 bp, Artificial Sequence; identical to SEQ ID NO: 21606
  Description of Artificial Sequence: Synthetic coding sequence

SEQ ID NO: 21610 - DNA, 537 bp, Artificial Sequence
  Description of Artificial Sequence: Synthetic coding sequence
atgcccgcctaccacagcagcctgatggaccccgacaccaagctgatcggcaacatggccctgctgcccatcagaagccagttcaagggccccgcccccagagagaccaaggacaccgacatcgtggacgaggccatctactacttcaaggccaacgtgttcttcaagaactacgagatcaagaacgaggccgacagaaccctgatctacatcaccctgtacatcagcgagtgcctgaagaagctgcagaagtgcaacagcaagagccagggcgagaaggagatgtacaccctgggcatcaccaacttccccatccccggcgagcccggcttccccctgaacgccatctacgccaagcccgccaacaagcaggaggacgaggtgatgagagcctacctgcagcagctgagacaggagaccggcctgagactgtgcgagaaggtgttcgacccccagaacgacaagcccagcaagtggtggacctgcttcgtgaagagacagttcatgaacaagagcctgagcggccccggccagtag

SEQ ID NO: 21611 - DNA, 885 bp, Artificial Sequence
  Description of Artificial Sequence: Synthetic coding sequence
atgcccagatacgcccagctggtgatgggccccgccggcagcggcaaggtgagaatctgcggcgacaaggagagaaagagcacctactgcgccaccatggtgcagcactgcgaggccctgaacagaagcgtgcaggtggtgaacctggaccccgccgccgagcacttcaactacagcgtgatggccgacatcagagagctgatcgaggtggacgacgtgatggaggacgacagcctgagattcggccccaacggcggcctggtgttctgcatggagtacttcgccaacaacttcgactggctggagaactgcctgggccacgtggaggacgactacatcctgttcgactgccccggccagatcgagctgtacacccacctgcccgtgatgaagcagctggtgcagcagctggagcagtgggagttcagagtgtgcggcgtgttcctggtggacagccagttcatggtggagagcttcaagttcatcagcggcatcctggccgccctgagcgccatgatcagcctggagatcccccaggtgaacatcatgaccaagatggacctgctgagcaagaaggccaagaaggagatcgagaagttcctggaccccgacatgtacagcctgctggaggacagcaccagcgacctgagaagcaagaagttcaagaagctgaccaaggccatctgcggcctgatcgacgactacagcatggtgagattcctgccctacgaccagagcgacgaggagagcatgaacatcgtgctgcagcacatcgacttcgccatccagtacggcgaggacctggagttcaaggagcccaaggagagagaggacgagagcagcagcatgttcgacgagtacttccaggagtgccaggacgagtag

SEQ ID NO: 21612 - DNA, 972 bp, Artificial Sequence
  Description of Artificial Sequence: Synthetic coding sequence
atgctgcccaagaccagaggcgccttccacttcagcatccccgacccccagcacatctgcaagagcagaggcagcccctacagaagcaacgtgtgcacccagaccaccgacagaagcacctggagaaaggacgccgagctgtacctgctgagcgtgatcacccagagcacctactgcgccaccatggtgcagcactgcgaggccctgaacagaagcgtgcaggtggtgaacctggaccccgccgccgagcacttcaactacagcgtgatggccgacatcagagagctgatcgaggtggacgacgtgatggaggacgacagcctgagattcggccccaacggcggcctggtgttctgcatggagtacttcgccaacaacttcgactggctggagaactgcctgggccacgtggaggacgactacatcctgttcgactgccccggccagatcgagctgtacacccacctgcccgtgatgaagcagctggtgcagcagctggagcagtgggagttcagagtgtgcggcgtgttcctggtggacagccagttcatggtggagagcttcaagttcatcagcggcatcctggccgccctgagcgccatgatcagcctggagatcccccaggtgaacatcatgaccaagatggacctgctgagcaagaaggccaagaaggagatcgagaagttcctggaccccgacatgtacagcctgctggaggacagcaccagcgacctgagaagcaagaagttcaagaagctgaccaaggccatctgcggcctgatcgacgactacagcatggtgagattcctgccctacgaccagagcgacgaggagagcatgaacatcgtgctgcagcacatcgacttcgccatccagtacggcgaggacctggagttcaaggagcccaaggagagagaggacgagagcagcagcatgttcgacgagtacttccaggagtgccaggacgagtag

SEQ ID NO: 21613 - DNA, 2331 bp, Artificial Sequence
  Description of Artificial Sequence: Synthetic coding sequence
atgggcaccgtgcccgaccccctgagaagcgccaagaccagcctgatcgccgccagcggcaaggaggacgacctgggcgagccccaggccgccagccccagacacagacccgccctgctgtgcaagaacgccaacggcttcagcggcgcccccgccgagcccgacctgagccccagagccgccgccgaggccctgatgcaggtgtgcgagcacgagaccacccagcccgacatgagcagccccggcgtgttcaacgaggtgcagaaggcccccgccaccttcaacagccccggcaacccccagctgcccggcagcagccagcccgccgccagcgcccccagcagcgccgccggcagagacctgatccacacccccctgaccatgcccgccaaccagcacacctgccagagcatccccggcgaccagcccaacgccatcaccagcagcatgcccgaggacagcctgatgagaagccagagaaccagcaacagagagcagcccgagaagcccagctgccccgtgggcggcgtgctgagcagcagcaaggaccaggtgagctgcgagttccccagccccgagaccatccagggcaccgtgcagacccccgtgaccgccgccagagtggtgagccacagcagcagccccgtgggcggccccgagggcgagagacagggcgccatctgcgacagcgagatgagaagctgcaagcccctgaccagagagagcggctgcagcgagaacaagcagcccagcgtgaccgccagcggcccccagggcaccaccagcgtgaccccccagcccacccccctgaccagcgagcccagcgcctgcccccccggccccgagaaggtgcccctgcccgcccagagacagatgagcagattcaaggaggccagcaccatgaccaaccaggccgagagcgagatcaaggaggtgcccagcagagcctggcaggacgccgaggtgcaggccgtggccagcgtggagagcagaagcgtgagcaccagccccagcatcctgaccgccttcctgaaggagagcagagcccccgagcacttcgagcaggagcagctgagagtgatctgccacagcagcggcagccacaccctggagctgagcgacagcaccctggccccccaggagagcagccagtgccccggcatcatgccccaggtgcacatccaggccgccgccgccgagagcaccgccttccagagagagaacaagctggccagcctgcccggcggcgtgctgaagaccagcagcatcaacctggtgagcagcaacgcccagcacacctgcaaggaggacggcagactggccggcatgacccccgtgagagaggagagcaccgccaagaagctggccggcaccaacagcagcagcctgaaggccaccgccatcgaccagatcagcatcagcgcctgcagccaggccgagaccagctacggcctgggcaagttcgagaccagacccagcgagttcgccgagaagaccaccaacggccacaagaccgaccccgactgcaagctgagcgacagctgcggcagcatcagcaaggccgaccacagcggcagcctggaccccaccaacaagggcgacgccagagagaagaagcccgccagcccccaggtggtgaaggagaaggagagcaccggcaccgacaccagcgacgccaagaccctgctgctgaaccccaagagccaggagagcggcggcaccgagagcgccgccaaccccacccccagccccatcagaaagaaccaggagagcaccctggaggagaacagacagaccaagaccgccaccagcctgagcctgcccagcgaccccatgggcgacagcagccccggcagcggcaagaagacccccagcagaagcgtgaaggccagccccagaagacccagcagagtgagcgagttcctgaaggagcagaagctgaacgtgaccgccgccgccgcccaggtgggcctgacccccggcgacaagaagaagcagctgggcgccgacagcaagctgcagctgaagcagagcaagagagtgagagacgtggtgtgggacgagcagggcatgacctgggaggtgtacggcgccagcctggacgccgagagcctgggcatcgccatccagaaccacctgcagagacagatcagagagcacgagaagctgatcaagacccagaacagccagaccagaagaagcatcagcagcgacaccagcagcaacaagaagctgagaggcagacagcacagcgtgttccagagcatgctgcagaacttcagaagacccaactgctgcgtgagacccgcccccagcagcgtgctggactag

SEQ ID NO: 21614 - DNA, 1299 bp, Artificial Sequence
  Description of Artificial Sequence: Synthetic coding sequence
atgaccgagctgcagcaggacgtggaggacaccaagcccgccaaggtgctgggcaagagagagagcaagctgggcagcgcccacagcgaggccgagaacggcgtggaggagaagaagaaggcctgcagaagccccaccgcccagagccccacccccagcgtggaggccgacagccccgaccagaagaagatcatcagcctgtggagcaagagcagcttcgacggcgccagcctggccagcgacaagaacgactgcaagaccgagagcaagaacgaccccaagaccgagagaaagaagagcagcagcagcagccagtacaaggccaacatgcacttccacaagctgttcctgagcgtgcccaccgaggagcccctgaagcagagcttcacctgcgccctgcagaaggagatcctgtaccagggcaagctgttcgtgagcgagaactggatctgcttccacagcaaggtgttcggcaaggacaccaagatcagcatccccgccttcagcgtgaccctgatcaagaagaccaagaccgccctgctggtgcccaacgccctgatcatcgccaccgtgaccgacagatacatcttcgtgagcctgctgagcagagacagcacctacaagctgctgaagagcgtgtgcggccacctggagaacaccagcgtgggcaacagccccaaccccagcagcgccgagaacagcttcagagccgacagacccagcagcctgcccctggacttcaacgacgagttcagcgacctggacggcgtggtgcagcagagaagacaggacatggagggctacagcagcagcggcagccagacccccgagagcgagaacagcagagacttccacgccaccgagagccagaccgtgctgaacgtgagcaagggcgaggccaagcccaccagagccgacgcccacgtgaacagagtgcccgagggcaaggccaagagcctgcccgtgcagggcctgagcgagaccgtgggcatcctgcacaaggtgaagagccagaagtgccccatgctgcaccacatcctgatcttctacgccatcgtggtgtgcgccctgatcatcagcaccttctacatgagatacagaatcaacaccctggaggagcagctgggcctgctgaccagcatcgtggacacccacaacaccgagcaggccgcccccagcggcctgagaagccaggtgcagttcaacgtggaggtgctgtgccaggagctgaccgccaacatcgtgaagctggagaagatccagaacaacctgcagaagctgctggagaacggcgactag

SEQ ID NO: 21615 - DNA, 1323 bp, Artificial Sequence
  Description of Artificial Sequence: Synthetic coding sequence
atgtggaagacccagagcctgagaaagtgcagcggcagaggcagagccaacctggcccagcccacccagagactgagaatggtgtggagaagaaagagaaagcccgccggcagacagcagcccaaccccctgccccacctgtggagaagaaccccccagaccagaagaaagagcctggcctacgcccacatcttcagccccaacctgtgcttcatccaggaccaggagagcaagagcagcttcgacggcgccagcctggccagcgacaagaacgactgcaagaccgagagcaagaacgaccccaagaccgagagaaagaagagcagcagcagcagccagtacaaggccaacatgcacttccacaagctgttcctgagcgtgcccaccgaggagcccctgaagcagagcttcacctgcgccctgcagaaggagatcctgtaccagggcaagctgttcgtgagcgagaactggatctgcttccacagcaaggtgttcggcaaggacaccaagatcagcatccccgccttcagcgtgaccctgatcaagaagaccaagaccgccctgctggtgcccaacgccctgatcatcgccaccgtgaccgacagatacatcttcgtgagcctgctgagcagagacagcacctacaagctgctgaagagcgtgtgcggccacctggagaacaccagcgtgggcaacagccccaaccccagcagcgccgagaacagcttcagagccgacagacccagcagcctgcccctggacttcaacgacgagttcagcgacctggacggcgtggtgcagcagagaagacaggacatggagggctacagcagcagcggcagccagacccccgagagcgagaacagcagagacttccacgccaccgagagccagaccgtgctgaacgtgagcaagggcgaggccaagcccaccagagccgacgcccacgtgaacagagtgcccgagggcaaggccaagagcctgcccgtgcagggcctgagcgagaccgtgggcatcctgcacaaggtgaagagccagaagtgccccatgctgcaccacatcctgatcttctacgccatcgtggtgtgcgccctgatcatcagcaccttctacatgagatacagaatcaacaccctggaggagcagctgggcctgctgaccagcatcgtggacacccacaacaccgagcaggccgcccccagcggcctgagaagccaggtgcagttcaacgtggaggtgctgtgccaggagctgaccgccaacatcgtgaagctggagaagatccagaacaacctgcagaagctgctggagaacggcgactag

SEQ ID NO: 21616 - DNA, 1116 bp, Artificial Sequence
  Description of Artificial Sequence: Synthetic coding sequence
atgaccgagctgcagcaggacgtggaggacaccaagcccgccaaggtgctgggcaagagagagagcaagctgggcagcgcccacagcgaggccgagaacggcgtggaggagaagaagaaggcctgcagaagccccaccgcccagagccccacccccagcgtggaggccgacagccccgaccagaagaagatcatcagcctgtgcccctacctgctgagcaagagcatgctgcacagcggccccagatacaaggccaacatgcacttccacaagctgttcctgagcgtgcccaccgaggagcccctgaagcagagcttcacctgcgccctgcagaaggagatcctgtaccagggcaagctgttcgtgagcgagaactggatctgcttccacagcaaggtgttcggcaaggacaccaagatcagcatccccgccttcagcgtgaccctgatcaagaagaccaagaccgccctgctggtgcccaacgccctgatcatcgccaccgtgaccgacagatacatcttcgtgagcctgctgagcagagacagcacctacaagctgctgaagagcgtgtgcggccacctggagaacaccagcgtgggcaacagccccaaccccagcagcgccgagaacagcttcagagccgacagacccagcagcctgcccctggacttcaacgacgagttcagcgacctggacggcgtggtgcagcagagaagacaggacatggagggctacagcagcagcggcagccagacccccgagagcgagaacagcagagtggacttccacgccaccgagagccagaccgtgctgaacgtgagcaagggcgaggccaagcccaccagagccgacgcccacgtgaacagagtgcccgagggcaaggccaagagcctgcccgtgcagggcctgagcgagaccgtgggcatcctgcacaaggtgaagagccagaagtgccccatgctgcaccacatcctgatcttctacgccatcgtggtgtgcgccctgatcatcagcaccttctacatgagatacagaatcaacaccctggaggagcagctgggcctgctgaccagcatcgtggacacccacaacaccgagcagcaccacctggcctag

SEQ ID NO: 21617 - DNA, 879 bp, Artificial Sequence
  Description of Artificial Sequence: Synthetic coding sequence
atgagcaaggtgaagagattccccttcttcttcagcagcgaggccgagaacggcgtggaggagaagaagaaggcctgcagaagccccaccgcccagagccccacccccagcgtggaggccgacagccccgaccagaagaagatcatcagcctgtggagcaagagcagcttcgacggcgccagcctggccagcgacaagaacgactgcaagaccgagagcaagaacgaccccaagaccgagagaaagaagagcagcagcagcagccagtacaaggccaacatgcacttccacaagctgttcctgagcgtgcccaccgaggagcccctgaagcagagcttcacctgcgccctgcagaaggagatcctgtaccagggcaagctgttcgtgagcgagaactggatctgcttccacagcaaggtgttcggcaaggacaccaagatcagcatccccgccttcagcgtgaccctgatcaagaagaccaagaccgccctgctggtgcccaacgccctgatcatcgccaccgtgaccgacagatacatcttcgtgagcctgctgagcagagacagcacctacaagctgctgaagagcgtgtgcggccacctggagaacaccagcgtgggcaacagccccaaccccagcagcgccgagaacagcttcagagccgacagacccagcagcctgcccctggacttcaacgacgagttcagcgacctggacggcgtggtgcagcagagaagacaggacatggagggctacagcagcagcggcagccagacccccgagagcgagaacagcagagacttccacgccaccgagagccagaccgtgctgaacgtgagcatcttcctgtacagcatgcagctgctgagcgtgcactag

SEQ ID NO: 21618 - DNA, 987 bp, Artificial Sequence
  Description of Artificial Sequence: Synthetic coding sequence
atgtacaaggccaacatgcacttccacaagctgttcctgagcgtgcccaccgaggagcccctgaagcagagcttcacctgcgccctgcagaaggagatcctgtaccagggcaagctgttcgtgagcgagaactggatctgcttccacagcaaggtgttcggcaaggacaccaagatcagcatccccgccttcagcgtgaccctgatcaagaagaccaagaccgccctgctggtgcccaacgccctgatcatcgccaccgtgaccgacagatacatcttcgtgagcctgctgagcagagacagcacctacaagctgctgaagagcgtgtgcggccacctggagaacaccagcgtgggcaacagccccaaccccagcagcgccgagaacagcttcagagccgacagacccagcagcctgcccctggacttcaacgacgagttcagcgacctggacggcgtggtgcagcagagaagacaggacatggagggctacagcagcagcggcagccagacccccgagagcgagaacagcagagacttccacgccaccgagagccagaccgtgctgaacgtgagcaagggcgaggccaagcccaccagagccgacgcccacgtgaacagagtgcccgagggcaaggccaagagcctgcccgtgcagggcctgagcgagaccgtgggcatcctgcacaaggtgaagagccagaagtgccccatgctgcaccacatcctgatcttctacgccatcgtggtgtgcgccctgatcatcagcaccttctacatgagatacagaatcaacaccctggaggagcagctgggcctgctgaccagcatcgtggacacccacaacaccgagcaggccgcccccagcggcctgagaagccaggtgcagttcaacgtggaggtgctgtgccaggagctgaccgccaacatcgtgaagctggagaagatccagaacaacctgcagaagctgctggagaacggcgactag

SEQ ID NO: 21619 - DNA, 1251 bp, Artificial Sequence
  Description of Artificial Sequence: Synthetic coding sequence
atgagcaaggtgaagagattccccttcttcttcagcagcgaggccgagaacggcgtggaggagaagaagaaggcctgcagaagccccaccgcccagagccccacccccagcgtggaggccgacagccccgaccagaagaagatcatcagcctgtggagcaagagcagcttcgacggcgccagcctggccagcgacaagaacgactgcaagaccgagagcaagaacgaccccaagaccgagagaaagaagagcagcagcagcagccagtacaaggccaacatgcacttccacaagctgttcctgagcgtgcccaccgaggagcccctgaagcagagcttcacctgcgccctgcagaaggagatcctgtaccagggcaagctgttcgtgagcgagaactggatctgcttccacagcaaggtgttcggcaaggacaccaagatcagcatccccgccttcagcgtgaccctgatcaagaagaccaagaccgccctgctggtgcccaacgccctgatcatcgccaccgtgaccgacagatacatcttcgtgagcctgctgagcagagacagcacctacaagctgctgaagagcgtgtgcggccacctggagaacaccagcgtgggcaacagccccaaccccagcagcgccgagaacagcttcagagccgacagacccagcagcctgcccctggacttcaacgacgagttcagcgacctggacggcgtggtgcagcagagaagacaggacatggagggctacagcagcagcggcagccagacccccgagagcgagaacagcagagacttccacgccaccgagagccagaccgtgctgaacgtgagcaagggcgaggccaagcccaccagagccgacgcccacgtgaacagagtgcccgagggcaaggccaagagcctgcccgtgcagggcctgagcgagaccgtgggcatcctgcacaaggtgaagagccagaagtgccccatgctgcaccacatcctgatcttctacgccatcgtggtgtgcgccctgatcatcagcaccttctacatgagatacagaatcaacaccctggaggagcagctgggcctgctgaccagcatcgtggacacccacaacaccgagcaggccgcccccagcggcctgagaagccaggtgcagttcaacgtggaggtgctgtgccaggagctgaccgccaacatcgtgaagctggagaagatccagaacaacctgcagaagctgctggagaacggcgactag

SEQ ID NO: 21620 - DNA, 1344 bp, Artificial Sequence
  Description of Artificial Sequence: Synthetic coding sequence
atgaccagaagacagcaggtgctgcaggccaagagaagcatccagcagaccttccaggcccagctgatgccctggaagagcatgttccacggcagagaggtgaagcccgtgggccccgacctggagctgagcgaggccgagaacggcgtggaggagaagaagaaggcctgcagaagccccaccgcccagagccccacccccagcgtggaggccgacagccccgaccagaagaagatcatcagcctgtggagcaagagcagcttcgacggcgccagcctggccagcgacaagaacgactgcaagaccgagagcaagaacgaccccaagaccgagagaaagaagagcagcagcagcagccagtacaaggccaacatgcacttccacaagctgttcctgagcgtgcccaccgaggagcccctgaagcagagcttcacctgcgccctgcagaaggagatcctgtaccagggcaagctgttcgtgagcgagaactggatctgcttccacagcaaggtgttcggcaaggacaccaagatcagcatccccgccttcagcgtgaccctgatcaagaagaccaagaccgccctgctggtgcccaacgccctgatcatcgccaccgtgaccgacagatacatcttcgtgagcctgctgagcagagacagcacctacaagctgctgaagagcgtgtgcggccacctggagaacaccagcgtgggcaacagccccaaccccagcagcgccgagaacagcttcagagccgacagacccagcagcctgcccctggacttcaacgacgagttcagcgacctggacggcgtggtgcagcagagaagacaggacatggagggctacagcagcagcggcagccagacccccgagagcgagaacagcagagacttccacgccaccgagagccagaccgtgctgaacgtgagcaagggcgaggccaagcccaccagagccgacgcccacgtgaacagagtgcccgagggcaaggccaagagcctgcccgtgcagggcctgagcgagaccgtgggcatcctgcacaaggtgaagagccagaagtgccccatgctgcaccacatcctgatcttctacgccatcgtggtgtgcgccctgatcatcagcaccttctacatgagatacagaatcaacaccctggaggagcagctgggcctgctgaccagcatcgtggacacccacaacaccgagcaggccgcccccagcggcctgagaagccaggtgcagttcaacgtggaggtgctgtgccaggagctgaccgccaacatcgtgaagctggagaagatccagaacaacctgcagaagctgctggagaacggcgactag

SEQ ID NO: 21621 - DNA, 1761 bp, Artificial Sequence
  Description of Artificial Sequence: Synthetic coding sequence
atgagcgccggcgacgccgtgtgcaccggctggctggtgaagagcccccccgagagaaagctgcagagatacgcctggagaaagagatggttcgtgctgagaagaggcagaatgagcggcaaccccgacgtgctggagtactacagaaacaagcacagcagcaagcccatcagagtgatcgacctgagcgagtgcgccgtgtggaagcacgtgggccccagcttcgtgagaaaggagttccagaacaacttcgtgttcatcgtgaagaccaccagcagaaccttctacctggtggccaagaccgagcaggagatgcaggtgtgggtgcacagcatcagccaggtgtgcaacctgggccacctggaggacggcgccgacagcatggagagcctgagctacacccccagcagcctgcagcccagcagcgccagcagcctgctgaccgcccacgccgccagcagcagcctgcccagagacgaccccaacaccaacgccgtggccaccgaggagaccagaagcgagagcgagctgctgttcctgcccgactacctggtgctgagcaactgcgagaccggcagactgcaccacaccagcctgcccaccagatgcgacagctggagcaacagcgacagaagcctggagcaggccagcttcgacgacgtgttcgtggactgcctgcagcccctgcccagcagccacctggtgcaccccagctgccacggcagcggcgcccaggaggtgcccagcagcagaccccaggccgccctgatctggagcagagagatcaacggcccccccagagaccacctgagcagcagccccctgctggagagcagcctgagcagcaccatccaggtggacaagaaccagggcagcctgccctgcggcgccaaggagctggacatcatgagcaacacccccccccccagaccccccaagcccagccacctgagcgagagaagacaggaggagtggagcacccacagcggcagcaagaagcccgagtgcaccctggtgcccagaagaatcagcctgagcggcctggacaacatgagaacctggaaggccgacgtggagggccagagcctgagacacagagacaagagactgagcctgaacctgccctgcagattcagccccatgtaccccaccgccagcgccagcatcgaggacagctacgtgcccatgagcccccaggccggcgccagcggcctgggcccccactgcagccccgacgactacatccccatgaacagcggcagcatcagcagccccctgcccgagctgcccgccaacctggagcccccccccgtgaacagagacctgaagccccagagaaagagcagacccccccccctggacctgagaaacctgagcatcatcagagagcacgccagcctgaccagaaccagaaccgtgccctgcagcagaaccagcttcctgagccccgagagaaacggcatcaacagcgccagattcttcgccaaccccgtgagcagagaggacgaggagagctacatcgagatggaggagcacagaaccgccagcagcctgagcagcggcgccctgacctggaccaagaagttcagcctggactacctggccctggacttcaacagcgccagccccgcccccatgcagcagaagctgctgctgagcgaggagcagagagtggactacgtgcaggtggacgagcagaagacccaggccctgcagagcaccaagcaggagtggaccgacgagagacagagcaaggtgtag

SEQ ID NO: 21622 - DNA, 1764 bp, Artificial Sequence
  Description of Artificial Sequence: Synthetic coding sequence
atgagcgccggcgacgccgtgtgcaccggctggctggtgaagagcccccccgagagaaagctgcagagatacgcctggagaaagagatggttcgtgctgagaagaggcagaatgagcggcaaccccgacgtgctggagtactacagaaacaagcacagcagcaagcccatcagagtgatcgacctgagcgagtgcgccgtgtggaagcacgtgggccccagcttcgtgagaaaggagttccagaacaacttcgtgttcatcgtgaagaccaccagcagaaccttctacctggtggccaagaccgagcaggagatgcaggtgtgggtgcacagcatcagccaggtgtgcaacctgggccacctggaggacggcgccgccgacagcatggagagcctgagctacacccccagcagcctgcagcccagcagcgccagcagcctgctgaccgcccacgccgccagcagcagcctgcccagagacgaccccaacaccaacgccgtggccaccgaggagaccagaagcgagagcgagctgctgttcctgcccgactacctggtgctgagcaactgcgagaccggcagactgcaccacaccagcctgcccaccagatgcgacagctggagcaacagcgacagaagcctggagcaggccagcttcgacgacgtgttcgtggactgcctgcagcccctgcccagcagccacctggtgcaccccagctgccacggcagcggcgcccaggaggtgcccagcagcagaccccaggccgccctgatctggagcagagagatcaacggcccccccagagaccacctgagcagcagccccctgctggagagcagcctgagcagcaccatccaggtggacaagaaccagggcagcctgccctgcggcgccaaggagctggacatcatgagcaacacccccccccccagaccccccaagcccagccacctgagcgagagaagacaggaggagtggagcacccacagcggcagcaagaagcccgagtgcaccctggtgcccagaagaatcagcctgagcggcctggacaacatgagaacctggaaggccgacgtggagggccagagcctgagacacagagacaagagactgagcctgaacctgccctgcagattcagccccatgtaccccaccgccagcgccagcatcgaggacagctacgtgcccatgagcccccaggccggcgccagcggcctgggcccccactgcagccccgacgactacatccccatgaacagcggcagcatcagcagccccctgcccgagctgcccgccaacctggagcccccccccgtgaacagagacctgaagccccagagaaagagcagacccccccccctggacctgagaaacctgagcatcatcagagagcacgccagcctgaccagaaccagaaccgtgccctgcagcagaaccagcttcctgagccccgagagaaacggcatcaacagcgccagattcttcgccaaccccgtgagcagagaggacgaggagagctacatcgagatggaggagcacagaaccgccagcagcctgagcagcggcgccctgacctggaccaagaagttcagcctggactacctggccctggacttcaacagcgccagccccgcccccatgcagcagaagctgctgctgagcgaggagcagagagtggactacgtgcaggtggacgagcagaagacccaggccctgcagagcaccaagcaggagtggaccgacgagagacagagcaaggtgtag

SEQ ID NO: 21623 - DNA, 1725 bp, Artificial Sequence
  Description of Artificial Sequence: Synthetic coding sequence
atgagcctgcccagccccagccccagcagagagctgtgcccccccgaccccgccttcgcccccctgagcagctggcccggcagcggccccgccggcggcagcaccagaagcggccacgtgctgtacagcggctggctgagaaagagcccccccgagaagaagctgagactgttcgcctggagaaagagatggttcatcctgagaagaggccagaccagcagcgaccccgacgtgctggagtactacaagaacgacggcagcaagaagcccctgagaaccatcaacctgaacctgtgcgagcagctggacgtggacgtgaccctgaacttcaacaagaaggagatccagaagggctacatgttcgacatcaagaccagcgagagaaccttctacctggtggccgagaccagagaggacatgaacgagtgggtgcagagcatctgccagatctgcggcttcagacaggaggagagcaccggcttcctgggcaacatcagcagcgccagccacggcctgtgcagcagccccgccgagcccagctgcagccaccagcacctgccccaggagcaggagcccaccagcgagccccccgtgagccactgcgtgccccccacctggcccatccccgccccccccggctgcctgagaagccaccagcacgccagccagagagccgagcacgccagaagcgccagcttcagccagggcagcgaggcccccttcatcatgagaagaaacaccgccatgcagaacctggcccagcacagcggctacagcgtggacggcgtgagcggccacatccacggcttccacagcctgagcaagcccagccagcacaacgccgagttcagaggcagcacccacagaatcccctggagcctggccagccacggccacaccagaggcagcctgaccggcagcgaggccgacaacgaggccagcagcggcaagtacacccagcacggcggcggcaacgccagcagacccgccgagagcatgcacgagggcgtgtgcagcttcctgcccggcagaaccctggtgggcctgagcgacagcatcgccagcgagggcagctgcgtgcccatgaaccccggcagccccaccctgcccgccgtgaagcaggccggcgacgacagccagggcgtgtgcatccccgtgggcagctgcctggtgagattcgacctgctgggcagccccctgaccgagctgagcatgcaccaggacctgagccagggccacgaggtgcagctgccccccgtgaacagaagcctgaagcccaaccagaaggccaaccccaccccccccaacctgagaaacaacagagtgatcaacgagctgagcttcaagccccccgtgaccgagccctggagcggcaccagccacaccttcgacagcagcagcagccagcaccccatcagcacccagagcatcaccaacaccgacagcgaggacagcggcgagagatacctgttccccaaccccgccagcgccttccccgtgagcggcggcaccagcagcagcgccccccccagaagcaccggcaacatccactacgccgccctggacttccagcccagcaagcccagcatcggcagcgtgaccagcggcaagaaggtggactacgtgcaggtggacctggagaagacccaggccctgcagaagaccatgcacgagcagatgtgcctgagacagagcagcgagccccccagaggcgccaagctgtag

SEQ ID NO: 21624 - DNA, 357 bp, Artificial Sequence
  Description of Artificial Sequence: Synthetic coding sequence
atggagagcgtggccctgtacagcttccaggccaccgagagcgacgagctggccttcaacaagggcgacaccctgaagatcctgaacatggaggacgaccagaactggtacaaggccgagctgagaggcgtggagggcttcatccccaagaactacatcagagtgaagccccacccctggtacagcggcagaatcagcagacagctggccgaggagatcctgatgaagagaaaccacctgggcgccttcctgatcagagagagcgagagcagccccggcgagttcagcgtgagcgtgaacaacagagcccagagaggcccctgcctgggccccaagagccacagcagactgggctag

SEQ ID NO: 21625 - DNA, 567 bp, Artificial Sequence
  Description of Artificial Sequence: Synthetic coding sequence
atggaggacgaccagaactggtacaaggccgagctgagaggcgtggagggcttcatccccaagaactacatcagagtgaagccccacccctggtacagcggcagaatcagcagacagctggccgaggagatcctgatgaagagaaaccacctgggcgccttcctgatcagagagagcgagagcagccccggcgagttcagcgtgagcgtgaactacggcgaccaggtgcagcacttcaaggtgctgagagaggccagcggcaagtacttcctgtgggaggagaagttcaacagcctgaacgagctggtggacttctacagaaccaccaccatcgccaagaagagacagatcttcctgagagacgaggagcccctgctgaagagccccggcgcctgcttcgcccaggcccagttcgacttcagcgcccaggaccccagccagctgagcttcagaagaggcgacatcatcgaggtgctggagagacccgacccccactggtggagaggcagaagctgcggcagagtgggcttcttccccagaagctacgtgcagcccgtgcacctgtag

SEQ ID NO: 21626 - DNA, 123 bp, Artificial Sequence
  Description of Artificial Sequence: Synthetic coding sequence
atgctgctgagagagatcacctacagcatcacccccctgagcctgcacggcaccagcctgctgaactgcaactggagagccaccggcctggtgaccctggagggccacagacccttccagtag

SEQ ID NO: 21627 - DNA, 801 bp, Artificial Sequence
  Description of Artificial Sequence: Synthetic coding sequence
atggtgctgagcggcgcccaggcccagatggaccagaaccccggctactaccaccagctgctgcagggcgagagaaaccccagactggaggacgccatcagaaccgacctgaacagaaccttccccgacaacgtgaagttcagaaagaccaccgacccctgcctgcagagaaccctgtacaacgtgctgctggcctacggccaccacaaccagggcgtgggctactgccagggcatgaacttcatcgccggctacctgatcctgatcaccaacaacgaggaggagagcttctggctgctggacgccctggtgggcagaatcctgcccgactactacagccccgccatgctgggcctgaagaccgaccaggaggtgctgggcgagctggtgagagccaagctgcccgccgtgggcgccctgatggagagactgggcgtgctgtggaccctgctggtgagcagatggttcatctgcctgttcgtggacatcctgcccgtggagaccgtgctgagaatctgggactgcctgttcaacgagggcagcaagatcatcttcagagtggccctgaccctgatcaagcagcaccaggagctgatcctggaggccaccagcgtgcccgacatctgcgacaagttcaagcagatcaccaagggcagcttcgtgatggagtgccacaccttcatgcaggtgtgcggcgccgccagaggcagcgtgcccagccagggcgcccccccccacctgcagcccggcggctgcagcgaccaccccgagggcgcccaggacggccaccagtgggcctag

SEQ ID NO: 21628 - DNA, 1035 bp, Artificial Sequence
  Description of Artificial Sequence: Synthetic coding sequence
atgcagcccgccgagagaagcagagtgcccagaatcgacccctacggcttcgagagacccgaggacttcgacgacgccgcctacgagaagttcttcagcagctacctggtgaccctgaccagaagagccatcaagtggagcagactgctgcagggcggcggcgtgcccagaagcagaaccgtgaagagatacgtgagaaagggcgtgcccctggagcacagagccagagtgtggatggtgctgagcggcgcccaggcccagatggaccagaaccccggctactaccaccagctgctgcagggcgagagaaaccccagactggaggacgccatcagaaccgacctgaacagaaccttccccgacaacgtgaagttcagaaagaccaccgacccctgcctgcagagaaccctgtacaacgtgctgctggcctacggccaccacaaccagggcgtgggctactgccagggcatgaacttcatcgccggctacctgatcctgatcaccaacaacgaggaggagagcttctggctgctggacgccctggtgggcagaatcctgcccgactactacagccccgccatgctgggcctgaagaccgaccaggaggtgctgggcgagctggtgagagccaagctgcccgccgtgggcgccctgatggagagactgggcgtgctgtggaccctgctggtgagcagatggttcatctgcctgttcgtggacatcctgcccgtggagaccgtgctgagaatctgggactgcctgttcaacgagggcagcaagatcatcttcagagtggccctgaccctgatcaagcagcaccaggagctgatcctggaggccaccagcgtgcccgacatctgcgacaagttcaagcagatcaccaagggcagcttcgtgatggagtgccacaccttcatgcaggtgtgcggcgccgccagaggcagcgtgcccagccagggcgcccccccccacctgcagcccggcggctgcagcgaccaccccgagggcgcccaggacggccaccagtgggcctag

SEQ ID NO: 21629 - DNA, 1011 bp, Artificial Sequence
  Description of Artificial Sequence: Synthetic coding sequence
atgcagcccgccgagagaagcagagtgcccagaatcgacccctacggcttcgagagacccgaggacttcgacgacgccgcctacgagaagttcttcagcagctacctggtgaccctgaccagaagagccatcaagtggagcagactgctgcagggcggcggcgtgcccagaagcagaaccgtgaagagatacgtgagaaagggcgtgcccctggagcacagagccagagtgtggatggtgctgagcggcgcccaggcccagatggaccagaaccccggctactaccaccagctgctgcagggcgagagaaaccccagactggaggacgccatcagaaccgacctgaacagaaccttccccgacaacgtgaagttcagaaagaccaccgacccctgcctgcagagaaccctgtacaacgtgctgctggcctacggccaccacaaccagggcgtgggctactgccagggcatgaacttcatcgccggctacctgatcctgatcaccaacaacgaggaggagagcttctggctgctggacgccctggtgggcagaatcctgcccgactactacagccccgccatgctgggcctgaagaccgaccaggaggtgctgggcgagctggtgagagccaagctgcccgccgtgggcgccctgatggagagactgggcgtgctgtggaccctgctggtgagcagatggttcatctgcctgttcgtggacatcctgcccgtggagaccgtgctgagaatctgggactgcctgttcaacgagggcagcaagatcatcttcagagtggccctgaccctgatcaagcagcaccaggagctgatcctggaggccaccagcgtgcccgacatctgcgacaagttcaagcagatcaccaagggcagcttcgtgatggagtgccacaccttcatgcagaagatcttcagcgagcccggcagcctgagcatggccaccgtggccaagctgagagagagctgcagagccagactgctggcccagggctag

SEQ ID NO: 21630 - DNA, 3654 bp, Artificial Sequence
  Description of Artificial Sequence: Synthetic coding sequence
atgaagggcatgagccacgagcccaagagccccagcctgggcatgctgagcaccgccaccagaaccaccgccaccgtgaaccccctgacccccagccccctgaacggcgccctggtgcccagcggcagccccgccaccagcagcgccctgagcgcccaggccgcccccagcagcagcttcgccgccgccctgagaaagctggccaagcaggccgaggagcccagaggcagcagcctgagcagcgagagcagccccgtgagcagccccgccaccaaccacagcagccccgccagcacccccaagagagtgcccatgggccccatcatcgtgccccccggcggccacagcgtgcccagcaccccccccgtggtgaccatcgcccccaccaagaccgtgaacggcgtgtggagaagcgagagcagacaggacgccggcagcagaagcagcagcggcggcagagagagactgatcgtggagccccccctgccccaggagaaggccggcggccccgccatccccagccacctgctgagcaccccctaccccttcggcctgagccccagcagcgtggtgcaggacagcagattcccccccctgaacctgcagagacccgtgcaccacgtggtgccccccagcaccgtgaccgaggactacctgagaagcttcagaccctaccacaccaccgacgacctgagaatgagcagcctgccccccctgggcctggaccccgccaccgccgccgcctactaccaccccagctacctggccccccaccccttcccccaccccgccttcagaatggacgacagctactgcctgagcgccctgagaagccccttctaccccatccccacccccggcagcctgccccccctgcaccccagcgccatgcacctgcacctgagcggcgtgagatacccccccgagctgagccacagcagcctggccgccctgcacagcgagagaatgagcggcctgagcgccgagagactgcagatggacgaggagctgagaagagagagagagagagagagagagagagagagagagagagaggccgacagagagagagagaaggagagagagagagagagagagaaggagagagagcaggagaaggagagagagagagagaaggagagagagagagagctggagagacagagagagcagagagccagagagaaggagctgctggccgccaaggccctggagcccagcttcctgcccgtggccgagctgcacggcctgagaggccacgccaccgaggagagaggcaagcccagcgagcagctgacccccaccagagccgagaagctgaaggacgccggcctgcaggcccccaagcccgtgcagcaccccctgcaccccgtgcccaccccccaccacaccgtgcccagcctgatcagcaaccacggcatcttcagcctgcccagcagcagcgccgccaccgccctgctgatccagagaaccaacgaggaggagaagtggctggccagacagagaagactgagacaggagaaggaggacagacagagccaggtgagcgagttcagacagcaggtgctggagcagcacctggacatgggcagaccccccgtgcccgccgaggccgagcacagacccgagagcaccaccagacccggccccaacagacacgagcccggcggcagagaccccccccagcacttcggcggccccccccccctgatcagccccaagccccagctgcacgccgcccccaccgccctgtggaaccccgtgagcctgatggacaacaccctggagaccagaagagccgagagccacagcctgcacagccaccccgccgccttcgagcccagcagacaggccgccgtgcccctggtgaaggtggagagagtgttctgccccgagaaggccgaggagggccccagaaagagagagcccgcccccctggacaagtaccagccccccccccccccccccagagagggcggcagcctggagcaccagcccttcctgcccggccccggccccttcctggccgagctggagaagagcacccagaccatcctgggccagcagagagccagcctgccccaggccgccaccttcggcgagctgagcggccccctgaagcccggcagcccctacagaccccccgtgcccagagcccccgaccccgcctacatctacgacgagttcctgcagcagagaagaagactggtgagcaagctggacctggaggagagaagaagaagagaggcccaggagaagggctactactacgacctggacgacagctacgacgagagcgacgaggaggaggtgagagcccacctgagatgcgtggccgagcagccccccctgaagctggacaccagcagcgagaagctggagttcctgcagctgttcggcctgaccacccagcagcagaaggaggagctggtggcccagaagagaagaaagagaagaagaatgctgagagagagaagccccagcccccccaccatccagagcaagagacagacccccagccccagactggccctgagcaccagatacagccccgacgagatgaacaacagccccaacttcgaggagaagaagaagttcctgaccatcttcaacctgacccacatcagcgccgagaagagaaaggacaaggagagactggtggagatgctgagagccatgaagcagaaggccctgagcgccgccgtggccgacagcctgaccaacagccccagagacagccccgccgtgagcctgagcgagcccgccacccagcaggccagcctggacgtggagaagcccgtgggcgtggccgccagcctgagcgacatccccaaggccgccgagcccggcaagctggagcaggtgagaccccaggagctgagcagagtgcaggagctggcccccgccagcggcgagaaggccagactgagcgaggcccccggcggcaagaagagcctgagcatgctgcactacatcagaggcgccgcccccaaggacatccccgtgcccctgagccacagcaccaacggcaagagcaagccctgggagcccttcgtggccgaggagttcgcccaccagttccacgagagcgtgctgcagagcacccagaaggccctgcagaagcacaagggcagcgtggccgtgctgagcgccgagcagaaccacaaggtggacaccagcgtgcactacaacatccccgagctgcagagcagcagcagagccccccccccccagcacaacggccagcaggagccccccaccgccagaaagggcccccccacccaggagctggacagagacagcgaggaggaggaggaggaggacgacgaggacggcgaggacgaggaggaggtgcccaagagaaagtggcagggcatcgaggccgtgttcgaggcctaccaggagcacatcgaggagcagaacctggagagacaggtgctgcagacccagtgcagaagactggaggccagacactacagcctgagcctgaccgccgagcagctgagccacagcgtggccgagctgagaagccagaagcagaagatggtgagcgagagagagagactgcaggccgagctggaccacctgagaaagtgcctggccctgcccgccatgcactggcccagaggctacctgaagggctaccccagatag

SEQ ID NO: 21631 - DNA, 3342 bp, Artificial Sequence
  Description of Artificial Sequence: Synthetic coding sequence
atgggccccatcatcgtgccccccggcggccacagcgtgcccagcaccccccccgtggtgaccatcgcccccaccaagaccgtgaacggcgtgtggagaagcgagagcagacaggacgccggcagcagaagcagcagcggcggcagagagagactgatcgtggagccccccctgccccaggagaaggccggcggccccgccatccccagccacctgctgagcaccccctaccccttcggcctgagccccagcagcgtggtgcaggacagcagattcccccccctgaacctgcagagacccgtgcaccacgtggtgccccccagcaccgtgaccgaggactacctgagaagcttcagaccctaccacaccaccgacgacctgagaatgagcagcctgccccccctgggcctggaccccgccaccgccgccgcctactaccaccccagctacctggccccccaccccttcccccaccccgccttcagaatggacgacagctactgcctgagcgccctgagaagccccttctaccccatccccacccccggcagcctgccccccctgcaccccagcgccatgcacctgcacctgagcggcgtgagatacccccccgagctgagccacagcagcctggccgccctgcacagcgagagaatgagcggcctgagcgccgagagactgcagatggacgaggagctgagaagagagagagagagagagagagagagagagagagagagagaggccgacagagagagagagaaggagagagagagagagagagagaaggagagagagcaggagaaggagagagagagagagaaggagagagagagagagctggagagacagagagagcagagagccagagagaaggagctgctggccgccaaggccctggagcccagcttcctgcccgtggccgagctgcacggcctgagaggccacgccaccgaggagagaggcaagcccagcgagcagctgacccccaccagagccgagaagctgaaggacgccggcctgcaggcccccaagcccgtgcagcaccccctgcaccccgtgcccaccccccaccacaccgtgcccagcctgatcagcaaccacggcatcttcagcctgcccagcagcagcgccgccaccgccctgctgatccagagaaccaacgaggaggagaagtggctggccagacagagaagactgagacaggagaaggaggacagacagagccaggtgagcgagttcagacagcaggtgctggagcagcacctggacatgggcagaccccccgtgcccgccgaggccgagcacagacccgagagcaccaccagacccggccccaacagacacgagcccggcggcagagaccccccccagcacttcggcggccccccccccctgatcagccccaagccccagctgcacgccgcccccaccgccctgtggaaccccgtgagcctgatggacaacaccctggagaccagaagagccgagagccacagcctgcacagccaccccgccgccttcgagcccagcagacaggccgccgtgcccctggtgaaggtggagagagtgttctgccccgagaaggccgaggagggccccagaaagagagagcccgcccccctggacaagtaccagccccccccccccccccccagagagggcggcagcctggagcaccagcccttcctgcccggccccggccccttcctggccgagctggagaagagcacccagaccatcctgggccagcagagagccagcctgccccaggccgccaccttcggcgagctgagcggccccctgaagcccggcagcccctacagaccccccgtgcccagagcccccgaccccgcctacatctacgacgagttcctgcagcagagaagaagactggtgagcaagctggacctggaggagagaagaagaagagaggcccaggagaagggctactactacgacctggacgacagctacgacgagagcgacgaggaggaggtgagagcccacctgagatgcgtggccgagcagccccccctgaagctggacaccagcagcgagaagctggagttcctgcagctgttcggcctgaccacccagcagcagaaggaggagctggtggcccagaagagaagaaagagaagaagaatgctgagagagagaagccccagcccccccaccatccagagcaagagacagacccccagccccagactggccctgagcaccagatacagccccgacgagatgaacaacagccccaacttcgaggagaagaagaagttcctgaccatcttcaacctgacccacatcagcgccgagaagagaaaggacaaggagagactggtggagatgctgagagccatgaagcagaaggccctgagcgccgccgtggccgacagcctgaccaacagccccagagacagccccgccgtgagcctgagcgagcccgccacccagcaggccagcctggacgtggagaagcccgtgggcgtggccgccagcctgagcgacatccccaaggccgccgagcccggcaagctggagcaggtgagaccccaggagctgagcagagtgcaggagctggcccccgccagcggcgagaaggccagactgagcgaggcccccggcggcaagaagagcctgagcatgctgcactacatcagaggcgccgcccccaaggacatccccgtgcccctgagccacagcaccaacggcaagagcaagccctgggagcccttcgtggccgaggagttcgcccaccagttccacgagagcgtgctgcagagcacccagaaggccctgcagaagcacaagggcagcgtggccgtgctgagcgccgagcagaaccacaaggtggacaccagcgtgcactacaacatccccgagctgcagagcagcagcagagccccccccccccagcacaacggccagcaggagccccccaccgccagaaagggcccccccacccaggagctggacagagacagcgaggaggaggaggaggaggacgacgaggacggcgaggacgaggaggaggtgcccaagagaaagtggcagggcatcgaggccgtgttcgaggcctaccaggagcacatcgaggagcagaacctggagagacaggtgctgcagacccagtgcagaagactggaggccagacactacagcctgagcctgaccgccgagcagctgagccacagcgtggccgagctgagaagccagaagcagaagatggtgagcgagagagagagactgcaggccgagctggaccacctgagaaagtgcctggccctgcccgccatgcactggcccagaggctacctgaagggctaccccagatag

SEQ ID NO: 21632 - DNA, 2463 bp, Artificial Sequence
  Description of Artificial Sequence: Synthetic coding sequence
atggtggtggacttctgcagaagattcgtggccagaagcctgtgcatcatcctgatgaagcacttctgcagcagcagcgtgagcgaggacctgggctgcagaagaggcgacttcagcagaaagcactacggcagcgtggagctgctgatcagcagcgacgccgacggcgccatccagagagccggcagattcagagtggagaacggcagcagcgacgagaacgccaccgccctgcccggcacctggagaagaaccgacgtgcacctggagaaccccgagtaccacaccagatggtacttcaagtacttcctgggccaggtgcaccagaactacatcggcaacgacgccgagaagagccccttcttcctgagcgtgaccctgagcgaccagaacaaccagagagtgccccagtacagagccatcctgtggagaaagaccggcacccagaagatctgcctgccctacagccccaccaagaccctgagcgtgaagagcatcctgagcgccatgaacctggacaagttcgagaagggccccagagagatcttccaccccgagatccagaaggacctgctggtgctggaggagcaggagggcagcgtgaacttcaagttcggcgtgctgttcgccaaggacggccagctgaccgacgacgagatgttcagcaacgagatcggcagcgagcccttccagaagttcctgaacctgctgggcgacaccatcaccctgaagggctggaccggctacagaggcggcctggacaccaagaacgacaccaccggcatccacagcgtgtacaccgtgtaccagggccacgagatcatgttccacgtgagcaccatgctgccctacagcaaggagaacaagcagcaggtggagagaaagagacacatcggcaacgacatcgtgaccatcgtgttccaggagggcgaggagagcagccccgccttcaagcccagcatgatcagaagccacttcacccacatcttcgccctggtgagatacaaccagcagaacgacaactacagactgaagatcttcagcgaggagagcgtgcccctgttcggcccccccctgcccaccccccccgtgttcaccgaccaccaggagttcagagacttcctgctggtgaagctgatcaacggcgagaaggccaccctggagacccccaccttcgcccagaagagaagaagaaccctggacatgctgatcagaagcctgcaccaggacctgatgcccgacctgcacaagaacatgctgaacagaagaagcttcagcgacgtgctgcccgagagccccaagagcgccagaaagaaggaggaggccagacaggccgagttcgtgagaatcggccaggccctgaagctgaagagcatcgtgagaggcgacgcccccagcagcctggccgccagcggcatctgcaagaaggagccctgggagccccagtgcttctgcagcaacttcccccacgaggccgtgtgcgccgacccctggggccaggccctgctggtgagcaccgacgccggcgtgctgctggtggacgacgacctgcccagcgtgcccgtgttcgacagaaccctgcccgtgaagcagatgcacgtgctggagaccctggacctgctggtgctgagagccgacaagggcaaggacgccagactgttcgtgttcagactgagcgccctgcagaagggcctggagggcaagcaggccggcaagagcagaagcgactgcagagagaacaagctggagaagaccaagggctgccacctgtacgccatcaacacccaccacagcagagagctgagaatcgtggtggccatcagaaacaagctgctgctgatcaccagaaagcacaacaagcccagcggcgtgaccagcaccagcctgctgagccccctgagcgagagccccgtggaggagttccagtacatcagagagatctgcctgagcgacagccccatggtgatgaccctggtggacggccccgccgaggagagcgacaacctgatctgcgtggcctacagacaccagttcgacgtggtgaacgagagcaccggcgaggccttcagactgcaccacgtggaggccaacagagtgaacttcgtggccgccatcgacgtgtacgaggacggcgaggccggcctgctgctgtgctacaactacagctgcatctacaagaaggtgtgccccttcaacggcggcagcttcctggtgcagcccagcgccagcgacttccagttctgctggaaccaggccccctacgccatcgtgtgcgccttcccctacctgctggccttcaccaccgacagcatggagatcagactggtggtgaacggcaacctggtgcacaccgccgtggtgccccagctgcagctggtggccagcagagtgaagttcaaccagaagatctgcaccagattccacctggagaccagctgggccgaggccagcaacgacctgtag

SEQ ID NO: 21633 - DNA, 3042 bp, Artificial Sequence
  Description of Artificial Sequence: Synthetic coding sequence
atggtggtggacttctgcagaagattcgtggccagaagcctgtgcatcatcctgatgaagcacttctgcagcagcagcgtgagcgaggacctgggctgcagaagaggcgacttcagcagaaagcactacggcagcgtggagctgctgatcagcagcgacgccgacggcgccatccagagagccggcagattcagagtggagaacggcagcagcgacgagaacgccaccgccctgcccggcacctggagaagaaccgacgtgcacctggagaaccccgagtaccacaccagatggtacttcaagtacttcctgggccaggtgcaccagaactacatcggcaacgacgccgagaagagccccttcttcctgagcgtgaccctgagcgaccagaacaaccagagagtgccccagtacagagccatcctgtggagaaagaccggcacccagaagatctgcctgccctacagccccaccaagaccctgagcgtgaagagcatcctgagcgccatgaacctggacaagttcgagaagggccccagagagatcttccaccccgagatccagaaggacctgctggtgctggaggagcaggagggcagcgtgaacttcaagttcggcgtgctgttcgccaaggacggccagctgaccgacgacgagatgttcagcaacgagatcggcagcgagcccttccagaagttcctgaacctgctgggcgacaccatcaccctgaagggctggaccggctacagaggcggcctggacaccaagaacgacaccaccggcatccacagcgtgtacaccgtgtaccagggccacgagatcatgttccacgtgagcaccatgctgccctacagcaaggagaacaagcagcaggtggagagaaagagacacatcggcaacgacatcgtgaccatcgtgttccaggagggcgaggagagcagccccgccttcaagcccagcatgatcagaagccacttcacccacatcttcgccctggtgagatacaaccagcagaacgacaactacagactgaagatcttcagcgaggagagcgtgcccctgttcggcccccccctgcccaccccccccgtgttcaccgaccaccaggagttcagagacttcctgctggtgaagctgatcaacggcgagaaggccaccctggagacccccaccttcgcccagaagagaagaagaaccctggacatgctgatcagaagcctgcaccaggacctgatgcccgacctgcacaagaacatgctgaacagaagaagcttcagcgacgtgctgcccgagagccccaagagcgccagaaagaaggaggaggccagacaggccgagttcgtgagaatcggccaggccctgaagctgaagagcatcgtgagaggcgacgcccccagcagcctggccgccagcggcatctgcaagaaggagccctgggagccccagtgcttctgcagcaacttcccccacgaggccgtgtgcgccgacccctggggccaggccctgctggtgagcaccgacgccggcgtgctgctggtggacgacgacctgcccagcgtgcccgtgttcgacagaaccctgcccgtgaagcagatgcacgtgctggagaccctggacctgctggtgctgagagccgacaagggcaaggacgccagactgttcgtgttcagactgagcgccctgcagaagggcctggagggcaagcaggccggcaagagcagaagcgactgcagagagaacaagctggagaagaccaagggctgccacctgtacgccatcaacacccaccacagcagagagctgagaatcgtggtggccatcagaaacaagctgctgctgatcaccagaaagcacaacaagcccagcggcgtgaccagcaccagcctgctgagccccctgagcgagagccccgtggaggagttccagtacatcagagagatctgcctgagcgacagccccatggtgatgaccctggtggacggccccgccgaggagagcgacaacctgatctgcgtggcctacagacaccagttcgacgtggtgaacgagagcaccggcgaggccttcagactgcaccacgtggaggccaacagagtgaacttcgtggccgccatcgacgtgtacgaggacggcgaggccggcctgctgctgtgctacaactacagctgcatctacaagaaggtgtgccccttcaacggcggcagcttcctggtgcagcccagcgccagcgacttccagttctgctggaaccaggccccctacgccatcgtgtgcgccttcccctacctgctggccttcaccaccgacagcatggagatcagactggtggtgaacggcaacctggtgcacaccgccgtggtgccccagctgcagctggtggccagcagaagcgacatctacttcaccgccaccgccgccgtgaacgaggtgagcagcggcggcagcagcaagggcgccagcgccagaaacagcccccagaccccccccggcagagacacccccgtgttccccagcagcctgggcgagggcgagatccagagcaagaacctgtacaagatccccctgagaaacctggtgggcagaagcatcgagagacccctgaagagccccctggtgagcaaggtgatcaccccccccacccccatcagcgtgggcctggccgccatccccgtgacccacagcctgagcctgagcagaatggagatcaaggagatcgccagcagaaccagaagagagctgctgggcctgagcgacgagggcggccccaagagcgagggcgcccccaaggccaagagcaagcccagaaagagactggaggagagccagggcggccccaagcccggcgccgtgagaagcagcagcagcgacagaatccccagcggcagcctggagagcgccagcaccagcgaggccaaccccgagggccacagcgccagcagcgaccaggaccccgtggccgacagagagggcagccccgtgagcggcagcagccccttccagctgaccgccttcagcgacgaggacatcatcgacctgaagtag

SEQ ID NO: 21634 - DNA, 807 bp, Artificial Sequence
  Description of Artificial Sequence: Synthetic coding sequence
atggaccccctgaccaaggtgccctgcggcagccagatcgcccagaccatcctgtggaaggccaagagcagcctgagcttcggcatccagcccctgcagacctggcccaccaaggaccccgagctggagagccaggtgaacctgagcgtgagcgaggacctgggctgcagaagaggcgacttcagcagaaagcactacggcagcgtggagctgctgatcagcagcgacgccgacggcgccatccagagagccggcagattcagagtggagaacggcagcagcgacgagaacgccaccgccctgcccggcacctggagaagaaccgacgtgcacctggagaaccccgagtaccacaccagatggtacttcaagtacttcctgggccaggtgcaccagaactacatcggcaacgacgccgagaagagccccttcttcctgagcgtgaccctgagcgaccagaacaaccagagagtgccccagtacagagccatcctgtggagaaagaccggcacccagaagatctgcctgccctacagccccaccaagaccctgagcgtgaagagcatcctgagcgccatgaacctggacaagttcgagaagggccccagagagatcttccaccccgagatccagaaggacctgctggtgctggaggagcaggagggcagcgtgaacttcaagttcggcgtgctgttcgccaaggacggccagctgaccgacgacgagatgttcagcaacgagatcggcagcgagcccttccagaagttcctgaacctgctgggcgacaccatcaccctgaagggctag

SEQ ID NO: 21635 - DNA, 2976 bp, Artificial Sequence
  Description of Artificial Sequence: Synthetic coding sequence
atgaagagcagcgtgagcgaggacctgggctgcagaagaggcgacttcagcagaaagcactacggcagcgtggagctgctgatcagcagcgacgccgacggcgccatccagagagccggcagattcagagtggagaacggcagcagcgacgagaacgccaccgccctgcccggcacctggagaagaaccgacgtgcacctggagaaccccgagtaccacaccagatggtacttcaagtacttcctgggccaggtgcaccagaactacatcggcaacgacgccgagaagagccccttcttcctgagcgtgaccctgagcgaccagaacaaccagagagtgccccagtacagagccatcctgtggagaaagaccggcacccagaagatctgcctgccctacagccccaccaagaccctgagcgtgaagagcatcctgagcgccatgaacctggacaagttcgagaagggccccagagagatcttccaccccgagatccagaaggacctgctggtgctggaggagcaggagggcagcgtgaacttcaagttcggcgtgctgttcgccaaggacggccagctgaccgacgacgagatgttcagcaacgagatcggcagcgagcccttccagaagttcctgaacctgctgggcgacaccatcaccctgaagggctggaccggctacagaggcggcctggacaccaagaacgacaccaccggcatccacagcgtgtacaccgtgtaccagggccacgagatcatgttccacgtgagcaccatgctgccctacagcaaggagaacaagcagcaggtggagagaaagagacacatcggcaacgacatcgtgaccatcgtgttccaggagggcgaggagagcagccccgccttcaagcccagcatgatcagaagccacttcacccacatcttcgccctggtgagatacaaccagcagaacgacaactacagactgaagatcttcagcgaggagagcgtgcccctgttcggcccccccctgcccaccccccccgtgttcaccgaccaccaggagttcagagacttcctgctggtgaagctgatcaacggcgagaaggccaccctggagacccccaccttcgcccagaagagaagaagaaccctggacatgctgatcagaagcctgcaccaggacctgatgcccgacctgcacaagaacatgctgaacagaagaagcttcagcgacgtgctgcccgagagccccaagagcgccagaaagaaggaggaggccagacaggccgagttcgtgagaatcggccaggccctgaagctgaagagcatcgtgagaggcgacgcccccagcagcctggccgccagcggcatctgcaagaaggagccctgggagccccagtgcttctgcagcaacttcccccacgaggccgtgtgcgccgacccctggggccaggccctgctggtgagcaccgacgccggcgtgctgctggtggacgacgacctgcccagcgtgcccgtgttcgacagaaccctgcccgtgaagcagatgcacgtgctggagaccctggacctgctggtgctgagagccgacaagggcaaggacgccagactgttcgtgttcagactgagcgccctgcagaagggcctggagggcaagcaggccggcaagagcagaagcgactgcagagagaacaagctggagaagaccaagggctgccacctgtacgccatcaacacccaccacagcagagagctgagaatcgtggtggccatcagaaacaagctgctgctgatcaccagaaagcacaacaagcccagcggcgtgaccagcaccagcctgctgagccccctgagcgagagccccgtggaggagttccagtacatcagagagatctgcctgagcgacagccccatggtgatgaccctggtggacggccccgccgaggagagcgacaacctgatctgcgtggcctacagacaccagttcgacgtggtgaacgagagcaccggcgaggccttcagactgcaccacgtggaggccaacagagtgaacttcgtggccgccatcgacgtgtacgaggacggcgaggccggcctgctgctgtgctacaactacagctgcatctacaagaaggtgtgccccttcaacggcggcagcttcctggtgcagcccagcgccagcgacttccagttctgctggaaccaggccccctacgccatcgtgtgcgccttcccctacctgctggccttcaccaccgacagcatggagatcagactggtggtgaacggcaacctggtgcacaccgccgtggtgccccagctgcagctggtggccagcagaagcgacatctacttcaccgccaccgccgccgtgaacgaggtgagcagcggcggcagcagcaagggcgccagcgccagaaacagcccccagaccccccccggcagagacacccccgtgttccccagcagcctgggcgagggcgagatccagagcaagaacctgtacaagatccccctgagaaacctggtgggcagaagcatcgagagacccctgaagagccccctggtgagcaaggtgatcaccccccccacccccatcagcgtgggcctggccgccatccccgtgacccacagcctgagcctgagcagaatggagatcaaggagatcgccagcagaaccagaagagagctgctgggcctgagcgacgagggcggccccaagagcgagggcgcccccaaggccaagagcaagcccagaaagagactggaggagagccagggcggccccaagcccggcgccgtgagaagcagcagcagcgacagaatccccagcggcagcctggagagcgccagcaccagcgaggccaaccccgagggccacagcgccagcagcgaccaggaccccgtggccgacagagagggcagccccgtgagcggcagcagccccttccagctgaccgccttcagcgacgaggacatcatcgacctgaagtag

SEQ ID NO: 21636 - DNA, 807 bp, Artificial Sequence; identical to SEQ ID NO: 21634
  Description of Artificial Sequence: Synthetic coding sequence

SEQ ID NO: 21637 - DNA, 903 bp, Artificial Sequence
  Description of Artificial Sequence: Synthetic coding sequence
atggccgagagcgaggacagaagcctgagaatcgtgctggtgggcaagaccggcagcggcaagagcgccaccgccaacaccatcctgggcgaggagatcttcgacagcagaatcgccgcccaggccgtgaccaagaactgccagaaggccagcagagagtggcagggcagagacctgctggtggtggacacccccggcctgttcgacaccaaggagagcctggacaccacctgcaaggagatcagcagatgcatcatcagcagctgccccggcccccacgccatcgtgctggtgctgctgctgggcagatacaccgaggaggagcagaagaccgtggccctgatcaaggccgtgttcggcaagagcgccatgaagcacatggtgatcctgttcaccagaaaggaggagctggagggccagagcttccacgacttcatcgccgacgccgacgtgggcctgaagagcatcgtgaaggagtgcggcaacagatgctgcgccttcagcaacagcaagaagaccagcaaggccgagaaggagagccaggtgcaggagctggtggagctgatcgagaagatggtgcagtgcaacgagggcgcctacttcagcgacgacatctacaaggacaccgaggagagactgaagcagagagaggaggtgctgagaaagatctacaccgaccagctgaacgaggagatcaagctggtggaggaggacaagcacaagagcgaggaggagaaggagaaggagatcaagctgctgaagctgaagtacgacgagaagatcaagaacatcagagaggaggccgagagaaacatcttcaaggacgtgttcaacagaatctggaagatgctgagcgagatctggcacagattcctgagcaagtgcaagttctacagcagctag

SEQ ID NO: 21638 - DNA, 207 bp, Artificial Sequence
  Description of Artificial Sequence: Synthetic coding sequence
atgagcggcttcagcagcgtggccgccaccaagaaggtggtgcagcagctgcagctggaggccggcctgaacagcgtgaaggtgagccaggccgccgccgacctgaagcagttctgcctgcagaacgcccagcacgaccccctgctgaccggcgtgagcagcagcaccaaccccttcagaccccagaaggtgtgcagcttcctgtag

SEQ ID NO: 21639 - DNA, 1569 bp, Artificial Sequence
  Description of Artificial Sequence: Synthetic coding sequence
atggtgagaagcggcaagaacggcgacctgcacctgaagcagatcgcctactacaagagaaccggcgagtaccacagcaccaccctgcccagcgagagaagcggcatcagaagagccgccaagaagttcgtgttcaaggagaagaagctgttctacgtgggcaaggacagaaagcagaacagactggtgatcgtgagcgaggaggagaagaagaaggtgctgagagagtgccacgagaacgacagcggcgcccaccacggcatcagcagaaccctgaccctggtggagagcaactactactggaccagcgtgaccaacgacgtgaagcagtgggtgtacgcctgccagcactgccaggtggccaagaacaccgtgatcgtggcccccaagcagcacctgctgaaggtggagaacccctggagcctggtgaccgtggacctgatgggccccttccacaccagcaacagaagccacgtgtacgccatcatcatgaccgacctgttcaccaagtggatcgtgatcctgcccctgtgcgacgtgagcgccagcgaggtgagcaaggccatcatcaacatcttcttcctgtacggccccccccagaagatcatcatggaccagagagacgagttcatccagcagatcaacatcgagctgtacagactgttcggcatcaagcagatcgtgatcagccacaccagcggcaccgtgaaccccaccgagagcacccccaacaccatcaaggccttcctgagcaagcactgcgccgaccaccccaacaactgggacgaccacctgagcgccgtgagcttcgccttcaacgtgacccacctggagcccaccaagaacaccccctacttccagatgttcagcagaaacccctacatgcccgagaccagcgacagcctgcacgaggtggacggcgacaacaccagcatgttcgccaagatcctggacgccatcaaggaggccgacaagatcatggagaacaagaccaccagcctgggccagatggagaacaacaacctggacgagctgaacaagagcaagatcatcgtgaagaagaagcccaagcagctgaaccccttccacctgaaggtgggccacgaggtgctgagacagagaaagaactggtggaaggacggcagattccagagcgagtgggtgggcccctgcgtgatcgactacatcaccgagagcggctgcgccgtgctgagagacaacaccggcgtgagactgaagagacccatcaagatgagccacctgaagccctacatcagagagagcagcgagcaggagagcctgtacctgctgcagggcagcgtggtggccgaccacgactacatcggcctgcccgagatccccatcggcgcctaccaggccaacatcctggtggaggacgccaccatcggcatcgtggacaacgagctgctgaccagcagcaaggacagagagctgctggagtacagaaacaccaagatcagccccctgatcgacgaccacagcagcctggagaagcagaccttcagcctgctggacagcagcaaccaggtgctggagtacctgagctag

SEQ ID NO: 21640 - DNA, 669 bp, Artificial Sequence
  Description of Artificial Sequence: Synthetic coding sequence
atggtgagaagcggcaagaacggcgacctgcacctgaagcagatcgcctactacaagagaaccggcgagtaccacagcaccaccctgcccagcgagagaagcggcatcagaagagccgccaagaagttcgtgttcaaggagaagaagctgttctacgtgggcaaggacagaaagcagaacagactggtgatcgtgagcgaggaggagaagaagaaggtgctgagagagtgccacgagaacgacagcggcgcccaccacggcatcagcagaaccctgaccctggtggagagcaactactactggaccagcgtgaccaacgacgtgaagcagtgggtgtacgcctgccagcactgccaggtggccaagaacaccgtgatcgtggcccccaagcagcacctgctgaaggtggagaacccctggagcctggtgaccgtggacctgatgggccccttccacaccagcaacagaagccacgtgtacgccatcatcatgaccgacctgttcaccaagtggatcgtgatcctgcccctgtgcgacgtgagcgccagcgaggtgagcaaggccatcatcaacatcttcttcctgtacggccccccccagaagatcatcatggaccagagagacgagttcatccagcagaaggtgttcatcagctgcaaggtgcagtag

SEQ ID NO: 21641 - DNA, 687 bp, Artificial Sequence
  Description of Artificial Sequence: Synthetic coding sequence
atggccgcccccccccagcccgtgacccacctgatcttcgacatggacggcctgctgctggacaccgagagactgtacagcgtggtgttccaggagatctgcaacagatacgacaagaagtacagctgggacgtgaagagcctggtgatgggcaagaaggccctggaggccgcccagatcatcatcgacgtgctgcagctgcccatgagcaaggaggagctggtggaggagagccagaccaagctgaaggaggtgttccccaccgccgccctgatgcccggcgccgagaagctgatcatccacctgagaaagcacggcatccccttcgccctggccaccagcagcggcagcgccagcttcgacatgaagaccagcagacacaaggagttcttcagcctgttcagccacatcgtgctgggcgacgaccccgaggtgcagcacggcaagcccgaccccgacatcttcctggcctgcgccaagagattcagccccccccccgccatggagaagtgcctggtgttcgaggacgcccccaacggcgtggaggccgccctggccgccggcatgcaggtggtgatggtgcccgacggcaacctgagcagagacctgaccaccaaggccaccctggtgctgaacagcctgcaggacttccagcccgagctgttcggcctgcccagctacgagtag

SEQ ID NO: 21642 - DNA, 756 bp, Artificial Sequence
  Description of Artificial Sequence: Synthetic coding sequence
atggccgcccccccccagcccgtgacccacctgatcttcgacatggacggcctgctgctgggctacaccggcagcatcgtggccgccgccagcggcgagagcagcagaggcctgcagagcagatggaccgacaccgagagactgtacagcgtggtgttccaggagatctgcaacagatacgacaagaagtacagctgggacgtgaagagcctggtgatgggcaagaaggccctggaggccgcccagatcatcatcgacgtgctgcagctgcccatgagcaaggaggagctggtggaggagagccagaccaagctgaaggaggtgttccccaccgccgccctgatgcccggcgccgagaagctgatcatccacctgagaaagcacggcatccccttcgccctggccaccagcagcggcagcgccagcttcgacatgaagaccagcagacacaaggagttcttcagcctgttcagccacatcgtgctgggcgacgaccccgaggtgcagcacggcaagcccgaccccgacatcttcctggcctgcgccaagagattcagccccccccccgccatggagaagtgcctggtgttcgaggacgcccccaacggcgtggaggccgccctggccgccggcatgcaggtggtgatggtgcccgacggcaacctgagcagagacctgaccaccaaggccaccctggtgctgaacagcctgcaggacttccagcccgagctgttcggcctgcccagctacgagtag

SEQ ID NO: 21643 - DNA, 627 bp, Artificial Sequence
  Description of Artificial Sequence: Synthetic coding sequence
atggccgcccccccccagcccgtgacccacctgatcttcgacatggacggcctgctgctggacaccgagagactgtacagcgtggtgttccaggagatctgcaacagatacgacaagaagtacagctgggacgtgaagagcctggtgatgggcaagaaggccctggaggccgcccagatcatcatcgacgtgctgcagctgcccatgagcaaggaggagctggtggaggagagccagaccaagctgaaggaggtgttccccaccgccgccctgatgcccggcgccgagaagctgatcatccacctgagaaagcacggcatccccttcgccctggccaccagcagcggcagcgccagcttcgacatgaagaccagcagacacaaggagttcttcagcctgttcagccacatcgtgctgggcgacgaccccgaggtgcagcacggcaagcccgaccccgacatcttcctggcctgcgccaagagattcagccccccccccgccatggagaagagcagcatccacagacccagactgctgaccgcccagaagtgccagggctgcagagaccccttcagcgccctgctgctgctgtgcaaccagctgctgctgtgcagcgacgacacctag

SEQ ID NO: 21644 - DNA, 735 bp, Artificial Sequence
  Description of Artificial Sequence: Synthetic coding sequence
atggccgcccccccccagcccgtgacccacctgatcttcgacggcagaaccagcagcggctgggtggtggccgccgccagcggcagaagctgcgtgggcgtgggcaccgacaccgagagactgtacagcgtggtgttccaggagatctgcaacagatacgacaagaagtacagctgggacgtgaagagcctggtgatgggcaagaaggccctggaggccgcccagatcatcatcgacgtgctgcagctgcccatgagcaaggaggagctggtggaggagagccagaccaagctgaaggaggtgttccccaccgccgccctgatgcccggcgccgagaagctgatcatccacctgagaaagcacggcatccccttcgccctggccaccagcagcggcagcgccagcttcgacatgaagaccagcagacacaaggagttcttcagcctgttcagccacatcgtgctgggcgacgaccccgaggtgcagcacggcaagcccgaccccgacatcttcctggcctgcgccaagagattcagccccccccccgccatggagaagtgcctggtgttcgaggacgcccccaacggcgtggaggccgccctggccgccggcatgcaggtggtgatggtgcccgacggcaacctgagcagagacctgaccaccaaggccaccctggtgctgaacagcctgcaggacttccagcccgagctgttcggcctgcccagctacgagtag

SEQ ID NO: 21645 - DNA, 558 bp, Artificial Sequence
  Description of Artificial Sequence: Synthetic coding sequence
atggccgcccccccccagcccgtgacccacctgatcttcgacatggacggcctgctgctggacaccgagagactgtacagcgtggtgttccaggagatctgcaacagatacgacaagaagtacagctgggacgtgaagagcctggtgatgggcgccgagaagctgatcatccacctgagaaagcacggcatccccttcgccctggccaccagcagcggcagcgccagcttcgacatgaagaccagcagacacaaggagttcttcagcctgttcagccacatcgtgctgggcgacgaccccgaggtgcagcacggcaagcccgaccccgacatcttcctggcctgcgccaagagattcagccccccccccgccatggagaagtgcctggtgttcgaggacgcccccaacggcgtggaggccgccctggccgccggcatgcaggtggtgatggtgcccgacggcaacctgagcagagacctgaccaccaaggccaccctggtgctgaacagcctgcaggacttccagcccgagctgttcggcctgcccagctacgagtag

SEQ ID NO: 21646 - DNA, 780 bp, Artificial Sequence
  Description of Artificial Sequence: Synthetic coding sequence
atggccgcctgcagagccctgaaggccgtgctggtggacctgagcggcaccctgcacatcgaggacgccgccgtgcccggcgcccaggaggccctgaagagactgagaggcgccagcgtgatcatcagattcgtgaccaacaccaccaaggagagcaagcaggacctgctggagagactgagaaagctggagttcgacatcagcgaggacgagatcttcaccagcctgaccgccgccagaagcctgctggagagaaagcaggtgagacccatgctgctggtggacgacagagccctgcccgacttcaagggcatccagaccagcgaccccaacgccgtggtgatgggcctggcccccgagcacttccactaccagatcctgaaccaggccttcagactgctgctggacggcgcccccctgatcgccatccacaaggccagatactacaagagaaaggacggcctggccctgggccccggccccttcgtgaccgccctggagtacgccaccgacaccaaggccaccgtggtgggcaagcccgagaagaccttcttcctggaggccctgagaggcaccggctgcgagcccgaggaggccgtgatgatcggcgacgactgcagagacgacgtgggcggcgcccaggacgtgggcatgctgggcatcctggtgaagaccggcaagtacagagccagcgacgaggagaagatcaacccccccccctacctgacctgcgagagcttcccccacgccgtggaccacatcctgcagcacctgctgtag

SEQ ID NO: 21647 - DNA, 132 bp, Artificial Sequence
  Description of Artificial Sequence: Synthetic coding sequence
atggccatccccatcaccgtgctggactgcgacctgctgctgtacggcagaggccacagaaccctggacagattcaagctggacgacgtgaccgacgagtacctgatgagcatgtacggcttccccagatag

SEQ ID NO: 21648 - DNA, 255 bp, Artificial Sequence
  Description of Artificial Sequence: Synthetic coding sequence
atgaagagagagcccaagaacctgagcagcgagcaggtgctgaagcccacctacagccagagcaagcccaacagaatcagactgtactactggggcctgggcctgaacctgagagccgccgccagcgaggccaacagaatggagagcaagaaggtgggcaagagactgggcgccggcaagcagcagatgggcgccgagctgaccgagcagcacatggccagaatcagcctgcccgccaagatcctgggctactag

SEQ ID NO: 21649 - DNA, 180 bp, Artificial Sequence
  Description of Artificial Sequence: Synthetic coding sequence
atgcagaccggcggctgcgagcccaagcacagaagaatgtgccccgacgacagcagcgagaacatcatgaagtggagaaccttcctgcccgaggagagaaccgtgacccaggccggcgacgtgacccacaccctgggcagcaagggccccaaggccggcgtgcccttcaccggcccctag

SEQ ID NO: 21650 - DNA, 369 bp, Artificial Sequence
  Description of Artificial Sequence: Synthetic coding sequence
atggtggtggtggagaagggcgccagcctgatgagcagagccagcctgatgcccgcccaggccagagcccccttccagagactgagagactgcagaggccccgccgacagcagccacgccttcaagctgcagtgcttccccagccactgcagaagacccccctgggtgatcagcagaaagggcagagccatcaacaagtacagcatctgcatcagctgcgtggccctgcacctggagatcagcttcatctggcagctgctgcagaacgagcccaacctggagggcggcctgggcagattcatgctggccagcctgagcctgcagcaggtgatcagcatcctggccttcaccagagtgaagcagctgtag

SEQ ID NO: 21651 - DNA, 183 bp, Artificial Sequence
  Description of Artificial Sequence: Synthetic coding sequence
atggccctgccctgcggcatgggcaccgcctggtacctggacagcaccgagaacgccctgaccgtgaacgtgcccagagcccagaaccacaaggccagccacaacagcatgtggaagctgggcagccacttctactgcatcctgctggtgaccaaggacccccccggcttcaccatggtgtag

SEQ ID NO: 21652 - DNA, 393 bp, Artificial Sequence
  Description of Artificial Sequence: Synthetic coding sequence
atgagcctgtgcagcctgctgagccccagaagcggcttcagatgctgctgcgccgccccccccccccccgcccagccccaccaggaggcccagggcggcctggtggagctgctgatgcacgccgccgccagaaagaccctgttcaacttcccccccgcccccagcagagccagccccggccacagagtggcctgccagcccgacagagccagaaagagcggcagctgggccgtggcccagagaagaagagagcaggaggaggccggcgccagagccggcgccgtggaccccctgggcctgcccctggtgagcagcatcagctgcgtgcagcactgcaacctggccgccggcgtgcagaccggcagaccccccgccagcagcaccgactgctag

SEQ ID NO: 21653 - DNA, 162 bp, Artificial Sequence
  Description of Artificial Sequence: Synthetic coding sequence
gccacccaggacctgcagttcagaatcagaagacccagaccccccgccagaggcagaggcggcgagaccagaagctgcgacctgggcagatgccacctgaagggcctggacctgctggaggccagaaccgccgaggaggacggcgagagaaacgccagatag

SEQ ID NO: 21654 - DNA, 414 bp, Artificial Sequence
  Description of Artificial Sequence: Synthetic coding sequence
atgttccacttcttcagaaagccccccgagagcaagaagcccagcgtgcccgagaccgaggccgacggcttcgtgctgctgggcgacaccaccgacgagcagagaatgaccgccagaggcaagaccagcgacatcgaggccaaccagcccctggagaccaacaaggagaacagcagcagcgtgaccgtgagcgaccccgagatggagaacaaggccggccagaccctggagaacagcagcctgatggccgagctgctgagcgacgtgcccttcaccctggccccccacgtgctggccgtgcagggcaccatcaccgacctgcccgaccacctgctgagctacgacggcagcgagaacctgagcagattctggtacgacttcaccctggagaacagcgtgctgtgcgacagctag

SEQ ID NO: 21655 - DNA, 876 bp, Artificial Sequence
  Description of Artificial Sequence: Synthetic coding sequence
atgcccggcaagctgctgcccgagaagtgcgccctgatgtggctgcacctgggcaccagagccccccagagacccaagagagagagcagaggcttccccggctggggctgcagaaccggccaggccctgccctgcagagccagaccccccgcccccgcccccagccaccccagcagcagcctgagcctgacccccggccccggcagccccagacagaccggccccccctgccagaccgtggccgccctgtacggcctgggcgcctggcagagccactgcggcggcggcgtgggctgccacggccagggcagacagcccctgggctgccagggctggtggagcaccctgaacccctacctgctggagagccccggcctgttccacaccagaagctgcggcaagctgtgggaccccaaggccgtgctgatcagcggcgtgaccagcagccacagcagcctgggcagccccggcaccagacccggcgtgagcctgtgcaaggagctgcccggctgctgggccgagctgtgctgcagacccagaaagatgaccaagaaggacagagccgagccccacctgcccctgctgggcggccccgagggcgccagagcccagcagagccccatcctgcacagcctgggcagcaagagactgcccagatgcggctggcagctgctgaccagcagcggcggcgccgccggcggcctgtgccccatgggccacagaagagagaaggacggcggcagagtgtgcaccctgggcagaaccggcggcagacacagacccgagcaggtggcctgggcccacgagaagggcgtgagcgagaccggctgcctgagccagatgcccggcgtggacgaggccgacgagtggcagtag

SEQ ID NO: 21656 - DNA, 234 bp, Artificial Sequence
  Description of Artificial Sequence: Synthetic coding sequence
atgaaggcccccggcctggcccaggccgccgtggccgaggagacccccgactgggcccccgagctgtgccccagcagcgaggccagaagccccgagccccccgccaacagactgcaggacttcgacaccctggtgaccgtgggcaagcagctggaggccatctgcgtgaagaagaacgtggacctgctggccagaatgcagagaagagagagactgctgatcagatgctggtag

SEQ ID NO: 21657 - DNA, 414 bp, Artificial Sequence
  Description of Artificial Sequence: Synthetic coding sequence
atgaccagccccctggtgttcgccagcctgagccccgacgccatggccaagatgctggagatggccgccctgaacgtgggcaccatcagaatcagcctgaacaccgagcccagaccccccgtgatcacccagctggcccccagccccgagaccctgcccttctgccccgagtggggcgccgagaaccagagcagacacctgaagctgccccccttcttcatctgcagatgcagaggccccctgtaccaggaggagagcctgagcgagatccactgccacagcggcctgttcctggaccagctgagcctgcccacccccttcagcagcctgagcgtgagcctgatccactggaccttcatcagcaccaagtacgtgcccggcatcatgctggccttcggcggcaccaacaagtag

SEQ ID NO: 21658 - DNA, 141 bp, Artificial Sequence
  Description of Artificial Sequence: Synthetic coding sequence
agagagggccacgccgacggcaacatccccgccggccccggcctgtgcagcccccagctgctgctgcccggcggccagctgttctgggcccccgaggtgctgagaagccccttccccggccccggcacccccagcgcctag

SEQ ID NO: 21659 - DNA, 444 bp, Artificial Sequence
  Description of Artificial Sequence: Synthetic coding sequence
atgggcctgctgagcctgatcctgttcctgggcgccaaggtgaccaccgccaacaagaccgacagcttcctgttcagcaccggcctgaccgtgctgagcagccccggcctgaagatgagagtgctgggctgcccccccacccccccccagctgacccagggccacaccagcggctacgtggacctgcacaagggccccttcctgagccccatgagacaccccagaggccacaccggcccccagatcctgccccaggcctgggagcccatcggcagaagagtgagacagtgcagaggcccccagaccttcctgaagggccccgagagcaagtacttcagactgtgcagacccgacgtgctgtgctgcaagacccagttctgctactgcagcagcaaggccgccatcgacaacagcgaggtgaacgagtgcgtggtgagccagtag

SEQ ID NO: 21660 - DNA, 84 bp, Artificial Sequence
  Description of Artificial Sequence: Synthetic coding sequence
gacatcctgcagcacaaccaccccgtggtgggcctgctgcaggtgggcagcgagcacggcagcgaggaggccgccctgagctag

SEQ ID NO: 21661 - DNA, 555 bp, Artificial Sequence
  Description of Artificial Sequence: Synthetic coding sequence
atgcccgtgaagggcgccagcagcctgctgttcctgcccctgccccccagcgcctggcagctgtgcctgctgagcaagagaagagtgcaccccatcagaacccccctgcccttccacagctggatcaaggccctggtgatcagcaaccagaaggtgcccgagagagagagacccgagggcaccggcgtgctgagcgacggctgcctgggccagagccaggagggcgagcccctgctgagcccccccgccctggcccacttccccctgcacgccagatgctgcggcagcagctgggcctggcccggcagcgccggcgaggccatcagaatggtgagcggcgcccccttcctgtgcttcctggacggcctggacggcctgccctgcagcagccccatggccgccctgcccgcccccatggccgccctgcccgccagaagacagagacaggagcacatcgagggcggcagccagggctgcggcgtgagaagccccgccccctgcagaggcaagcccggcagcgccaccagcagcaccctgagactgtgccccgcctag

SEQ ID NO: 21662 - DNA, 417 bp, Artificial Sequence
  Description of Artificial Sequence: Synthetic coding sequence
atgctggagaagtggagagagaccgaggaggccagaggcctgctgaccagaacccagcccaccgccagcggccccccctgcagccacgcccacagccagctgctgctggacagactgaagggcaacctggccagaagaggcggcgtgggcagagccagcctggagaccgtgctgtggagacccggcgagaccgccttctacccccagcactggggcgagcaggccagcatccccgccttcgcctgcagacccagcagcttccccctgaaggcctaccccgccgcccccgccctgagaaacgccctgctgagctaccagctgtgggagagacaggacagactggccagcggcagaagaggcagacactgcctgcccagcggccccggcccccacagatacccccagctgcaggactag

SEQ ID NO: 21663 - DNA, 429 bp, Artificial Sequence
  Description of Artificial Sequence: Synthetic coding sequence
atgggcctgtaccacgtgggccaggccggcctggagctgctgaccagcagcgacccccccaccagcgccagccagaacgccgagatcaccggcgtgagccacagagcccagagcaaggcccacaacctgcagagaaagctgagactgagccacaagagcagccccccctgcacctacacccagcacgccggcggcgtggacagccaccccctgacccaggacatgtgcgtgatcgtgaacgtgatcgccagacccttcgacaagtgcaactgcgacatctacctgggcctggccagcgagctgttcgtggtgagctgggtgcagctgaccgtgccctaccactggatccagaccctgggcaacgtgatcctgttctgcctggacaccgcccacagaggccactgcgacatcgccggccactgcacctag

SEQ ID NO: 21664 - DNA, 303 bp, Artificial Sequence
  Description of Artificial Sequence: Synthetic coding sequence
atgagacccaagcacctgcagggcatcgcccccgaggtgttcagaacccccaccggcagccacggccagatgcccggccagcccctgcagagaggccacgccctggacatcagaccccccctgagaccccaccccctgatcagcggccacgccctgagaggcgacagatggcagacccccgccctggccctgggccccgccctgtgcggcttcgtgcccgcccactgggtgctgaccgtgccccccccccagagacccagcatccccagcagaagcgccgacacctgccccgccagcagatag

SEQ ID NO: 21665 - DNA, 246 bp, Artificial Sequence
  Description of Artificial Sequence: Synthetic coding sequence
atggtgttcctgaactacaagtgcaccacccccctgatcctgctgctgcccagccagatccccagaagctacaagcaggactggctgctgtactgcagcaagctgatcagcctggcctaccacgccttcctgatcttcatgcccagcctgatgatgttcagcctgctggagatctaccacatcctgctgccccagctgctgctgcaggtgaacttcctgctgaaggccgagcccgaccagatctag

SEQ ID NO: 21666 - DNA, 435 bp, Artificial Sequence
  Description of Artificial Sequence: Synthetic coding sequence
atgaaggtgagcagcctgaccagacagcagagacccccccagggcaccgaggccggcaccagaggcggcggccccggcagactgagccccgagagatgcagactgctggacagccccctgcagctgcagggccccgccagcctgccccagcccggcggcagagagagagccgtggccacccccccccaggccaccagaagaggcggcagcgagagaaccagagacagcctgctgggcgccgtgggccccagcggcgccaagagacccttcttcagcagcgccctgcccaagggctgcagaagagtgggcgccacctggggccccagacagagaggctggggcaacgccaccggcggccccggcgagggcgccagaagaagcagacccgacccccaggccctgttctggcacgccccccacctgagagcccagtag

SEQ ID NO: 21667 - DNA, 318 bp, Artificial Sequence
  Description of Artificial Sequence: Synthetic coding sequence
atggcccactgcagcctggacctgagcggcagcggcgacccccccaccagcaccagccaggtggccagaaccatcggcgcctgccaccacgtgcagctgatcttcgtgttcttcggcgagaccggcttccaccacgtggcccccctggtgctggagctgctggacagcagcgacccccccaccctggccagccagagcggcggcaacagacacgagcccccccacagagccctgaagcacatcttcctgaagcacatctggctgttcagcttctacttccaccagaacggccacgaggagaccatggaccagatctag

SEQ ID NO: 21668 - DNA, 396 bp, Artificial Sequence
  Description of Artificial Sequence: Synthetic coding sequence
atgcccttctggagactggacaagctgagccccggcggcgtgaagagactgagagtgacccagcccgccaccggcaccggcgtggtgagaagccagtgccagaagtgggtgaaggagctgggcaacgtgcccagactggccgccagaaagcccggcctgggcgtgcccggcagcagcggcgccgtgaagagacagggccagaagtgggtgaaggagctgggcaacatccccagactggccgtgggcagagaccagggcctgggcagcctggaccccggcagcgccaccgagctgctgtgcgactgcagcgtgcccctgctgcccctgagcggcggctacagaaaggccgacgtggcccaccaccccgcctgcgccatcgtgtggctgcactactag

SEQ ID NO: 21669 - DNA, 444 bp, Artificial Sequence
  Description of Artificial Sequence: Synthetic coding sequence
atggtgaccggcccctgcctgacctgcgtgagcagcctgatcgagagagccagccccaaccaccccaccaacaagggcctgaccctgctgccctggctggagtgcagcggccccatcatcgcccactgcagcctggacttccccgccagcgtggacccccccaccctgatcagcagagtggccggcaccgccggcctgctgatcctgagattcagcagcgccagcgccaaccccgagaccgccagacccatcccccccctgccctgccccccccccagactgctgcacatgaagaccaccagaatgaagaccttcatgatgatccacttccacctgatgaacaagctgcaggagatcatccaggaggagagacacggcggcatgctggagagcctgctgagcctgaaggtgggcaaccccggcagctgcagctgcagccactag

SEQ ID NO: 21670 - DNA, 204 bp, Artificial Sequence
  Description of Artificial Sequence: Synthetic coding sequence
atgttccacctgtgcaagctgaaccccagctacctgaagatcacctgcggcaagagaagcaagcagatcacccccacctactaccccagcagactgccccccgtgaagagaaagttcagcgtgtacgacgccaagctgaccatcgtgcacctgagcaccttcagcatcgaggacttccccctgtacctgagcatggccggctag

SEQ ID NO: 21671 - DNA, 423 bp, Artificial Sequence
  Description of Artificial Sequence: Synthetic coding sequence
atgggcagcgaggccgcccagctgctggaggccgccgacttcgccgccagaaagcacagacagcagagaagaaaggaccccgagggcaccccctacatcaaccaccccatcggcgtggccagaatcctgacccacgaggccggcatcaccgacatcgtggtgctgcaggccgccctgctgcacgacaccgtggaggacaccgacaccaccctggacgaggtggagctgcacttcggcgcccaggtgagaagactggtggaggaggtgaccgacgacaagaccctgcccaagctggagagaaagagactgcaggtggagcaggccccccacagcagccccggcgccaagctggtgaagctggccgacaagctgtacaacctgagagacctgaacagatgcacccccgaggtgaagatccagtag

SEQ ID NO: 21672 - DNA, 540 bp, Artificial Sequence
  Description of Artificial Sequence: Synthetic coding sequence
atgggcagcgaggccgcccagctgctggaggccgccgacttcgccgccagaaagcacagacagcagagaagaaaggaccccgagggcaccccctacatcaaccaccccatcggcgtggccagaatcctgacccacgaggccggcatcaccgacatcgtggtgctgcaggccgccctgctgcacgacaccgtggaggacaccgacaccaccctggacgaggtggagctgcacttcggcgcccaggtgagaagactggtggaggaggtgaccgacgacaagaccctgcccaagctggagagaaagagactgcaggtggagcaggccccccacagcagccccggcgccaagctggtgaagctggccgacaagctgtacaacctgagagacctgaacagatgcacccccgagggctggagcgagcacagagtgcaggagtacttcgagtgggccgcccaggtggtgaagggcctgcagggcaccaacagacagctggaggaggccctgaagcacctgttcaagcagagaggcctgaccatctag

SEQ ID NO: 21673 - DNA, 1632 bp, Artificial Sequence
  Description of Artificial Sequence: Synthetic coding sequence
atgcccaaccccaagaacagcaagggcggcagaaagaacaagagagccaacagcagcggcgacgagcaggagaacggcgccggcgccctggccgccgccggcgccgccggcgccgccgccggcggcgccctggccgccgccgccggctgcggcgccgccgccgccggcgcccccggcgccggcggcgccgccggcgccggcggcgccggcaccggcgccgccaacgccgccgccgccgccggcgccgccgccgccggcgacgccaagaacgaggccccctgcgccacccccctgatctgcagcttcggcagacccgtggacctggagaaggacgactaccagaaggtggtgtgcaacaacgagcactgcccctgcagcacctggatgcacctgcagtgcttctacgagtgggagagcagcatcctggtgcagttcaactgcatcggcagagccagaagctggaacgagaagcagtgcagacagaacatgtggaccaagaagggctacgacctggccttcagattctgcagctgcagatgcggccagggccacctgaagaaggacaccgactggtaccaggtgaagagaatgcaggacgagaagaagaagaagagcggcagcgagaagaacaccggcagaccccccggcgaggccgccgaggaggccaagaagtgcagaccccccaacaagccccagaagggccccagccacgacctgcccagaagacacagcatggacagacagaacagccaggagaaggccgtgggcgccgccgcctacggcgccagaagccccggcggcagccccggccagagcccccccaccggctacagcatcctgagccccgcccacttcagcggccccagaagcagcagatacctgggcgagttcctgaagaacgccatccacctggagccccacaagaaggccatggccggcggccacgtgttcagaaacgcccacttcgactacagccccgccggcctggccgtgcacagaggcggccacttcgacacccccgtgcagttcctgagaagactggacctgagcgagctgctgacccacatccccagacacaagctgaacaccttccacgtgagaatggaggacgacgcccaggtgggccagggcgaggacctgagaaagttcatcctggccgccctgagcgccagccacagaaacgtggtgaactgcgccctgtgccacagagccctgcccgtgttcgagcagttccccctggtggacggcaccctgttcctgagccccagcagacacgacgagatcgagtacgacgtgccctgccacctgcagggcagactgatgcacctgtacgccgtgtgcgtggactgcctggagggcgtgcacaagatcatctgcatcaagtgcaagagcagatgggacggcagctggcaccagctgggcaccatgtacacctacgacatcctggccgccagcccctgctgccaggccagactgaactgcaagcactgcggcaagcccgtgatcgacgtgagaatcggcatgcagtacttcagcgagtacagcaacgtgcagcagtgcccccactgcggcaacctggactaccacttcgtgaagcccttcagcagcttcaaggtgctggaggcctactag

SEQ ID NO: 21674 - DNA, 2568 bp, Artificial Sequence
  Description of Artificial Sequence: Synthetic coding sequence
atggccgccctgggcgtggccgaggccgtggccgccccccaccccgccgagggcgccgagaccgccgaggccgtggagctgagcagagccctgagcagactgctgcccggcctggaggccgacagcaagcccggcagaagaagagccctggaggccctgagaagagccctggaggagcccggccccgccgccgaccccaccgccttccagggcccctgggccagactgctgctgcccagactgctgagatgcctgagcgaccccgccgagggctgcagagccctggccgtgcacctgctggacctgggcctgagaagagccgccagacccagagacgccctgcccagactgctgcccgccctggccgccagactggccggccccgtgcccgccagaagaccccccgaggcctgcgaggagctgagactggccctggtgcagctgctgggcctggccgtggacctgtgcggcgccgccctggccccccacctggacgacgccctgagagccctgagatgcagcctgctggaccccttcgccgccgtgagaagagagagctgcagctgcgccgccgccctggcccaggccacccccgaccacttccacatgcagagcgagagcctgatcggccccctgatgcagaccatcagccaccagcactggaaggtgagagtggccgccatcgaggccaccggcgccgtgatccacttcggcaacggcaagagcgtggacgacgtgctgagccacttcgcccagagactgttcgacgacgtgccccaggtgagaagagccgtggccagcgtggtgggcggctggctgctgtgcctgagagacagatacagcttcttccacaagctgatccccctgctgctgagcagcctgaacgacgaggtgcccgaggtgagacagctggccgccagcctgtgggaggacgtgggcctgcagtggcagaaggagaacgaggaggacctgaaggacaagctggacttcgccccccccacccccccccactaccccccccacgagagaagacccgtgctgggctgcagagagctggtgttcagaaacctgagcaagatcctgcccgccctgtgccacgacatcaccgactgggtggtgggcaccagagtgaagagcgcccagctgctgcccgtgctgctgctgcacgccgaggaccacgccacccagcacctggaggtggtgctgagaaccctgttccaggcctgcaccgacgaggaggccgccgtggtgcagagctgcaccagaagcgccgagctggtgggcaccttcgtgagccccgaggtgttcctgaagctgatcctgagcaccctgaagaagacccccagcgccagcggcctgctggtgctggccagcgccatgagaggctgccccagagaggccctgcagccccacctggccgccatcgccaccgagctggcccaggcccacatctgccaggccagcgagaacgacctgtacctggagagactgctgctgtgcgtgcaggccctggtgagcgtgtgccacgaggactgcggcgtggccagcctgcagctgctggacgtgctgctgaccatcgtggccctggccggcgccaccggcctgagagacaaggcccaggagaccatggacagcctggccatggtggagggcgtgagcagctgccaggacctgtacagaaagcacatcggccccctgctggagagagtgaccgccagccacctggactggaccgcccacagccccgagctgctgcagttcagcgtgatcgtggcccagagcggccccgccctgggcgaggccctgccccacgtggtgcccaccctgagagcctgcctgcagcccagccaggacccccagatgagactgaagctgttcagcatcctgagcaccgtgctgctgagagccaccgacaccatcaacagccagggccagttccccagctacctggagaccgtgaccaaggacatcctggcccccaacctgcagtggcacgccggcagaaccgccgccgccatcagaaccgccgccgtgagctgcctgtgggccctgaccagcagcgaggtgctgagcgccgagcagatcagagacgtgcaggagaccctgatgccccaggtgctgaccaccctggaggaggacagcaagatgaccagactgatcagctgcagaatcatcaacaccttcctgaagaccagcggcggcatgaccgaccccgagaagctgatcagaatctaccccgagctgctgaagagactggacgacgtgagcaacgacgtgagaatggccgccgccagcaccctggtgacctggctgcagtgcgtgaagggcgccaacgccaagagctactaccagagcagcgtgcagtacctgtacagagagctgctggtgcacctggacgaccccgagagagccatccaggacgccatcctggaggtgctgaaggagggcagcggcctgttccccgacctgctggtgagagagaccgaggccgtgatccacaagcacagaagcgccacctactgcgagcagctgctgcagcacgtgcaggccgtgcccgccacccagtag

SEQ ID NO: 21675 - DNA, 2532 bp, Artificial Sequence
  Description of Artificial Sequence: Synthetic coding sequence
atggccgccctgggcgtggccgaggccgtggccgccccccaccccgccgagggcgccgagaccgccgaggccgtggagctgagcagagccctgagcagactgctgcccggcctggaggccgacagcaagcccggcagaagaagagccctggaggccctgagaagagccctggaggagcccggccccgccgccgaccccaccgccttccagggcccctgggccagactgctgctgcccagactgctgagatgcctgagcgaccccgccgagggctgcagagccctggccgtgcacctgctggacctgggcctgagaagagccgccagacccagagacgccctgcccagactgctgcccgccctggccgccagactggccggccccgtgcccgccagaagaccccccgaggcctgcgaggagctgagactggccctggtgcagctgctgggcctggccgtggacctgtgcggcgccgccctggccccccacctggacgacgccctgagagccctgagatgcagcctgctggaccccttcgccgccgtgagaagagagagctgcagctgcgccgccgccctggcccaggccacccccgaccacttccacatgcagagcgagagcctgatcggccccctgatgcagaccatcagccaccagcactggaaggtgagagtggccgccatcgaggccaccggcgccgtgatccacttcggcaacggcaagagcgtggacgacgtgctgagccacttcgcccagagactgttcgacgacgtgccccaggtgagaagagccgtggccagcgtggtgggcggctggctgctgtgcctgagagacagatacagcttcttccacaagctgatccccctgctgctgagcagcctgaacgacgaggtgcccgaggtgagacagctggccgccagcctgtgggaggacgtgggcctgcagtggcagaaggagaacgaggaggacctgaaggacaagctggacttcgccccccccacccccccccactaccccccccacgagagaagacccgtgctgggctgcagagagctggtgttcagaaacctgagcaagatcctgcccgccctgtgccacgacatcaccgactgggtggtgggcaccagagtgaagagcgcccagctgctgcccgtgctgctgctgcacgccgaggaccacgccacccagcacctggaggtggtgctgagaaccctgttccaggcctgcaccgacgaggaggccgccgtggtgcagagctgcaccagaagcgccgagctggtgggcaccttcgtgagccccgaggtgttcctgaagctgatcctgagcaccctgaagaagacccccagcgccagcggcctgctggtgctggccagcgccatgagaggctgccccagagaggccctgcagccccacctggccgccatcgccaccgagctggcccaggcccacatctgccaggccagcgagaacgacctgtacctggagagactgctgctgtgcgtgcaggccctggtgagcgtgtgccacgaggactgcggcgtggccagcctgcagctgctggacgtgctgctgaccatcgtggccctggccggcgccaccggcctgagagacaaggcccaggagaccatggacagcctggccatggtggagggcgtgagcagctgccaggacctgtacagaaagcacatcggccccctgctggagagagtgaccgccagccacctggactggaccgcccacagccccgagctgctgcagttcagcgtgatcgtggcccagagcggccccgccctgggcgaggccctgccccacgtggtgcccaccctgagagcctgcctgcagcccagccaggacccccagatgagactgaagctgttcagcatcctgagcaccgtgctgctgagagccaccgacaccatcaacagccagggccagttccccagctacctggagaccgtgaccaaggacatcctggcccccaacctgcagtggcacgccggcagaaccgccgccgccatcagaaccgccgccgtgagctgcctgtgggccctgaccagcagcgaggtgctgagcgccgagcagatcagagacgtgcaggagaccctgatgccccaggtgctgaccaccctggaggaggacagcaagatgaccagactgatcagctgcagaatcatcaacaccttcctgaagaccagcggcggcatgaccgaccccgagaagctgatcagaatctaccccgagctgctgaagagactggacgacgtgagcaacgacgtgagaatggccgccgccagcaccctggtgacctggctgcagtgcgtgaagggcgccaacgccaagagctactaccagagcagcgtgcagtacctgtacagagagctgctggtgcacctggacgaccccgagagagccatccaggacgccatcctggacgtgcccggcagccccagccccagcgccatgatcggcagcttcctgagacccccccacccctggagaaccgtgagccagctgaacctgttcagcagctag

SEQ ID NO: 21676 - DNA, 1806 bp, Artificial Sequence
  Description of Artificial Sequence: Synthetic coding sequence
atggacagcttcagcgaggtgagaagagccgtggccagcgtggtgggcggctggctgctgtgcctgagagacagatacagcttcttccacaagctgatccccctgctgctgagcagcctgaacgacgaggtgcccgaggtgagacagctggccgccagcctgtgggaggacgtgggcctgcagtggcagaaggagaacgaggaggacctgaaggacaagctggacttcgccccccccacccccccccactaccccccccacgagagaagacccgtgctgggctgcagagagctggtgttcagaaacctgagcaagatcctgcccgccctgtgccacgacatcaccgactgggtggtgggcaccagagtgaagagcgcccagctgctgcccgtgctgctgctgcacgccgaggaccacgccacccagcacctggaggtggtgctgagaaccctgttccaggcctgcaccgacgaggaggccgccgtggtgcagagctgcaccagaagcgccgagctggtgggcaccttcgtgagccccgaggtgttcctgaagctgatcctgagcaccctgaagaagacccccagcgccagcggcctgctggtgctggccagcgccatgagaggctgccccagagaggccctgcagccccacctggccgccatcgccaccgagctggcccaggcccacatctgccaggccagcgagaacgacctgtacctggagagactgctgctgtgcgtgcaggccctggtgagcgtgtgccacgaggactgcggcgtggccagcctgcagctgctggacgtgctgctgaccatcgtggccctggccggcgccaccggcctgagagacaaggcccaggagaccatggacagcctggccatggtggagggcgtgagcagctgccaggacctgtacagaaagcacatcggccccctgctggagagagtgaccgccagccacctggactggaccgcccacagccccgagctgctgcagttcagcgtgatcgtggcccagagcggccccgccctgggcgaggccctgccccacgtggtgcccaccctgagagcctgcctgcagcccagccaggacccccagatgagactgaagctgttcagcatcctgagcaccgtgctgctgagagccaccgacaccatcaacagccagggccagttccccagctacctggagaccgtgaccaaggacatcctggcccccaacctgcagtggcacgccggcagaaccgccgccgccatcagaaccgccgccgtgagctgcctgtgggccctgaccagcagcgaggtgctgagcgccgagcagatcagagacgtgcaggagaccctgatgccccaggtgctgaccaccctggaggaggacagcaagatgaccagactgatcagctgcagaatcatcaacaccttcctgaagaccagcggcggcatgaccgaccccgagaagctgatcagaatctaccccgagctgctgaagagactggacgacgtgagcaacgacgtgagaatggccgccgccagcaccctggtgacctggctgcagtgcgtgaagggcgccaacgccaagagctactaccagagcagcgtgcagtacctgtacagagagctgctggtgcacctggacgaccccgagagagccatccaggacgccatcctggaggtgctgaaggagggcagcggcctgttccccgacctgctggtgagagagaccgaggccgtgatccacaagcacagaagcgccacctactgcgagcagctgctgcagcacgtgcaggccgtgcccgccacccagtag

SEQ ID NO: 21677 - DNA, 2043 bp, Artificial Sequence
  Description of Artificial Sequence: Synthetic coding sequence
atgggcaagagcagaaccaagagattcaagagaccccagttcagccccaccggcgactgccaggccgaggccgccgccgccgccaacggcaccggcggcgaggaggacgacggccccgccgccgagctgctggagaagctgcagcaccccagcgccgaggtgagagagtgcgcctgcgccggcctggccagactggtgcagcagagacccgccctgcccggcctggccagaagagacgccgtgagaagactgggccccctgctgctggaccccagcctggccgtgagagagaccgccgccggcgccctgagaaacctgagcgcctgcggcggcttcgaggtgtgcgacgacatggtgaccaaggacatcatgacccccctggtggccctgctgaaggagtgcagcgccggcctggacagcaacgagatgagcctgcaggagaagaaggaccagaacagaaacagcatcgagaacatcgccaacgagaccgtgaacgtgctgtggaacatctgcgagtgcagcagcagagccgtgagcatcttcaacaaggagggctgcctggagatcgtgctgaagtacctgagcagattccccaccaacgtggacctggccatcagcgtggcctactgcctgcagaccgtgaccgaggacaaccccgagctgctgaagagcttcagcgccaccgccctgaacatgctggagagcgccctgctgagccccgtgagcagcatggagagcctgctgctgaagaccctggtggccggcaccatctggaacctgaaggacatcatcccctgcaagagccaggccgagatcatcaacgccctgctgaagatcctgagcgaggtgctgggcatggacgccggcgagatggtgatccagatgaaggaggccgagacccagagactgaagaccgccgccgaggccgaggagatcctggagaacaccaacggcgacgacctgatcgaggacgacgagatggagggcatcagccacaagagaagagtgagaagaaagaccttcgtgagcgacctgctgccccccaccgacaaggagctgagagagaccatcgccctgctgaccgcccagcagaccgccctggagatcatcgtgaacatgtgctgcaacgaggaccccagcgacgacgagtgggaggagctgagcagcagcgacgagagcgacgccttcatggagaacagcttcagcgagtgcggcggccagctgttcagccccctgtgcctgagccacgaggtgcacaccgccctgaccaactacctgatccccaagaagatcttcgagaagaccgccttccccaacagcatcgccgtggacctgtgcagcagaaaccccacctggaagcccctgatcagaaagatgaacaccatccagtgcagagccctgttctgcctgcagagcctggtgagcctgctggacgtggagcacctgggcggcgccgccgccctgcagaccctggcccagcacctgagccagctgctgttcagccagcccgacttcgccaagcacgtggacttcctggaggccatcagcagcgccctgagagccctgctgcagaccatggccagcaagaacatcagccagtgcatgacccccgaccagctgatgaccctgtgcaaggccggcatccacagcagcaacgtgggcgtgagagtgaacgtggtgagcatcctgggcatcaccggcagcgtgctggccaaggaggacggcaccctggagaccctgaagaacatcggctgcttcctgctggaggtgaccaccaaggaccccagcctggtggtggccggcgaggccctggacgccctgttcgacgtgttcgccgacggcaaggaggccgagagagccagcatccagatcaagctgctgagcgccctgaaggagttccagcccgtgttcaagatgaagatcagaaaggagggcagaggcaactacagcaccgaccagctgtgcgtgctggacaacgtgaagatgaacctgagaagattcatcgcctaccaggagaccgtggagaagagactgaccagctag

SEQ ID NO: 21678 - DNA, 3081 bp, Artificial Sequence
  Description of Artificial Sequence: Synthetic coding sequence
atgaccagaacccagaagggcaagaccttcctgccccactgcttctaccagagcctgccccccagactgggctggggcatgatcctgaactacagcaagctgaagggcaaggaggagtgcgccagcgtgagcagcgtgcccatggtgttcttcagcagccagtacagactgcacagaaagagccagtacctgaagatggccgccgccaacctgaccttcagccaggaggtggtgtggcagagaggcctgcccagcatcccctacagccagtacagcttcgaccacctgtacaacaccaacgacatcatccacaccccccagatcagaaaggccagaccccagaagcccgtgagcttcaagttcctgggcagcagcagccccctgaccggcgacaccagcctggccgtgaagaccgagagcagcgccaaccccgagaagaagctgaagaagagcaagcccgccagcaccgtgagagaggcccccagacccctgatccaccacccctgcatgcaccccgacatgctgggcagaccccccagcctggacgtgaacctggaggagagagaggcctggctgctgccccccgagaaggaggccagagcctgggaggccaccgtgctggagaagctgaacgagagaaccgccagatggatccagagcaagagacccagaagacccggcgccagccccaacaagtggcagagcttcctgagacagcagtacgactggagccacatcagagacgagctgaccagcgccagcgacctggagctgctgaagcagctggaggccgaggagaccgccgagttcgaggaccagagcgtgatcctgcccccccaggagaagaagaagcccgagctgctgctgcccgtgtactacagactgcccagctacttccagcaggccgagaccgtggagatcatgcccggcaacaagagcaccgaggacatccacgagaagaccagcctgagccagccccagacccagagctacttcagacaggtgacccccagagccggcaagttcgcctacagcaccgacaacaccttcgagcaggagatctacttcgacgaggtgcagatcatccaccagatcggcgccaagagagaccagatcgtgctggagaacctgaacagatacaacaagcagctgagcaaggtgttccccgagacccccgagaagtggagcgcccaggccatccccgaggccagctacagacccgtgcagggcgccctgagatggaccgccctgcccacccccgccaaggacatgctgctgcaggtgggcgagaaggacgtgcccatcaagaccagaagactgaagaagcaggccaagagcctgcaggaggacgtgacctgggagctggtggtgctgagaagaatgctgaaggagtggaagaccgcctgggccctgatcatcgagtggcaccacgagaccgtggagaacctgctgcagagcctgggcgacctgcacgacgacgtgagaatcaaggccatcaccacctgcgccaccgccgccctggagagacccagaatcgccaccagccagagagacagcgacaagaccatccaggacctgcccgaggtgctgctgcccgccctggaggccgccctgtgcgacaagaacgcccacgtgagaatggccgccgccatctgccagtacgccatccagagccacaaccccctggccagaaacatcatgcagaccgccctgctgaagggcaacagcgtggacagctgggccgccgcccagtgcctggccctggagggcaccgccacctaccccgtgatcaagagaatcctgcaccagctgttcaccaagaagaacgaggacaccgaggagcagagctacatcctgctgagctacctgagcgagaagaccaccctgatccacaccatgctggccgtggagctgaacagctgccagtggaagaacagaatcgtggcctgccaggccttcagcagaatcagcggcaacgtgtgcctggacatgaagcacaagctgatccagctgatgtggaacgactggaacaaggaggtgagaagagccgccgcccaggccctgggccagatgagcctgggcaaggaggtgcacgacatcatcagagtgaagctgggccagggcaacagccaggagagagtggaggccctgtacctgatcggcgagctgaagctgatgaccgccaagctgctgcccagcttcctgcactgcttcagcgacgacttcaccgccgtgagaagagccgcctgcctggccgccggcgccctgcagatcagagacaagatggtgctggagtgcctgctgaacctgatgcagagagacccctactggaagatcaaggccttcgccatcagagccctgggccagatcggccaggtgagccccgagctgaccgacctgctgctgtgggccatccactacgaggagagccccggcgtgagactggaggcctgcagaagcatcctggccctgaagctgcagggcgacagagtgagagacaccttcctggacgtgctgctgctggagaaccacgacgccgtgctgaaggagatgtaccagaccatgaagatcctgaacctgggcaacgagggcaaccaggagatgctgcaggagatcaagaacagaatcaagaccctgagccagaaggacctgctgacccacaagatcctgaagctggagatggtgatgggcaaggtgagagaggaggccaagagagtgtacctgaagcccaagggcgagcagggccccctgaccctgcagaccctgctgcaggagaccttccaggacgagatggtgctgcccagaagacccagcgaggtgtgcgacaccgaggccgtgatcaagcccgtgaagcccagagcccccaacccctggctgcagagcagcgtgcccggcctgaccaccagaagcaaggtgagaagcagcctggtgaaggacctgagaaccagccccgagaagagaatcgccgtgggccccttcagaagcgactaccccgccctgtacctgggcaagttcagcgagagaaccttcttcagccccatcatgagcagccccagcggcaagaagggcgcccacctgtag

SEQ ID NO: 21679 - DNA, 3081 bp, Artificial Sequence; identical to SEQ ID NO: 21678
  Description of Artificial Sequence: Synthetic coding sequence

SEQ ID NO: 21680 - DNA, 576 bp, Artificial Sequence
  Description of Artificial Sequence: Synthetic coding sequence
atgaccagaacccagaagggcaagaccttcctgccccactgcttctaccagagcctgccccccagactgggctggggcatgatcctgaactacagcaagctgaagggcaaggaggagtgcgccagcgtgagcagcgtgcccatggtgttcttcagcagccagtacagactgcacagaaagagccagtacctgaagatggccgccgccaacctgaccttcagccaggaggtggtgtggcagagaggcctgcccagcatcccctacagccagtacagcttcgaccacctgtacaacaccaacgacatcatccacaccccccagatcagaaaggccagaccccagaagcccgtgagcttcaagttcctgggcagcagcagccccctgaccggcgacaccagcctggccgtgaagaccgagagcagcgccaaccccgagaagaagctgaagaagagcaagcccgccagcaccgtgagagaggcccccagacccctgatccaccacccctgcatgcaccccgacatgctgggcagaccccccagcctggacgtgaacctggaggagagagaggcctggtag

SEQ ID NO: 21681 - DNA, 120 bp, Artificial Sequence
  Description of Artificial Sequence: Synthetic coding sequence
atgaccagaacccagaagggcaagaccttcctgccccactgcttctaccagagcctgccccccagactgggctggggcatgatcctgaactacagcaagctgaagggcaaggaggagtag

SEQ ID NO: 21682 - DNA, 2940 bp, Artificial Sequence
  Description of Artificial Sequence: Synthetic coding sequence
atggtgttcttcagcagccagtacagactgcacagaaagagccagtacctgaagatggccgccgccaacctgaccttcagccaggaggtggtgtggcagagaggcctgcccagcatcccctacagccagtacagcttcgaccacctgtacaacaccaacgacatcatccacaccccccagatcagaaaggccagaccccagaagcccgtgagcttcaagttcctgggcagcagcagccccctgaccggcgacaccagcctggccgtgaagaccgagagcagcgccaaccccgagaagaagctgaagaagagcaagcccgccagcaccgtgagagaggcccccagacccctgatccaccacccctgcatgcaccccgacatgctgggcagaccccccagcctggacgtgaacctggaggagagagaggcctggctgctgccccccgagaaggaggccagagcctgggaggccaccgtgctggagaagctgaacgagagaaccgccagatggatccagagcaagagacccagaagacccggcgccagccccaacaagtggcagagcttcctgagacagcagtacgactggagccacatcagagacgagctgaccagcgccagcgacctggagctgctgaagcagctggaggccgaggagaccgccgagttcgaggaccagagcgtgatcctgcccccccaggagaagaagaagcccgagctgctgctgcccgtgtactacagactgcccagctacttccagcaggccgagaccgtggagatcatgcccggcaacaagagcaccgaggacatccacgagaagaccagcctgagccagccccagacccagagctacttcagacaggtgacccccagagccggcaagttcgcctacagcaccgacaacaccttcgagcaggagatctacttcgacgaggtgcagatcatccaccagatcggcgccaagagagaccagatcgtgctggagaacctgaacagatacaacaagcagctgagcaaggtgttccccgagacccccgagaagtggagcgcccaggccatccccgaggccagctacagacccgtgcagggcgccctgagatggaccgccctgcccacccccgccaaggacatgctgctgcaggtgggcgagaaggacgtgcccatcaagaccagaagactgaagaagcaggccaagagcctgcaggaggacgtgacctgggagctggtggtgctgagaagaatgctgaaggagtggaagaccgcctgggccctgatcatcgagtggcaccacgagaccgtggagaacctgctgcagagcctgggcgacctgcacgacgacgtgagaatcaaggccatcaccacctgcgccaccgccgccctggagagacccagaatcgccaccagccagagagacagcgacaagaccatccaggacctgcccgaggtgctgctgcccgccctggaggccgccctgtgcgacaagaacgcccacgtgagaatggccgccgccatctgccagtacgccatccagagccacaaccccctggccagaaacatcatgcagaccgccctgctgaagggcaacagcgtggacagctgggccgccgcccagtgcctggccctggagggcaccgccacctaccccgtgatcaagagaatcctgcaccagctgttcaccaagaagaacgaggacaccgaggagcagagctacatcctgctgagctacctgagcgagaagaccaccctgatccacaccatgctggccgtggagctgaacagctgccagtggaagaacagaatcgtggcctgccaggccttcagcagaatcagcggcaacgtgtgcctggacatgaagcacaagctgatccagctgatgtggaacgactggaacaaggaggtgagaagagccgccgcccaggccctgggccagatgagcctgggcaaggaggtgcacgacatcatcagagtgaagctgggccagggcaacagccaggagagagtggaggccctgtacctgatcggcgagctgaagctgatgaccgccaagctgctgcccagcttcctgcactgcttcagcgacgacttcaccgccgtgagaagagccgcctgcctggccgccggcgccctgcagatcagagacaagatggtgctggagtgcctgctgaacctgatgcagagagacccctactggaagatcaaggccttcgccatcagagccctgggccagatcggccaggtgagccccgagctgaccgacctgctgctgtgggccatccactacgaggagagccccggcgtgagactggaggcctgcagaagcatcctggccctgaagctgcagggcgacagagtgagagacaccttcctggacgtgctgctgctggagaaccacgacgccgtgctgaaggagatgtaccagaccatgaagatcctgaacctgggcaacgagggcaaccaggagatgctgcaggagatcaagaacagaatcaagaccctgagccagaaggacctgctgacccacaagatcctgaagctggagatggtgatgggcaaggtgagagaggaggccaagagagtgtacctgaagcccaagggcgagcagggccccctgaccctgcagaccctgctgcaggagaccttccaggacgagatggtgctgcccagaagacccagcgaggtgtgcgacaccgaggccgtgatcaagcccgtgaagcccagagcccccaacccctggctgcagagcagcgtgcccggcctgaccaccagaagcaaggtgagaagcagcctggtgaaggacctgagaaccagccccgagaagagaatcgccgtgggccccttcagaagcgactaccccgccctgtacctgggcaagttcagcgagagaaccttcttcagccccatcatgagcagccccagcggcaagaagggcgcccacctgtag

SEQ ID NO: 21683 - DNA, 6123 bp, Artificial Sequence
  Description of Artificial Sequence: Synthetic coding sequence
atggagctggcccacagcctgctgctgaacgaggaggcctacaaccagctgggcgaggtgcagaaggccgagttcatcttcgagtggctgagatacctggagaagctgctgctggccaccagcagaaacgacgtgagagagaagcagaagaccctggtggagcagctgctgagcctgctgaacagcagccccggcccccccaccagaaagctgctggccaagaacctggccatcctgtacagcatcggcgacaccttcagcgtgcacgaggccatcgacaagtgcaacgacctgatcagaagcaaggacgacagccccagctacctgcccaccaagctggccgccgtggtgtgcctgggcagcctgtacaagaagctgggcagaatcctgggcaacaccttcaccgacaccgtgggcaacatcctgaaggccatgaagagcgccgagagccagggcagatacgagatcatgctgagcctgcagaacatcctgaacggcctgggcgccgccgccgccccctgccacagagacgtgtacaaggccgccagaagctgcctgaccgacagaagcatggccgtgagatgcgccgccgccaagaacgaggccatcttcatgtggagcaccgacctggacagcgtggccaccctgtgcttcaagagcttcgagggcagcaactacgacgtgagaatcagcgtgagcaagctgctgggcatcatcctggccaaggccgtgatcagcaagcaccccggcaccgccgccagcagacagagcatcagaagagtgagcctggaggaggtgctggagctgctgggcaccggcttcctgagaggcagcagcggcttcctgagagccagcggcgacatgctgaagggcaccagcagcgtgagcagagacgtgagagtgggcgtgacccaggcctacgtggtgttcgtgagcaccctgggcggcgcctggctggagaagaacttcgccgccttcttcagccacatcctgagcctggccagccccagccaccccaaggccacccagacccagatcgacgccgtgtgctgcagaagatgcgtgagcttcatcctgagaaccaccatcggcggcctgctgggcgagaaggcccagctggccgccgtgaaggacatctgccaggccatctggaagctgaagaaggtgatggacgccgtgatgagcgacggcaacctggagaccagactgggcagcaccgacgtggccgccagccagcacatgctggtgtgcgccctgcaggagctgggcaacctgatccacaacctgggcaccaccgccgcccccctgctgcaggacagcagcaccggcctgctggacagcatcctgagcgtgatcctgcaccccagcatcagcgtgagactggccgccgcctggtgcctgcactgcatcgccgtggccctgcccagctacctgacccccctgctggacagatgcctggagagactgaccggccacaagagcagccccgaggccgtgaccggcttcagcttcgccgtggccgccctgctgggcgccgtgaagcactgccccctgggcatcccccacggcaagggcaagatcatcatgaccctggccgaggacctgctgtgcagcgccgcccagaacagcagactgagcgcccagagaacccaggccggctggctgctgatcagcgccctgatgaccctgggccccgccgtggtgagccaccacctggccagagtgctgctgctgtggaagtgcgtgttccccgccagccccaaggacctggagaccgagaagagcagaggcgacagcttcacctggcaggtgaccctggagggcagagccggcgccctgtgcgccatcaagagcttcgtgagccactgcggcgacctgctgaccgaggaggtgacccagagactgctgccccccctgccctgcgccgtggacctgctgacccagctgagcagcatcctgaagatgtacggcagccccctgaagacccccagcgtggtgtacagacagagactgtacgagctgctgatcctgctgccccccgagacctacgagggcaacctgtgcgccatcctgagagagctggccgccgacctgaccgcccccgacatccaggtggccgccagcaccttcctgctgccccccctgtgccaccaggacgacctgctgatcctgagccccttcctgcaggagaccgaccacagattcatcgaggagcagctgctgctgggcaacggcgtggcctgcggcagcctggagtacgacccctacagcatctacgagaaggacgtggagggcgacagcgtgcccaagcccctgccccccgccctgagcgtgatcagcagcgccagcaagctgttcggcgtggtgtgcgcccacgtgggcgagacccagagactgctgatcctggagcagctgctggacagcatcaagcacaccaagggcgccagacagcaggtggtgcagctgcacgtggtgagcagcgtgagcagcttcctgaagtacgtggccggcagcaagggctgcctgggccccgaggagatgaagagattcgccctgaccctggtgatgggcgccctggagagccccaaccccctgctgagatgcgccgccgccgagagctgggccagactggcccaggtggtggacgacggcgccttcaccgccggcctggcccaggtgagcttcgacaagctgaagagcgccagagacgtggtgaccagaaccggccacagcctggccctgggcagcctgcacagatacctgggcggcatcagcagcagccagcacctgaacagctgcatcggcatcctgtacaccctggcccaggacagcaccagccccgacgtgcagacctgggccctgcacagcctgagcctgatcatcgacagcgccggccccctgtactacgtgcacgtggagcccaccctgagcctgatcatcatgctgctgctgaacgtgccccccacccacgccgaggtgcaccagagcctgggcagatgcctgaacgccctgatcaccaccctgggccccgagctgcagggcaacagcaccagcatcagcaccctgagaaccagctgcctgctgggctgcgccgtgatgcaggacaaccccgactgcctggtgcaggcccaggccatcagctgcctgcagcagctgcacatgttcgcccccagacacgtgaacctgagcagcctggtgagctgcctgtgcgtgaacctgtgcagcccctacctgctgctgagaagagccgtgctggcctgcctgagacagctggtgcagagagaggccgccgaggtgagcgagcacgccgtgatgctggccaaggacagcagagaggagctgacccccgacgccaacatcagagaggtgggcctggagggcgccctgctgatcctgctggacaaggagaccgacgagagactgtgccacgacatcaaggagaccctgaactacatgctgaccagcatggccgtggagaagctgagcctgtggctgaagctgtgcaaggacgtgctggccgccagcgccgacttcaccgccgtgacctgcgtggacaccatgcaggaggaggagggcgacaagggcgacgacgccagcgtgctgaccaccagaagagacgagaagagccaccccttcaccaaccccagatgggccaccagagtgttcgccgccgagtgcgtgtgcagaatcatcaaccagtgcgagaacgccaacagcgcccacttcgacatcgccctggcccaggagatgaagaagagagacagcagaaacgacttcctggtgctgcacctggccgacctgatcagaatggccttcatggccgccaccgaccacagcgaccagctgagactgagcggcctggagatgctgctggtggtgatcagaagattcgccaccgtgcccgagcccgagttccccggccacgtgatcctggagcagtaccaggccaacgtgggcgccgccctgagacccgccttcaccagcgagaccccccccgacgtgaccgccaaggcctgccaggtgtgcagcgcctggatcgccagcggcgtggtgagcgacctgaacgacctgagaagagtgcaccagctgctggtgagcagcctgaccaagatccaggccggcaaggaggccctgagccacctgtacaacgagagcgccagcaccatggagatcctggccgtgctgaaggcctgggccgaggtgtacatcatcgccgtgcagagacacaagaaccacagacagcccctgaagaccaccacctgcctggaggacggcatcagaaacggcagctgcagcagcgacggcctgctggacctggtgtacgccgacctgggcaccctgagcagactgtggctggccgccctgcaggacttcgccctgctgaccctgcccagcgagttcgccagccagctgcccgccgagggcggcgccttctacaccgccgagaccagcgagaacgccaagctgcactactacaacagctgggccctgatcctgcacgccaccgccctgtggctgaccagcaccggcttcgtggtggccgaccccgacgagggcgccagcaacctgagcagacccgtgacccccaccagcatgtgccagggcagcagcagcggcgccaccatcaagagccccgaggacgtgtacaccgacagattccacctgatcctgggcatcagcgtggagttcctgtgcagcctgagaagcgacgccaccatggagagcatcaccgcctgcctgcacgccctgcaggccctgctggacgtgccctggcccagaagcaagatcggcagcgaccaggacctgggcatcgagctgctgaacgtgctgcacagagtgatcctgaccagagagagccccagcatccagctggccagcctggaggtggtgagacagatcatctgcgccgcccaggagcacgtgaaggagaagagaagaagcgccgaggtggacgacggcgccgccgagaaggagaccctgcccgagttcggcgagggcaaggacaccggcggcctggtgcccggcaagagcctggtgttcgccaccctggagctgtgcgtgtgcatcctggtgagacagctgcccgagctgaaccccaagctgaccggcagccccggcgtgaaggccaccaagccccagatcctgctggaggacggcagcagactggtgagcgccgccctggtgatcctgagcgagctgcccgccgtgtgcagccccgagggcagcatcagcatcctgcccaccatcctgtacctgaccatcggcgtgctgagagagaccgccgtgaagctgcccggcggccagctgagcagcaccgtggccgccagcctgcaggccctgaagggcatcctgagcagccccatggccagagccgagaagagcagaaccgcctggaccgacctgctgagaagcgccctgaccaccatcctggactgctgggaccccgtggacgagacccaccaggagctggacgaggtgagcctgctgaccgccatcaccgtgttcatcctgagcaccagccccgaggtgaccaccatcccctgcctgcagaagagatgcatcgacaagttcaaggccaccctggagatcaaggaccccgtggtgcagatcaagacctaccagctgctgcacagcatcttccagtaccccaaccccgccgtgagctacccctacatctacagcctggccagctgcatcatggagaagctgcaggagatcgacaagagaaagcccgagaacaccgccgagctggagatcttccaggagggcatcaaggtgctggagaccctggtgaccgtggccgaggagcaccacagagcccagctggtggcctgcctgctgcccatcctgatcagcttcctgctggacgagaacagcctgggcagcgccaccagcatcatgagaaacctgcacgacttcgccctgcagaacctgatgcagatcggcccccagtacagcagcgtgttcaagagcctggtggccagcagccccgccctgaaggccagactggaggccgccatcaagggcaaccaggagagcgtgaaggtgaagatccccaccagcaagtacaccaagagccccggcaagaacagcagcatccagctgaagaccagcttcctgtag

SEQ ID NO: 21684 - DNA, 3423 bp, Artificial Sequence
  Description of Artificial Sequence: Synthetic coding sequence
atggagctggcccacagcctgctgctgaacgaggaggcctacaaccagctgggcgaggtgcagaaggccgagttcatcttcgagtggctgagatacctggagaagctgctgctggccaccagcagaaacgacgtgagagagaagcagaagaccctggtggagcagctgctgagcctgctgaacagcagccccggcccccccaccagaaagctgctggccaagaacctggccatcctgtacagcatcggcgacaccttcagcgtgcacgaggccatcgacaagtgcaacgacctgatcagaagcaaggacgacagccccagctacctgcccaccaagctggccgccgtggtgtgcctgggcagcctgtacaagaagctgggcagaatcctgggcaacaccttcaccgacaccgtgggcaacatcctgaaggccatgaagagcgccgagagccagggcagatacgagatcatgctgagcctgcagaacatcctgaacggcctgggcgccgccgccgccccctgccacagagacgtgtacaaggccgccagaagctgcctgaccgacagaagcatggccgtgagatgcgccgccgccaagtgcctgctggagctgcagaacgaggccatcttcatgtggagcaccgacctggacagcgtggccaccctgtgcttcaagagcttcgagggcagcaactacgacgtgagaatcagcgtgagcaagctgctgggcatcatcctggccaaggccgtgatcagcaagcaccccggcaccgccgccagcagacagagcatcagaagagtgagcctggaggaggtgctggagctgctgggcaccggcttcctgagaggcagcagcggcttcctgagagccagcggcgacatgctgaagggcaccagcagcgtgagcagagacgtgagagtgggcgtgacccaggcctacgtggtgttcgtgagcaccctgggcggcgcctggctggagaagaacttcgccgccttcttcagccacatcctgagcctggccagccccagccaccccaaggccacccagacccagatcgacgccgtgtgctgcagaagatgcgtgagcttcatcctgagaaccaccatcggcggcctgctgggcgagaaggcccagctggccgccgtgaaggacatctgccaggccatctggaagctgaagaaggtgatggacgccgtgatgagcgacggcaacctggagaccagactgggcagcaccgacgtggccgccagccagcacatgctggtgtgcgccctgcaggagctgggcaacctgatccacaacctgggcaccaccgccgcccccctgctgcaggacagcagcaccggcctgctggacagcatcctgagcgtgatcctgcaccccagcatcagcgtgagactggccgccgcctggtgcctgcactgcatcgccgtggccctgcccagctacctgacccccctgctggacagatgcctggagagactgaccggccacaagagcagccccgaggccgtgaccggcttcagcttcgccgtggccgccctgctgggcgccgtgaagcactgccccctgggcatcccccacggcaagggcaagatcatcatgaccctggccgaggacctgctgtgcagcgccgcccagaacagcagactgagcgcccagagaacccaggccggctggctgctgatcagcgccctgatgaccctgggccccgccgtggtgagccaccacctggccagagtgctgctgctgtggaagtgcgtgttccccgccagccccaaggacctggagaccgagaagagcagaggcgacagcttcacctggcaggtgaccctggagggcagagccggcgccctgtgcgccatcaagagcttcgtgagccactgcggcgacctgctgaccgaggaggtgacccagagactgctgccccccctgccctgcgccgtggacctgctgacccagctgagcagcatcctgaagatgtacggcagccccctgaagacccccagcgtggtgtacagacagagactgtacgagctgctgatcctgctgccccccgagacctacgagggcaacctgtgcgccatcctgagagagctggccgccgacctgaccgcccccgacatccaggtggccgccagcaccttcctgctgccccccctgtgccaccaggacgacctgctgatcctgagccccttcctgcaggagaccgaccacagattcatcgaggagcagctgctgctgggcaacggcgtggcctgcggcagcctggagtacgacccctacagcatctacgagaaggacgtggagggcgacagcgtgcccaagcccctgccccccgccctgagcgtgatcagcagcgccagcaagctgttcggcgtggtgtgcgcccacgtgggcgagacccagagactgctgatcctggagcagctgctggacagcatcaagcacaccaagggcgccagacagcaggtggtgcagctgcacgtggtgagcagcgtgagcagcttcctgaagtacgtggccggcagcaagggctgcctgggccccgaggagatgaagagattcgccctgaccctggtgatgggcgccctggagagccccaaccccctgctgagatgcgccgccgccgagagctgggccagactggcccaggtggtggacgacggcgccttcaccgccggcctggcccaggtgagcttcgacaagctgaagagcgccagagacgtggtgaccagaaccggccacagcctggccctgggcagcctgcacagatacctgggcggcatcagcagcagccagcacctgaacagctgcatcggcatcctgtacaccctggcccaggacagcaccagccccgacgtgcagacctgggccctgcacagcctgagcctgatcatcgacagcgccggccccctgtactacgtgcacgtggagcccaccctgagcctgatcatcatgctgctgctgaacgtgccccccacccacgccgaggtgcaccagagcctgggcagatgcctgaacgccctgatcaccaccctgggccccgagctgcagggcaacagcaccagcatcagcaccctgagaaccagctgcctgctgggctgcgccgtgatgcaggacaaccccgactgcctggtgcaggcccaggccatcagctgcctgcagcagctgcacatgttcgcccccagacacgtgaacctgagcagcctggtgagctgcctgtgcgtgaacctgtgcagcccctacctgctgctgagaagagccgtgctggcctgcctgagacagctggtgcagagagaggccgccgaggtgagcgagcacgccgtgatgctggccaaggacagcagagaggagctgacccccgtgttcaccgccagcagccccggcgtggacagcatctgcagaaaccacctggagtag

SEQ ID NO: 21685 - DNA, 5898 bp, Artificial Sequence
  Description of Artificial Sequence: Synthetic coding sequence
atggagctggcccacagcctgctgctgaacgaggaggcctacaaccagctgggcgaggtgcagaaggccgagttcatcttcgagtggctgagatacctggagaagctgctgctggccaccagcagaaacgacgtgagagagaagcagaagaccctggtggagcagctgctgagcctgctgaacagcagccccggcccccccaccagaaagctgctggccaagaacctggccatcctgtacagcatcggcgacaccttcagcgtgcacgaggccatcgacaagtgcaacgacctgatcagaagcaaggacgacagccccagctacctgcccaccaagctggccgccgtggtgtgcctgggcagcctgtacaagaagctgggcagaatcctgggcaacaccttcaccgacaccgtgggcaacatcctgaaggccatgaagagcgccgagagccagggcagatacgagatcatgctgagcctgcagaacatcctgaacggcctgggcgccgccgccgccccctgccacagagacgtgtacaaggccgccagaagctgcctgaccgacagaagcatggccgtgagatgcgccgccgccaagaacgaggccatcttcatgtggagcaccgacctggacagcgtggccaccctgtgcttcaagagcttcgagggcagcaactacgacgtgagaatcagcgtgagcaagctgctgggcatcatcctggccaaggccgtgatcagcaagcaccccggcaccgccgccagcagacagagcatcagaagagtgagcctggaggaggtgctggagctgctgggcaccggcttcctgagaggcagcagcggcttcctgagagccagcggcgacatgctgaagggcaccagcagcgtgagcagagacgtgagagtgggcgtgacccaggcctacgtggtgttcgtgagcaccctgggcggcgcctggctggagaagaacttcgccgccttcttcagccacatcctgagcctggccagccccagccaccccaaggccacccagacccagatcgacgccgtgtgctgcagaagatgcgtgagcttcatcctgagaaccaccatcggcggcctgctgggcgagaaggcccagctggccgccgtgaaggacatctgccaggccatctggaagctgaagaaggtgatggacgccgtgatgagcgacggcaacctggagaccagactgggcagcaccgacgtggccgccagccagcacatgctggtgtgcgccctgcaggagctgggcaacctgatccacaacctgggcaccaccgccgcccccctgctgcaggacagcagcaccggcctgctggacagcatcctgagcgtgatcctgcaccccagcatcagcgtgagactggccgccgcctggtgcctgcactgcatcgccgtggccctgcccagctacctgacccccctgctggacagatgcctggagagactgaccggccacaagagcagccccgaggccgtgaccggcttcagcttcgccgtggccgccctgctgggcgccgtgaagcactgccccctgggcatcccccacggcaagggcaagatcatcatgaccctggccgaggacctgctgtgcagcgccgcccagaacagcagactgagcgcccagagaacccaggccggctggctgctgatcagcgccctgatgaccctgggccccgccgtggtgagccaccacctggccagagtgctgctgctgtggaagtgcgtgttccccgccagccccaaggacctggagaccgagaagagcagaggcgacagcttcacctggcaggtgaccctggagggcagagccggcgccctgtgcgccatcaagagcttcgtgagccactgcggcgacctgctgaccgaggaggtgacccagagactgctgccccccctgccctgcgccgtggacctgctgacccagctgagcagcatcctgaagatgtacggcagccccctgaagacccccagcgtggtgtacagacagagactgtacgagctgctgatcctgctgccccccgagacctacgagggcaacctgtgcgccatcctgagagagctggccgccgacctgaccgcccccgacatccaggtggccgccagcaccttcctgctgccccccctgtgccaccaggacgacctgctgatcctgagccccttcctgcaggagaccgaccacagattcatcgaggagcagctgctgctgggcaacggcgtggcctgcggcagcctggagtacgacccctacagcatctacgagaaggacgtggagggcgacagcgtgcccaagcccctgccccccgccctgagcgtgatcagcagcgccagcaagctgttcggcgtggtgtgcgcccacgtgggcgagacccagagactgctgatcctggagcagctgctggacagcatcaagcacaccaagggcgccagacagcaggtggtgcagctgcacgtggtgagcagcgtgagcagcttcctgaagtacgtggccggcagcaagggctgcctgggccccgaggagatgaagagattcgccctgaccctggtgatgggcgccctggagagccccaaccccctgctgagatgcgccgccgccgagagctgggccagactggcccaggtggtggacgacggcgccttcaccgccggcctggcccaggtgagcttcgacaagctgaagagcgccagagacgtggtgaccagaaccggccacagcctggccctgggcagcctgcacagatacctgggcggcatcagcagcagccagcacctgaacagctgcatcggcatcctgtacaccctggcccaggacagcaccagccccgacgtgcagacctgggccctgcacagcctgagcctgatcatcgacagcgccggccccctgtactacgtgcacgtggagcccaccctgagcctgatcatcatgctgctgctgaacgtgccccccacccacgccgaggtgcaccagagcctgggcagatgcctgaacgccctgatcaccaccctgggccccgagctgcagggcaacagcaccagcatcagcaccctgagaaccagctgcctgctgggctgcgccgtgatgcaggacaaccccgactgcctggtgcaggcccaggccatcagctgcctgcagcagctgcacatgttcgcccccagacacgtgaacctgagcagcctggtgagctgcctgtgcgtgaacctgtgcagcccctacctgctgctgagaagagccgtgctggcctgcctgagacagctggtgcagagagaggccgccgaggtgagcgagcacgccgtgatgctggccaaggacagcagagaggagctgacccccgacgccaacatcagagaggtgggcctggagggcgccctgctgatcctgctggacaaggagaccgacgagagactgtgccacgacatcaaggagaccctgaactacatgctgaccagcatggccgtggagaagctgagcctgtggctgaagctgtgcaaggacgtgctggccgccagcgccgacttcaccgccgtgacctgcgtggacaccatgcaggaggaggagggcgacaagggcgacgacgccagcgtgctgaccaccagaagagacgagaagagccaccccttcaccaaccccagatgggccaccagagtgttcgccgccgagtgcgtgtgcagaatcatcaaccagtgcgagaacgccaacagcgcccacttcgacatcgccctggcccaggagatgaagaagagagacagcagaaacgacttcctggtgctgcacctggccgacctgatcagaatggccttcatggccgccaccgaccacagcgaccagctgagactgagcggcctggagatgctgctggtggtgatcagaagattcgccaccgtgcccgagcccgagttccccggccacgtgatcctggagcagtaccaggccaacgtgggcgccgccctgagacccgccttcaccagcgagaccccccccgacgtgaccgccaaggcctgccaggtgtgcagcgcctggatcgccagcggcgtggtgagcgacctgaacgacctgagaagagtgcaccagctgctggtgagcagcctgaccaagatccaggccggcaaggaggccctgagccacctgtacaacgagagcgccagcaccatggagatcctggccgtgctgaaggcctgggccgaggtgtacatcatcgccgtgcagagacacaagaaccacagacagcccctgaagaccaccacctgcctggaggacggcatcagaaacggcagctgcagcagcgacggcctgctggacctggtgtacgccgacctgggcaccctgagcagactgtggctggccgccctgcaggacttcgccctgctgaccctgcccagcgagttcgccagccagctgcccgccgagggcggcgccttctacaccgccgagaccagcgagaacgccaagctgcactactacaacagctgggccctgatcctgcacgccaccgccctgtggctgaccagcaccggcttcgtggtggccgaccccgacgagggcgccagcaacctgagcagacccgtgacccccaccagcatgtgccagggcagcagcagcggcgccaccatcaagagccccgaggacgtgtacaccgacagattccacctgatcctgggcatcagcgtggagttcctgtgcagcctgagaagcgacgccaccatggagagcatcaccgcctgcctgcacgccctgcaggccctgctggacgtgccctggcccagaagcaagatcggcagcgaccaggacctgggcatcgagctgctgaacgtgctgcacagagtgatcctgaccagagagagccccagcatccagctggccagcctggaggtggtgagacagatcatctgcgccgcccaggagcacgtgaaggagaagagaagaagcgccgaggtggacgacggcgccgccgagaaggagaccctgcccgagttcggcgagggcaaggacaccggcggcctggtgcccggcaagagcctggtgttcgccaccctggagctgtgcgtgtgcatcctggtgagacagctgcccgagctgaaccccaagctgaccggcagccccggcgtgaaggccaccaagccccagatcctgctggaggacggcagcagactggtgagcgccgccctggtgatcctgagcgagctgcccgccgtgtgcagccccgaggtggacgagacccaccaggagctggacgaggtgagcctgctgaccgccatcaccgtgttcatcctgagcaccagccccgaggtgaccaccatcccctgcctgcagaagagatgcatcgacaagttcaaggccaccctggagatcaaggaccccgtggtgcagatcaagacctaccagctgctgcacagcatcttccagtaccccaaccccgccgtgagctacccctacatctacagcctggccagctgcatcatggagaagctgcaggagatcgacaagagaaagcccgagaacaccgccgagctggagatcttccaggagggcatcaaggtgctggagaccctggtgaccgtggccgaggagcaccacagagcccagctggtggcctgcctgctgcccatcctgatcagcttcctgctggacgagaacagcctgggcagcgccaccagcatcatgagaaacctgcacgacttcgccctgcagaacctgatgcagatcggcccccagtacagcagcgtgttcaagagcctggtggccagcagccccgccctgaaggccagactggaggccgccatcaagggcaaccaggagagcgtgaaggtgaagatccccaccagcaagtacaccaagagccccggcaagaacagcagcatccagctgaagaccagcttcctgtag

SEQ ID NO: 21686 - DNA, 5262 bp, Artificial Sequence
  Description of Artificial Sequence: Synthetic coding sequence
atgctgaagggcaccagcagcgtgagcagagacgtgagagtgggcgtgacccaggcctacgtggtgttcgtgagcaccctgggcggcgcctggctggagaagaacttcgccgccttcttcagccacatcctgagcctggccagccccagccaccccaaggccacccagacccagatcgacgccgtgtgctgcagaagatgcgtgagcttcatcctgagaaccaccatcggcggcctgctgggcgagaaggcccagctggccgccgtgaaggacatctgccaggccatctggaagctgaagaaggtgatggacgccgtgatgagcgacggcaacctggagaccagactgggcagcaccgacgtggccgccagccagcacatgctggtgtgcgccctgcaggagctgggcaacctgatccacaacctgggcaccaccgccgcccccctgctgcaggacagcagcaccggcctgctggacagcatcctgagcgtgatcctgcaccccagcatcagcgtgagactggccgccgcctggtgcctgcactgcatcgccgtggccctgcccagctacctgacccccctgctggacagatgcctggagagactgaccggccacaagagcagccccgaggccgtgaccggcttcagcttcgccgtggccgccctgctgggcgccgtgaagcactgccccctgggcatcccccacggcaagggcaagatcatcatgaccctggccgaggacctgctgtgcagcgccgcccagaacagcagactgagcgcccagagaacccaggccggctggctgctgatcagcgccctgatgaccctgggccccgccgtggtgagccaccacctggccagagtgctgctgctgtggaagtgcgtgttccccgccagccccaaggacctggagaccgagaagagcagaggcgacagcttcacctggcaggtgaccctggagggcagagccggcgccctgtgcgccatcaagagcttcgtgagccactgcggcgacctgctgaccgaggaggtgacccagagactgctgccccccctgccctgcgccgtggacctgctgacccagctgagcagcatcctgaagatgtacggcagccccctgaagacccccagcgtggtgtacagacagagactgtacgagctgctgatcctgctgccccccgagacctacgagggcaacctgtgcgccatcctgagagagctggccgccgacctgaccgcccccgacatccaggtggccgccagcaccttcctgctgccccccctgtgccaccaggacgacctgctgatcctgagccccttcctgcaggagaccgaccacagattcatcgaggagcagctgctgctgggcaacggcgtggcctgcggcagcctggagtacgacccctacagcatctacgagaaggacgtggagggcgacagcgtgcccaagcccctgccccccgccctgagcgtgatcagcagcgccagcaagctgttcggcgtggtgtgcgcccacgtgggcgagacccagagactgctgatcctggagcagctgctggacagcatcaagcacaccaagggcgccagacagcaggtggtgcagctgcacgtggtgagcagcgtgagcagcttcctgaagtacgtggccggcagcaagggctgcctgggccccgaggagatgaagagattcgccctgaccctggtgatgggcgccctggagagccccaaccccctgctgagatgcgccgccgccgagagctgggccagactggcccaggtggtggacgacggcgccttcaccgccggcctggcccaggtgagcttcgacaagctgaagagcgccagagacgtggtgaccagaaccggccacagcctggccctgggcagcctgcacagatacctgggcggcatcagcagcagccagcacctgaacagctgcatcggcatcctgtacaccctggcccaggacagcaccagccccgacgtgcagacctgggccctgcacagcctgagcctgatcatcgacagcgccggccccctgtactacgtgcacgtggagcccaccctgagcctgatcatcatgctgctgctgaacgtgccccccacccacgccgaggtgcaccagagcctgggcagatgcctgaacgccctgatcaccaccctgggccccgagctgcagggcaacagcaccagcatcagcaccctgagaaccagctgcctgctgggctgcgccgtgatgcaggacaaccccgactgcctggtgcaggcccaggccatcagctgcctgcagcagctgcacatgttcgcccccagacacgtgaacctgagcagcctggtgagctgcctgtgcgtgaacctgtgcagcccctacctgctgctgagaagagccgtgctggcctgcctgagacagctggtgcagagagaggccgccgaggtgagcgagcacgccgtgatgctggccaaggacagcagagaggagctgacccccgacgccaacatcagagaggtgggcctggagggcgccctgctgatcctgctggacaaggagaccgacgagagactgtgccacgacatcaaggagaccctgaactacatgctgaccagcatggccgtggagaagctgagcctgtggctgaagctgtgcaaggacgtgctggccgccagcgccgacttcaccgccgtgacctgcgtggacaccatgcaggaggaggagggcgacaagggcgacgacgccagcgtgctgaccaccagaagagacgagaagagccaccccttcaccaaccccagatgggccaccagagtgttcgccgccgagtgcgtgtgcagaatcatcaaccagtgcgagaacgccaacagcgcccacttcgacatcgccctggcccaggagatgaagaagagagacagcagaaacgacttcctggtgctgcacctggccgacctgatcagaatggccttcatggccgccaccgaccacagcgaccagctgagactgagcggcctggagatgctgctggtggtgatcagaagattcgccaccgtgcccgagcccgagttccccggccacgtgatcctggagcagtaccaggccaacgtgggcgccgccctgagacccgccttcaccagcgagaccccccccgacgtgaccgccaaggcctgccaggtgtgcagcgcctggatcgccagcggcgtggtgagcgacctgaacgacctgagaagagtgcaccagctgctggtgagcagcctgaccaagatccaggccggcaaggaggccctgagccacctgtacaacgagagcgccagcaccatggagatcctggccgtgctgaaggcctgggccgaggtgtacatcatcgccgtgcagagacacaagaaccacagacagcccctgaagaccaccacctgcctggaggacggcatcagaaacggcagctgcagcagcgacggcctgctggacctggtgtacgccgacctgggcaccctgagcagactgtggctggccgccctgcaggacttcgccctgctgaccctgcccagcgagttcgccagccagctgcccgccgagggcggcgccttctacaccgccgagaccagcgagaacgccaagctgcactactacaacagctgggccctgatcctgcacgccaccgccctgtggctgaccagcaccggcttcgtggtggccgaccccgacgagggcgccagcaacctgagcagacccgtgacccccaccagcatgtgccagggcagcagcagcggcgccaccatcaagagccccgaggacgtgtacaccgacagattccacctgatcctgggcatcagcgtggagttcctgtgcagcctgagaagcgacgccaccatggagagcatcaccgcctgcctgcacgccctgcaggccctgctggacgtgccctggcccagaagcaagatcggcagcgaccaggacctgggcatcgagctgctgaacgtgctgcacagagtgatcctgaccagagagagccccagcatccagctggccagcctggaggtggtgagacagatcatctgcgccgcccaggagcacgtgaaggagaagagaagaagcgccgaggtggacgacggcgccgccgagaaggagaccctgcccgagttcggcgagggcaaggacaccggcggcctggtgcccggcaagagcctggtgttcgccaccctggagctgtgcgtgtgcatcctggtgagacagctgcccgagctgaaccccaagctgaccggcagccccggcgtgaaggccaccaagccccagatcctgctggaggacggcagcagactggtgagcgccgccctggtgatcctgagcgagctgcccgccgtgtgcagccccgagggcagcatcagcatcctgcccaccatcctgtacctgaccatcggcgtgctgagagagaccgccgtgaagctgcccggcggccagctgagcagcaccgtggccgccagcctgcaggccctgaagggcatcctgagcagccccatggccagagccgagaagagcagaaccgcctggaccgacctgctgagaagcgccctgaccaccatcctggactgctgggaccccgtggacgagacccaccaggagctggacgaggtgagcctgctgaccgccatcaccgtgttcatcctgagcaccagccccgaggtgaccaccatcccctgcctgcagaagagatgcatcgacaagttcaaggccaccctggagatcaaggaccccgtggtgcagatcaagacctaccagctgctgcacagcatcttccagtaccccaaccccgccgtgagctacccctacatctacagcctggccagctgcatcatggagaagctgcaggagatcgacaagagaaagcccgagaacaccgccgagctggagatcttccaggagggcatcaaggtgctggagaccctggtgaccgtggccgaggagcaccacagagcccagctggtggcctgcctgctgcccatcctgatcagcttcctgctggacgagaacagcctgggcagcgccaccagcatcatgagaaacctgcacgacttcgccctgcagaacctgatgcagatcggcccccagtacagcagcgtgttcaagagcctggtggccagcagccccgccctgaaggccagactggaggccgccatcaagggcaaccaggagagcgtgaaggtgaagatccccaccagcaagtacaccaagagccccggcaagaacagcagcatccagctgaagaccagcttcctgtag

SEQ ID NO: 21687 - DNA, 6141 bp, Artificial Sequence
  Description of Artificial Sequence: Synthetic coding sequence
atggagctggcccacagcctgctgctgaacgaggaggcctacaaccagctgggcgaggtgcagaaggccgagttcatcttcgagtggctgagatacctggagaagctgctgctggccaccagcagaaacgacgtgagagagaagcagaagaccctggtggagcagctgctgagcctgctgaacagcagccccggcccccccaccagaaagctgctggccaagaacctggccatcctgtacagcatcggcgacaccttcagcgtgcacgaggccatcgacaagtgcaacgacctgatcagaagcaaggacgacagccccagctacctgcccaccaagctggccgccgtggtgtgcctgggcagcctgtacaagaagctgggcagaatcctgggcaacaccttcaccgacaccgtgggcaacatcctgaaggccatgaagagcgccgagagccagggcagatacgagatcatgctgagcctgcagaacatcctgaacggcctgggcgccgccgccgccccctgccacagagacgtgtacaaggccgccagaagctgcctgaccgacagaagcatggccgtgagatgcgccgccgccaagtgcctgctggagctgcagaacgaggccatcttcatgtggagcaccgacctggacagcgtggccaccctgtgcttcaagagcttcgagggcagcaactacgacgtgagaatcagcgtgagcaagctgctgggcatcatcctggccaaggccgtgatcagcaagcaccccggcaccgccgccagcagacagagcatcagaagagtgagcctggaggaggtgctggagctgctgggcaccggcttcctgagaggcagcagcggcttcctgagagccagcggcgacatgctgaagggcaccagcagcgtgagcagagacgtgagagtgggcgtgacccaggcctacgtggtgttcgtgagcaccctgggcggcgcctggctggagaagaacttcgccgccttcttcagccacatcctgagcctggccagccccagccaccccaaggccacccagacccagatcgacgccgtgtgctgcagaagatgcgtgagcttcatcctgagaaccaccatcggcggcctgctgggcgagaaggcccagctggccgccgtgaaggacatctgccaggccatctggaagctgaagaaggtgatggacgccgtgatgagcgacggcaacctggagaccagactgggcagcaccgacgtggccgccagccagcacatgctggtgtgcgccctgcaggagctgggcaacctgatccacaacctgggcaccaccgccgcccccctgctgcaggacagcagcaccggcctgctggacagcatcctgagcgtgatcctgcaccccagcatcagcgtgagactggccgccgcctggtgcctgcactgcatcgccgtggccctgcccagctacctgacccccctgctggacagatgcctggagagactgaccggccacaagagcagccccgaggccgtgaccggcttcagcttcgccgtggccgccctgctgggcgccgtgaagcactgccccctgggcatcccccacggcaagggcaagatcatcatgaccctggccgaggacctgctgtgcagcgccgcccagaacagcagactgagcgcccagagaacccaggccggctggctgctgatcagcgccctgatgaccctgggccccgccgtggtgagccaccacctggccagagtgctgctgctgtggaagtgcgtgttccccgccagccccaaggacctggagaccgagaagagcagaggcgacagcttcacctggcaggtgaccctggagggcagagccggcgccctgtgcgccatcaagagcttcgtgagccactgcggcgacctgctgaccgaggaggtgacccagagactgctgccccccctgccctgcgccgtggacctgctgacccagctgagcagcatcctgaagatgtacggcagccccctgaagacccccagcgtggtgtacagacagagactgtacgagctgctgatcctgctgccccccgagacctacgagggcaacctgtgcgccatcctgagagagctggccgccgacctgaccgcccccgacatccaggtggccgccagcaccttcctgctgccccccctgtgccaccaggacgacctgctgatcctgagccccttcctgcaggagaccgaccacagattcatcgaggagcagctgctgctgggcaacggcgtggcctgcggcagcctggagtacgacccctacagcatctacgagaaggacgtggagggcgacagcgtgcccaagcccctgccccccgccctgagcgtgatcagcagcgccagcaagctgttcggcgtggtgtgcgcccacgtgggcgagacccagagactgctgatcctggagcagctgctggacagcatcaagcacaccaagggcgccagacagcaggtggtgcagctgcacgtggtgagcagcgtgagcagcttcctgaagtacgtggccggcagcaagggctgcctgggccccgaggagatgaagagattcgccctgaccctggtgatgggcgccctggagagccccaaccccctgctgagatgcgccgccgccgagagctgggccagactggcccaggtggtggacgacggcgccttcaccgccggcctggcccaggtgagcttcgacaagctgaagagcgccagagacgtggtgaccagaaccggccacagcctggccctgggcagcctgcacagatacctgggcggcatcagcagcagccagcacctgaacagctgcatcggcatcctgtacaccctggcccaggacagcaccagccccgacgtgcagacctgggccctgcacagcctgagcctgatcatcgacagcgccggccccctgtactacgtgcacgtggagcccaccctgagcctgatcatcatgctgctgctgaacgtgccccccacccacgccgaggtgcaccagagcctgggcagatgcctgaacgccctgatcaccaccctgggccccgagctgcagggcaacagcaccagcatcagcaccctgagaaccagctgcctgctgggctgcgccgtgatgcaggacaaccccgactgcctggtgcaggcccaggccatcagctgcctgcagcagctgcacatgttcgcccccagacacgtgaacctgagcagcctggtgagctgcctgtgcgtgaacctgtgcagcccctacctgctgctgagaagagccgtgctggcctgcctgagacagctggtgcagagagaggccgccgaggtgagcgagcacgccgtgatgctggccaaggacagcagagaggagctgacccccgacgccaacatcagagaggtgggcctggagggcgccctgctgatcctgctggacaaggagaccgacgagagactgtgccacgacatcaaggagaccctgaactacatgctgaccagcatggccgtggagaagctgagcctgtggctgaagctgtgcaaggacgtgctggccgccagcgccgacttcaccgccgtgacctgcgtggacaccatgcaggaggaggagggcgacaagggcgacgacgccagcgtgctgaccaccagaagagacgagaagagccaccccttcaccaaccccagatgggccaccagagtgttcgccgccgagtgcgtgtgcagaatcatcaaccagtgcgagaacgccaacagcgcccacttcgacatcgccctggcccaggagatgaagaagagagacagcagaaacgacttcctggtgctgcacctggccgacctgatcagaatggccttcatggccgccaccgaccacagcgaccagctgagactgagcggcctggagatgctgctggtggtgatcagaagattcgccaccgtgcccgagcccgagttccccggccacgtgatcctggagcagtaccaggccaacgtgggcgccgccctgagacccgccttcaccagcgagaccccccccgacgtgaccgccaaggcctgccaggtgtgcagcgcctggatcgccagcggcgtggtgagcgacctgaacgacctgagaagagtgcaccagctgctggtgagcagcctgaccaagatccaggccggcaaggaggccctgagccacctgtacaacgagagcgccagcaccatggagatcctggccgtgctgaaggcctgggccgaggtgtacatcatcgccgtgcagagacacaagaaccacagacagcccctgaagaccaccacctgcctggaggacggcatcagaaacggcagctgcagcagcgacggcctgctggacctggtgtacgccgacctgggcaccctgagcagactgtggctggccgccctgcaggacttcgccctgctgaccctgcccagcgagttcgccagccagctgcccgccgagggcggcgccttctacaccgccgagaccagcgagaacgccaagctgcactactacaacagctgggccctgatcctgcacgccaccgccctgtggctgaccagcaccggcttcgtggtggccgaccccgacgagggcgccagcaacctgagcagacccgtgacccccaccagcatgtgccagggcagcagcagcggcgccaccatcaagagccccgaggacgtgtacaccgacagattccacctgatcctgggcatcagcgtggagttcctgtgcagcctgagaagcgacgccaccatggagagcatcaccgcctgcctgcacgccctgcaggccctgctggacgtgccctggcccagaagcaagatcggcagcgaccaggacctgggcatcgagctgctgaacgtgctgcacagagtgatcctgaccagagagagccccagcatccagctggccagcctggaggtggtgagacagatcatctgcgccgcccaggagcacgtgaaggagaagagaagaagcgccgaggtggacgacggcgccgccgagaaggagaccctgcccgagttcggcgagggcaaggacaccggcggcctggtgcccggcaagagcctggtgttcgccaccctggagctgtgcgtgtgcatcctggtgagacagctgcccgagctgaaccccaagctgaccggcagccccggcgtgaaggccaccaagccccagatcctgctggaggacggcagcagactggtgagcgccgccctggtgatcctgagcgagctgcccgccgtgtgcagccccgagggcagcatcagcatcctgcccaccatcctgtacctgaccatcggcgtgctgagagagaccgccgtgaagctgcccggcggccagctgagcagcaccgtggccgccagcctgcaggccctgaagggcatcctgagcagccccatggccagagccgagaagagcagaaccgcctggaccgacctgctgagaagcgccctgaccaccatcctggactgctgggaccccgtggacgagacccaccaggagctggacgaggtgagcctgctgaccgccatcaccgtgttcatcctgagcaccagccccgaggtgaccaccatcccctgcctgcagaagagatgcatcgacaagttcaaggccaccctggagatcaaggaccccgtggtgcagatcaagacctaccagctgctgcacagcatcttccagtaccccaaccccgccgtgagctacccctacatctacagcctggccagctgcatcatggagaagctgcaggagatcgacaagagaaagcccgagaacaccgccgagctggagatcttccaggagggcatcaaggtgctggagaccctggtgaccgtggccgaggagcaccacagagcccagctggtggcctgcctgctgcccatcctgatcagcttcctgctggacgagaacagcctgggcagcgccaccagcatcatgagaaacctgcacgacttcgccctgcagaacctgatgcagatcggcccccagtacagcagcgtgttcaagagcctggtggccagcagccccgccctgaaggccagactggaggccgccatcaagggcaaccaggagagcgtgaaggtgaagatccccaccagcaagtacaccaagagccccggcaagaacagcagcatccagctgaagaccagcttcctgtag

SEQ ID NO: 21688 - DNA, 2223 bp, Artificial Sequence
  Description of Artificial Sequence: Synthetic coding sequence
atggccgccttcagcgagatgggcgtgatgcccgagatcgcccaggccgtggaggagatggactggctgctgcccaccgacatccaggccgagagcatccccctgatcctgggcggcggcgacgtgctgatggccgccgagaccggcagcggcaagaccggcgccttcagcatccccgtgatccagatcgtgtacgagaccctgaaggaccagcaggagggcaagaagggcaagaccaccatcaagaccggcgccagcgtgctgaacaagtggcagatgaacccctacgacagaggcagcgccttcgccatcggcagcgacggcctgtgctgccagagcagagaggtgaaggagtggcacggctgcagagccaccaagggcctgatgaagggcaagcactactacgaggtgagctgccacgaccagggcctgtgcagagtgggctggagcaccatgcaggccagcctggacctgggcaccgacaagttcggcttcggcttcggcggcaccggcaagaagagccacaacaagcagttcgacaactacggcgaggagttcaccatgcacgacaccatcggctgctacctggacatcgacaagggccacgtgaagttcagcaagaacggcaaggacctgggcctggccttcgagatccccccccacatgaagaaccaggccctgttccccgcctgcgtgctgaagaacgccgagctgaagttcaacttcggcgaggaggagttcaagttcccccccaaggacggcttcgtggccctgagcaaggcccccgacggctacatcgtgaagagccagcacagcggcaacgcccaggtgacccagaccaagttcctgcccaacgcccccaaggccctgatcgtggagcccagcagagagctggccgagcagaccctgaacaacatcaagcagttcaagaagtacatcgacaaccccaagctgagagagctgctgatcatcggcggcgtggccgccagagaccagctgagcgtgctggagaacggcgtggacatcgtggtgggcacccccggcagactggacgacctggtgagcaccggcaagctgaacctgagccaggtgagattcctggtgctggacgaggccgacggcctgctgagccagggctacagcgacttcatcaacagaatgcacaaccagatcccccaggtgaccagcgacggcaagagactgcaggtgatcgtgtgcagcgccaccctgcacagcttcgacgtgaagaagctgagcgagaagatcatgcacttccccacctgggtggacctgaagggcgaggacagcgtgcccgacaccgtgcaccacgtggtggtgcccgtgaaccccaagaccgacagactgtgggagagactgggcaagagccacatcagaaccgacgacgtgcacgccaaggacaacaccagacccggcgccaacagccccgagatgtggagcgaggccatcaagatcctgaagggcgagtacgccgtgagagccatcaaggagcacaagatggaccaggccatcatcttctgcagaaccaagatcgactgcgacaacctggagcagtacttcatccagcagggcggcggccccgacaagaagggccaccagttcagctgcgtgtgcctgcacggcgacagaaagccccacgagagaaagcagaacctggagagattcaagaagggcgacgtgagattcctgatctgcaccgacgtggccgccagaggcatcgacatccacggcgtgccctacgtgatcaacgtgaccctgcccgacgagaagcagaactacgtgcacagaatcggcagagtgggcagagccgagagaatgggcctggccatcagcctggtggccaccgagaaggagaaggtgtggtaccacgtgtgcagcagcagaggcaagggctgctacaacaccagactgaaggaggacggcggctgcaccatctggtacaacgagatgcagctgctgagcgagatcgaggagcacctgaactgcaccatcagccaggtggagcccgacatcaaggtgcccgtggacgagttcgacggcaaggtgacctacggccagaagagagccgccggcggcggcagctacaagggccacgtggacatcctggcccccaccgtgcaggagctggccgccctggagaaggaggcccagaccagcttcctgcacctgggctacctgcccaaccagctgttcagaaccttctag

SEQ ID NO: 21689 - DNA, 5949 bp, Artificial Sequence
  Description of Artificial Sequence: Synthetic coding sequence
atggagctggcccacagcctgctgctgaacgaggaggccctggcccagatcaccgaggccaagagacccgtgttcatcttcgagtggctgagattcctggacaaggtgctggtggccgccaacaagaccgacgtgaaggagaagcagaagaagctggtggagcagctgaccggcctgatcagcagcagccccggcccccccaccagaaagctgctggccaagaacctggccgccctgtacagcatcggcgacaccttcaccgtgttccagaccctggacaagtgcaacgacatcatcagaaacaaggacgacaccgccgcctacctgcccaccaagctggccgccgtggcctgcgtgggcgccttctacgagaagatgggcagaatgctgggcagcgccttccccgagaccgtgaacaacctgctgaagagcctgaagagcgccgagagccagggcagaagcgagatcctgatgagcctgcagaaggtgctgagcggcctgggcggcgccgccgccagcagccacagagacatctacaagaacgccagaagcctgctgaccgacagaagcatggccgtgagatgcgccgtggccaagtgcctgctggagctgcagaacgaggccgtgttcatgtggaccgccgagctggagaacatcgccaccctgtgcttcaaggccctggagaacagcaactacggcgtgagagtggccgtgagcaagctgctgggcaccgtgatggccaccgccctgatgcccaagcaggccaccgtgatgagacagaacgtgaagagagccaccttcgacgaggtgctggagctgatggccaccggcttcctgagaggcggcagcggcttcctgaagagcggcggcgagatgctgaaggtgggcggcagcgtgaacagagaggtgagagtgggcgtgacccaggcctacgtggtgttcgtgaccaccctgggcggccagtggctggagagaagcttcgccaccttcctgagccacgtgctggacctggtgagccaccccagagccacccagacccacgtggaggccgtgtacagcagaagatgcgtgagcttcatcctgagagccaccgtgggcagcctgctgggcgagaaggcccagatcgccgccgccaaggagatctgccaggccatcggcaagcagatgaaggccgtggaggccgtggtgaacgacaccagcggcgagaacaagagcggcgccgccgacatcgccgccagccagcacgtgatggtgtgcgccctgcaggagctgggcagcctggtgcagagcctgaacgccaccgccagccccctgatccaggaggccagcatcggcctgctggagatcgtgaccagcgtgctgctgcaccccagcatggccgccagactggccgccgcctggtgcctgagatgcgtggccgtggccctgcccttccagctgacccccttcctggacagatgcgccgagagactgaacaacctgaagaccagccccgaggccgtgagcggctacagcttcgccatggccgccctgctgggcggcgtgcaccagtgccccctgggcatcccccacgccaagggcaagatggtggtgagcatcgccgaggacctgctgagaaccgccgcccagaacagcagactgagcctgcagagaacccaggccggctggctgctgctgggcgccctgatgaccctgggccccagcgtggtgagataccacctgcccaagatgctgctgctgtggagaaacgtgttccccagaagcctgaaggagctggaggccgagaaggccagaggcgacagcttcacctggcaggtgaccctggagggcagagccggcgccctgtgcgccatgagaagcttcgtggcccactgccccgagctgctgaccgaggacgtgatcagaaagctgatgacccccatcgagtgcgccatgaccatgatgagccacatccccagcgtgatgaaggcccacggcgcccacctgaaggccagcgccgccatggtgagactgagactgtacgacatcctggccctgctgccccccaagacctacgagggcagcttcaacgccctgctgagagagctggtggccgagttcaccctgaccgacaacagcgccaacaccaccaccagcctgctgagaagcctgtgccactacgacgacagcgtgctgctgggcagctggctgcaggagaccgaccacaagagcatcgaggaccagctgcagcccaacagcgccagcggcagcggcgccctggagcacgaccccagcagcatctacctgagaatccccgccggcgaggccgtgcccggccccctgcccctgggcgtgagcgtgatcgacgccagcgtggccctgttcggcgtggtgttcccccacgtgagctacaagcacagactgcagatgctggaccacttcgccgagtgcgtgaagcaggccaagggcgtgagacagcaggccgtgcagctgaacatcttcaccgccgtgctgagcgccctgaagggcctggccgagaacaagagcaccctgggccccgaggaggtgagaaagagcgccctgaccctggtgatgggccccctggacaaccccaaccccatcctgagatgcgccgccggcgaggccctgggcagaatggcccaggtggtgggcgaggccaccttcatcgccagaatggcccagtacagcttcgacaagctgaagagcgccagagacgtggtgagcagaaccggccacagcctggccctgggctgcctgcacagatacgtgggcggcatcggcagcggccagcacctgaagaccagcgtgagcatcctgctggccctggcccaggacggcaccagccccgaggtgcagacctggagcctgcacagcctggccctgatcgtggacagcagcggccccatgtacagaggctacgtggagcccaccctgagcctggtgctgaccctgctgctgaccgtgccccccagccacaccgaggtgcaccagtgcctgggcagatgcctgggcgccatcatcaccaccgtgggccccgagctgcagggcaacggcgccaccaccagcaccatcagaagcagctgcctggtgggctgcgccatcacccaggaccacagcgacagcctggtgcaggccgccgccatcagctgcctgcagcagctgcacatgttcgcccccagacacgtgaacctgagcagcctggtgcccagcctgtgcgtgcacctgtgcagcagccacctgctgctgagaagagccgccgtggcctgcctgagacagctggcccagagagaggccgccgaggtgtgcgagtacgccatgagcctggccaagaacaccggcgacaaggagagcagcagcgccaacgtgagccccttcgcccccggcgtgagcagcagaaccgacatccactgcagacaccagggcgtgaacatcaccgagaccggcctggagggcctgctgttcggcatgctggacagagagaccgacagaaagctgtgcagcgacatccacgacaccctgggccacatgctgagcagcctggccgtggagaagctgagccactggctgatgctgtgcaaggacgtgctggccgccagcagcgacatgagcaccgccaccctgctgagcagcggcaaggacgaggaggccgagaagaaggacgagatggacgacgacaccatgttcaccaccctgggcgaggaggacaagagcaagcccttcgtggcccccagatgggccaccagagtgttcgccgccgactgcctgtgcagaatcatcaacctgtgcgagaacgccgaccaggcccacttcgacctggccctggccagaagcgccaagctgagaaaccccaccaacgacctgctggtgctgcacctgagcgacctgatcagaatggccttcatggccgccaccgaccacagcaaccagctgagaatggccggcctgcaggccctggaggacatcatcaagaagttcgccagcgtgcccgagcccgagttccccggccacgtgatcctggagcagtaccaggccaacgtgggcgccgccctgagacccgccttcagccaggacacccccagcgacatcatcgccaaggcctgccaggtgtgcagcacctggatcggcagcggcgtggtgagcgacctgaacgacctgagaagagtgcacaacctgctggtgagcagcctggacaaggtgcaggccggcaagggcagcagcagccagctgtacagagagagcgccaccaccatggagaagctggccgtgctgaaggcctgggccgaggtgtacgtggtggccatgaacatcaagaaggaggccgagagcaagcccaagagagccatcaagaacaccgacgacgacgacgacgactgcggcaccatcgacgagctgccccccgacagcctgatcaccctggtgcagcccgagctgcccaccctgagcagactgtggctggccgccctgaaggactacgccctgctgaccctgcccgccgagttcagcagccagctgccccccgacggcggcgccttctacacccccgagaccatcgacaccgccagactgcactacagaaacagctgggcccccatcctgcacgccgtggccctgtggctgaacagcaccggcttcacctgcagcgagagcaccgaggccgccgccatcagcggcctgcagaagagaagcaccagcgtgaacctgaaccaggccagcggcgccgtgggcagcgccaagagcctgcccgagatcaacaaggacagaatgcacctgatcctgggcgtgagcatccagttcctgtgcagccccagacccgaggagcccatcgagcacgtgaccgcctgcctgcaggccctgcacaccctgctggacagcccctacgccagagtgcacatcgccgaggaccagctgatcggcgtggagctgctgagcgtgctgcacagactgctgctgacctggaaccccagcagcgtgcagctgctggtgaccggcgtggtgcagcagatcgtgagagccgcccaggactacctgcaggagaagagaaacaccctgagatgcatgaccatcctgcccaccatcctgttcctgatcgccagaatcctgaaggacaccgccatcaagagcgccgacaaccaggtgcccccccccgtgagcgccgccctgcagggcatcaagagcatcgtgaccctgagcatggccaagaccgaggccggcgtgcagaagcagtggaccgccctgatcagaagcaccctggcctgcatcctggagtacagccagcccgaggacagcgtgcccacccccgacgaggtgagcatgctgaccgccatcgccctgttcctgtggagcgccagcaacgagatcatcggcgtgcagagcctgcagaacggctgcatgaacagattcaagaacgccctgaacagctgcgacccctgggtgcaggccaagtgctaccagctgctgctgagcgtgttccagcacagcaacagagccctgagcaccccctacatccacagcctggcccccatcgtggtggagaagctgaaggccgtggagagaaacagacccgccagcaacatcgagctgctggccgtgcaggagggcatcaaggtgctggagaccctggtggccctgggcgaggagcagaacagagtgcagctgctggccctgctggtgcccaccctgatcagctacctgctggacgagaacagcttcgccagcgccagcagcgccagcaaggacctgcacgagttcgccctgcagaacctgatgcacatcggccccctgtacccccacgccttcaagaccgtgatgggcgccgcccccgagctgaaggtgagactggagaccgccgtgagagccagccaggccagcaaggccaaggccgccgccagacagcccgcccccgccatccacagcgcccccaccatcaagctgaagaccagcttcttctag

SEQ ID NO: 21690 - DNA, 2307 bp, Artificial Sequence
  Description of Artificial Sequence: Synthetic coding sequence
atggagctggcccacagcctgctgctgaacgaggaggccctggcccagatcaccgaggccaagagacccgtgttcatcttcgagtggctgagattcctggacaaggtgctggtggccgccaacaagaccgacgtgaaggagaagcagaagaagctggtggagcagctgaccggcctgatcagcagcagccccggcccccccaccagaaagctgctggccaagaacctggccgccctgtacagcatcggcgacaccttcaccgtgttccagaccctggacaagtgcaacgacatcatcagaaacaaggacgacaccgccgcctacctgcccaccaagctggccgccgtggcctgcgtgggcgccttctacgagaagatgggcagaatgctgggcagcgccttccccgagaccgtgaacaacctgctgaagagcctgaagagcgccgagagccagggcagaagcgagatcctgatgagcctgcagaaggtgctgagcggcctgggcggcgccgccgccagcagccacagagacatctacaagaacgccagaagcctgctgaccgacagaagcatggccgtgagatgcgccgtggccaagtgcctgctggagctgcagaacgaggccgtgttcatgtggaccgccgagctggagaacatcgccaccctgtgcttcaaggccctggagaacagcaactacggcgtgagagtggccgtgagcaagctgctgggcaccgtgatggccaccgccctgatgcccaagcaggccaccgtgatgagacagaacgtgaagagagccaccttcgacgaggtgctggagctgatggccaccggcttcctgagaggcggcagcggcttcctgaagagcggcggcgagatgctgaaggtgggcggcagcgtgaacagagaggtgagagtgggcgtgacccaggcctacgtggtgttcgtgaccaccctgggcggccagtggctggagagaagcttcgccaccttcctgagccacgtgctggacctggtgagccaccccagagccacccagacccacgtggaggccgtgtacagcagaagatgcgtgagcttcatcctgagagccaccgtgggcagcctgctgggcgagaaggcccagatcgccgccgccaaggagatctgccaggccatcggcaagcagatgaaggccgtggaggccgtggtgaacgacaccagcggcgagaacaagagcggcgccgccgacatcgccgccagccagcacgtgatggtgtgcgccctgcaggagctgggcagcctggtgcagagcctgaacgccaccgccagccccctgatccaggaggccagcatcggcctgctggagatcgtgaccagcgtgctgctgcaccccagcatggccgccagactggccgccgcctggtgcctgagatgcgtggccgtggccctgcccttccagctgacccccttcctggacagatgcgccgagagactgaacaacctgaagaccagccccgaggccgtgagcggctacagcttcgccatggccgccctgctgggcggcgtgcaccagtgccccctgggcatcccccacgccaagggcaagatggtggtgagcatcgccgaggacctgctgagaaccgccgcccagaacagcagactgagcctgcagagaacccaggccggctggctgctgctgggcgccctgatgaccctgggccccagcgtggtgagataccacctgcccaagatgctgctgctgtggagaaacgtgttccccagaagcctgaaggagctggaggccgagaaggccagaggcgacagcttcacctggcaggtgaccctggagggcagagccggcgccctgtgcgccatgagaagcttcgtggcccactgccccgagctgctgaccgaggacgtgatcagaaagctgatgacccccatcgagtgcgccatgaccatgatgagccacatccccagcgtgatgaaggcccacggcgcccacctgaaggccagcgccgccatggtgagactgagactgtacgacatcctggccctgctgccccccaagacctacgagggcagcttcaacgccctgctgagagagctggtggccgagttcaccctgaccgacaacagcgccaacaccaccaccagcctgctgagaagcctgtgccactacgacgacagcgtgctgctgggcagctggctgcaggagaccgaccacaagagcatcgaggaccagctgcagcccaacagcgccagcggcagcggcgccctggagcacgaccccagcagcatctacctgctgctgttcctggtgcactag

SEQ ID NO: 21691 - DNA, 3546 bp, Artificial Sequence
  Description of Artificial Sequence: Synthetic coding sequence
atggccgccgtgcaggtggtgggcagctggcccagcgtgcagcccagagaggcccccagagaggccatccccgagagaggcaacggcttcagactgctgagcgccagactgtgcgccctgagacccgacgacagcagcagcgccagaaccgagatccacctgctgttcgaccagctgatcagcgagaactacagcgagggcagcggcgtggcccccgaggacgtgagcgccctgctggtgcaggcctgcagactggtgcccctgaaccagaaccacctggtgagcaaggtgagccagctgatccaccacctgctgaacagactgcaggtgatcgtggacgagcagcacctggacttcctgctggcctacaccatcagcgccatccaccagtgcagcagctggacccacagagagatcctgcaggccctggccgccctggtgtactgcaacggcagcaagtgccagaagtacctgcccgagctgctgggcaacaccggcctgctgatgaagctgagcgacctggcccagagcgaccccgaggtgagaagagccgccgtgcactgcatggccaacctgtgcctgagcgtgcccggccagccctacctggaggagccctaccagaacgtgtgcttccaggccttcctgaccatcctgcagagccccaagagcagcgacatggacgacatcaccttctgcatgctgctgcagaacgccctgaagggcatccagagcctgctgaacggcggcagaatgaagctgacccagaccgacgagctgggcgccctgctggccgtgctgaagaagttcatgttccacggcctgcccggcctgaacatcgagatgcccaccgtgctgtaccccacccccctgccccagtacgacggcagaacccccatcaagccccagcagagcgagagcagcgccagcagacccaccctgaacaagaagaagaagagcaaggtgaagcccaagaagatccagcagggcgaggaggaggagaaggagagcagcggcgagatcgaggccgcccccgtgaccggcaccggcagagtgaacctgcacgagggcaacacctggtgccccagcagcctgggcgtgcagagcctgcccctggacggcagcggcgccgccgagaaggacggcgtgagcagcagcttcagcagcagcagctggaagagagtgagcagcagcgagagcgacttcagcgacgccgagggcggcatgcagagcaagatgagaagctaccaggccaaggtgagacagggcgccctggtgtgcttcctgagcaccatcaagagcatcgagaagaaggtgctgtacggctactggagcgccttcatccccgacacccccgagctgggcagcccccagagcgtgagcctgatgaccctgaccctgaaggaccccagccccaagaccagagcctgcgccctgcaggtgctgagcgccatcctggagggcagcaagcagttcctgagcgtggccgaggacaccagcgaccacagaagagccttcacccccttcagcgtgatgatcgcctgcagcatcagagagctgcacagatgcctgctgctggccctggtggccgagagcagcagccagaccgtgacccagatcatcaagtgcctggccaacctggtgagcaacgccccctacgacagactgaagctgagcctgctgaccaaggtgtggaaccagatcaagccctacatcagacacaaggacgtgaacgtgagagtgagcagcctgaccctgctgggcgccatcgtgagcacccacgcccccctgcccgaggtgcagctgctgctgcagcagccctgcagcagcggcctgggcaacagcaacagcgccaccccccacctgagcccccccgactggtggaagaaggcccccgccggccccagcctggaggagaccagcgtgagcagccccaagggcagcagcgagccctgctggctgatcagactgtgcatcagcatcgtggtgctgcccaaggaggacagctgcagcggcagcgacgccggcagcgccgccggcagcacctacgagcccagccccatgagactggaggccctgcaggtgctgaccctgctggccagaggctacttcagcatgacccaggcctacctgatggagctgggcgaggtgatctgcaagtgcatgggcgaggccgaccccagcatccagctgcacggcgccaagctgctggaggagctgggcaccggcctgatccagcagtacaagcccgacagcaccgccgcccccgaccagagagcccccgtgttcctggtggtgatgttctggaccatgatgctgaacggccccctgcccagagccctgcagaacagcgagcaccccaccctgcaggccagcgcctgcgacgccctgagcagcatcctgcccgaggccttcagcaacctgcccaacgacagacagatgctgtgcatcaccgtgctgctgggcctgaacgacagcaagaacagactggtgaaggccgccaccagcagagccctgggcgtgtacgtgctgttcccctgcctgagacaggacgtgatcttcgtggccgacgccgccaacgccatcctgatgagcctggaggacaagagcctgaacgtgagagccaaggccgcctggagcctgggcaacctgaccgacaccctgatcgtgaacatggagacccccgaccccagcttccaggaggagttcagcggcctgctgctgctgaagatgctgagaagcgccatcgaggccagcaaggacaaggacaaggtgaagagcaacgccgtgagagccctgggcaacctgctgcacttcctgcagcccagccacatcgagaagcccaccttcgccgagatcatcgaggagagcatccaggccctgatcagcaccgtgctgaccgaggccgccatgaaggtgagatggaacgcctgctacgccatgggcaacgtgttcaagaaccccgccctgcccctgggcaccgccccctggaccagccaggcctacaacgccctgaccagcgtggtgaccagctgcaagaacttcaaggtgagaatcagaagcgccgccgccctgagcgtgcccggcaagagagagcagtacggcagcgtggaccagtacgccagaatctggaacgccctggtgaccgccctgcagaagagcgaggacaccatcgacttcctggagttcaagtactgcgtgagcctgagaacccagatctgccaggccctgatccacctgctgagcctggccagcgccagcgacctgccctgcatgaaggagaccctggagctgagcggcaacatggtgcagagctacatcctgcagttcctgaagagcggcgccgagggcgacgacaccggcgccccccacagcccccaggagagagaccagatggtgagaatggccctgaagcacatgggcagcatccaggcccccaccggcgacaccgccagaagagccatcatgggcttcctggaggagatcctggccgtgtgcttcgacagcagcggcagccagggcgccctgcccggcctgaccaaccagtag

SEQ ID NO: 21692 - DNA, 2751 bp, Artificial Sequence
  Description of Artificial Sequence: Synthetic coding sequence
atgagcaagtacctgcccgagctgctgggcaacaccggcctgctgatgaagctgagcgacctggcccagagcgaccccgaggtgagaagagccgccgtgcactgcatggccaacctgtgcctgagcgtgcccggccagccctacctggaggagccctaccagaacgtgtgcttccaggccttcctgaccatcctgcagagccccaagagcagcgacatggacgacatcaccttctgcatgctgctgcagaacgccctgaagggcatccagagcctgctgaacggcggcagaatgaagctgacccagaccgacgagctgggcgccctgctggccgtgctgaagaagttcatgttccacggcctgcccggcctgaacatcgagatgcccaccgtgctgtaccccacccccctgccccagtacgacggcagaacccccatcaagccccagcagagcgagagcagcgccagcagacccaccctgaacaagaagaagaagagcaaggtgaagcccaagaagatccagcagggcgaggaggaggagaaggagagcagcggcgagatcgaggccgcccccgtgaccggcaccggcagagtgaacctgcacgagggcaacacctggtgccccagcagcctgggcgtgcagagcctgcccctggacggcagcggcgccgccgagaaggacggcgtgagcagcagcttcagcagcagcagctggaagagagtgagcagcagcgagagcgacttcagcgacgccgagggcggcatgcagagcaagatgagaagctaccaggccaaggtgagacagggcgccctggtgtgcttcctgagcaccatcaagagcatcgagaagaaggtgctgtacggctactggagcgccttcatccccgacacccccgagctgggcagcccccagagcgtgagcctgatgaccctgaccctgaaggaccccagccccaagaccagagcctgcgccctgcaggtgctgagcgccatcctggagggcagcaagcagttcctgagcgtggccgaggacaccagcgaccacagaagagccttcacccccttcagcgtgatgatcgcctgcagcatcagagagctgcacagatgcctgctgctggccctggtggccgagagcagcagccagaccgtgacccagatcatcaagtgcctggccaacctggtgagcaacgccccctacgacagactgaagctgagcctgctgaccaaggtgtggaaccagatcaagccctacatcagacacaaggacgtgaacgtgagagtgagcagcctgaccctgctgggcgccatcgtgagcacccacgcccccctgcccgaggtgcagctgctgctgcagcagccctgcagcagcggcctgggcaacagcaacagcgccaccccccacctgagcccccccgactggtggaagaaggcccccgccggccccagcctggaggagaccagcgtgagcagccccaagggcagcagcgagccctgctggctgatcagactgtgcatcagcatcgtggtgctgcccaaggaggacagctgcagcggcagcgacgccggcagcgccgccggcagcacctacgagcccagccccatgagactggaggccttcagcaacctgcccaacgacagacagatgctgtgcatcaccgtgctgctgggcctgaacgacagcaagaacagactggtgaaggccgccaccagcagagccctgggcgtgtacgtgctgttcccctgcctgagacaggacgtgatcttcgtggccgacgccgccaacgccatcctgatgagcctggaggacaagagcctgaacgtgagagccaaggccgcctggagcctgggcaacctgaccgacaccctgatcgtgaacatggagacccccgaccccagcttccaggaggagttcagcggcctgctgctgctgaagatgctgagaagcgccatcgaggccagcaaggacaaggacaaggtgaagagcaacgccgtgagagccctgggcaacctgctgcacttcctgcagcccagccacatcgagaagcccaccttcgccgagatcatcgaggagagcatccaggccctgatcagcaccgtgctgaccgaggccgccatgaaggtgagatggaacgcctgctacgccatgggcaacgtgttcaagaaccccgccctgcccctgggcaccgccccctggaccagccaggcctacaacgccctgaccagcgtggtgaccagctgcaagaacttcaaggtgagaatcagaagcgccgccgccctgagcgtgcccggcaagagagagcagtacggcagcgtggaccagtacgccagaatctggaacgccctggtgaccgccctgcagaagagcgaggacaccatcgacttcctggagttcaagtactgcgtgagcctgagaacccagatctgccaggccctgatccacctgctgagcctggccagcgccagcgacctgccctgcatgaaggagaccctggagctgagcggcaacatggtgcagagctacatcctgcagttcctgaagagcggcgccgagggcgacgacaccggcgccccccacagcccccaggagagagaccagatggtgagaatggccctgaagcacatgggcagcatccaggcccccaccggcgacaccgccagaagagccatcatgggcttcctggaggagatcctggccgtgtgcttcgacagcagcggcagccagggcgccctgcccggcctgaccaaccagtag

SEQ ID NO: 21693 - DNA, 4926 bp, Artificial Sequence
  Description of Artificial Sequence: Synthetic coding sequence
atgaccgagagcagcatgaagaagctggccagcaccctgctggacgccatcaccgacaaggaccccctggtgcaggagcaggtgtgcagcgccctgtgcagcctgggcgaggccagacccgtggagaccctgagagcctgcgaggagtacctgagacagcacgacaagctggcccacccctacagagccgccgtgctgagagccatggagagagtgctgagcagcagagccagcgagctggacaaggacaccgccagcaccatcatcctgctggccagcagcgagatgaccaagaccaaggacctggtgtgggactggcagcaggccgccagcggcgtgctggtggccgtgggcagacagttcatcagcaaggtgatggaggagctgctgagaagactgcaccccggcaccctgccccactgcgccgtgctgcacaccctggccagcctgagcgtggccaacgccttcggcgtggtgcccttcctgcccagcgtgctgagcagcctgctgcccgtgctgggcgtggccaagcaggacaccgtgagagtggccttctgcagcgccctgcagagattcagcgagggcgccctggagtacctggccaacctggacagagcccccgaccccaccgtgagaaaggacgccttcgccaccgacatcttcagcgcctacgacgtgctgttccaccagtggctgcagagcagagaggccaagctgagactggccgtggtggaggccctgggccccatgagccacctgctgcccagcgagagactggaggagcagctgcccaagctgctgcccggcatcctggccctgtacaagaagcacgccgagaccttctacctgagcaagagcctgggccagatcctggaggccgccgtgagcgtgggcagcagaaccctggagacccagctggacgccctgctggccgccctgcacagccagatctgcgtgcccgtggagagcagcagccccctggtgatgagcaaccagaaggaggtgctgagatgcttcaccgtgctggcctgcagcagccccgacagactgctggccttcctgctgcccagactggacaccagcaacgagagaaccagagtgggcaccctgcaggtggtgagacacgtgatcaacagcgccgccgcccagatggaggacaagaagcccttcatcctgagcagcatgagactgcccctgctggacaccaacagcaaggtgaagagagccgtggtgcaggtgatcagcgccatggcccaccacggctacctggagcagcccggcggcgaggccatgatcgagtacatcgtgcagcagtgcgccctgccccccgagcaggagcccgagaagcccggccccggcagcaaggaccccaaggccgacagcgtgagagccatcagcgtgagaaccctgtacctggtgagcaccaccgtggacagaatgagccacgtgctgtggccctacctgctgcagttcctgacccccgtgagattcaccggcgccctgacccccctgtgcagaagcctggtgcacctggcccagaagagacaggaggccggcgccgacgccttcctgatccagtacgacgcccacgccagcctgcccagcccctacgccgtgaccggcagactgctggtggtgagcagcagcccctacctgggcgacggcagaggcgccgccgccctgagactgctgagcgtgctgcaccccaacatccaccccctgctgggccagcactgggagaccaccgtgcccctgctgctgggctacctggacgagcacaccgaggagaccctgccccaggaggagtgggaggagaagctgctgatgttcctgagagacaccctggccatcatcagcgacaacgcctggatctgccagctgagcctggagctgtgcagacagctgccctgctacgacgaggccccccaggagaagaacttcctgtacaagtgcatcggcaccaccctgggcgccgccagcagcaaggaggtggtgagaaagcacctgcaggagctgctggagaccgccagataccaggaggaggccgagagagagggcctggcctgctgcttcggcatctgcgccatcagccacctggaggacaccctggcccagctggaggacttcgtgagaagcgaggtgttcagaaagagcatcggcatcctgaacatcttcaaggacagaagcgagaacgaggtggagaaggtgaagagcgccctgatcctgtgctacggccacgtggccgccagagcccccagagagctggtgctggccaaggtggagagcgacatcctgagaaacatctgccagcacttcagcaccaaggtgctgggcatcaaggtggagaccaaggaccccgccctgaagctgtgcctggtgcagagcgtgtgcatggtgagcagagccatctgcagcagcacccaggccggcagcttccacttcaccagaaaggccgagctggtggcccagatgatggagttcatcagagccgagccccccgacagcctgagaacccccatcagaaagaaggccatgctgacctgcacctacctggtgagcgtggagcccgccctggacgagcaggccagagccgacgtgatccacggctgcctgcacagcatcatggccctgctgcccgagcccaaggaggaggacggcggctgccagaagagcctgtacctggagaccctgcacgccctggaggacctgctgaccagcctgctgcagagaaacatgaccccccagggcctgcagatcatgatcgagcacctgagcccctggatcaagagccccagaggccacgagagagccagagccctgggcctgagcgccctgctgctgagatacttcctggagcacctgagagtgagcgccctggtgcccttccacaacctgggcctgctgatcggcctgttcagccccagatgcgccgacctgtggcccgccaccagacaggaggccgtggactgcgtgtacagcctgctgtacctgcagctgggctacgagggcttcagcagagactacagagacgacgtggccgagagactgctgagcctgaaggacggcctggtgcaccccgaccccgccatcctgttccacacctgccacagcgtgggccagatcatcgccaagagactgccccccgaccagctgatcagcctgctgctgaccatgttcgaggccctgggcgaccccgagaagaactgcagcagagccgccaccgtgatgatcaactgcctgctgcaggagagaggcggcgtgctgcaggagaaggtgcccgagatcgtgagcgtgctgagaagcaagctgcaggaggcccagggcgagcacgtgctgcccgccgcccagcacagcgtgtacctgctggccacccagcactgcgccgccgtggtgagcagcctgctgggcagccccctgcccctggacagccacacctgcatgctgtggagagccctggccgtggagcccagactggccgcccaggtgctgggcctgctgctggagaagatgagcagagacgtgcccttcaaggagagcagagccttcctgctgggcagaacccccgacagagtggccaccctgctgcccctgagcgccacctgcgccctgttcgaggtgatgagcacccccgccgccggccccgccgtgctggagctgtacccccagctgttcgtggtgctgctgctgagagtgagctgcaccgtgggcgtgcagctgcccagaaacctgcaggcccaggagagaagaggcgccagccccgccctggccaccagaaacctggagccctgcagcagcgccgtggacaccctgagaagcatgctgctgagaagcggcagcgaggacgtggtgcagagaatggacctggagggcggctgggagctgctgagaaccagcgccggccacgaggagggcgccaccagactggccagagccatggccgagcacgccggccccagactgcccctggtgctgaagaccctggcctgcacccacagcagcgcctacgagaaccagagagtgaccaccaccgccttcctggccgagctgctgaacagcaacgtggccaacgacctgatgctgctggacagcctgctggagagcctggccgccagacagaaggacacctgcgccagcgtgagaagactggtgctgagaggcctggccaacctggccagcggctgccccgacaaggtgagaacccacggcccccagctgctgaccgccatgatcggcggcctggacgacggcgacaacccccacagccccgtggccctggaggccatgctgggcctggccagactggtgcacctggtggagagctgggacctgagaagcggcctgctgcacgtggccatcagaatcagacccttcttcgacagcgagaagatggagttcagaaccgccagcatcagactgttcggccacctgaacaaggtgtgccacggcgactgcgaggacgtgttcctggaccaggtggtgggcggcctggcccccctgctgctgcacctgcaggacccccaggccaccgtggccagcgcctgcagattcgccctgagaatgtgcggccccaacctggcctgcgaggagctgagcgccgccttccagaagcacctgcaggagggcagagccctgcacttcggcgagttcctgaacaccacctgcaagcacctgatgcaccacttccccgacctgctgggcagactgctgaccacctgcctgttctacttcaagagcagctgggagaacgtgagagccgccgcccccctgttcaccggcttcctggtgctgcacagcgagcccagacagcagccccaggtggacctggaccagctgatcgccgccctgcagatcctgctgaaggaccccgcccccgaggtgagaaccagagccgccgaggccctgggcagactggtgaagctggcctag

SEQ ID NO: 21694 - DNA, 1023 bp, Artificial Sequence
  Description of Artificial Sequence: Synthetic coding sequence
atggagagagtgctgagcagcagagccagcgagctggacaaggacaccgccagcaccatcatcctgctggccagcagcgagatgaccaagaccaaggacctggtgtgggactggcagcaggccgccagcggcgtgctggtggccgtgggcagacagttcatcagcaaggtgatggaggagctgctgagaagactgcaccccggcaccctgccccactgcgccgtgctgcacaccctggccagcctgagcgtggccaacgccttcggcgtggtgcccttcctgcccagcgtgctgagcagcctgctgcccgtgctgggcgtggccaagcaggacaccgtgagagtggccttctgcagcgccctgcagagattcagcgagggcgccctggagtacctggccaacctggacagagcccccgaccccaccgtgagaaaggacgccttcgccaccgacatcttcagcgcctacgacgtgctgttccaccagtggctgcagagcagagaggccaagctgagactggccgtggtggaggccctgggccccatgagccacctgctgcccagcgagagactggaggagcagctgcccaagctgctgcccggcatcctggccctgtacaagaagcacgccgagaccttctacctgagcaagagcctgggccagatcctggaggccgccgtgagcgtgggcagcagaaccctggagacccagctggacgccctgctggccgccctgcacagccagatctgcgtgcccgtggagagcagcagccccctggtgatgagcaaccagaaggaggtgctgagatgcttcaccgtgctggcctgcagcagccccgacagactgctggccttcctgctgcccagactggacaccagcaacgagagaaccagagtgggcaccctgcaggtggtgagacacgtgatcaacagcgccggcgagtgcctgcacgccagcctggccgccacccccggccacgtgcaggacggcgccggccccggcagactgtgccccagcaagtag

SEQ ID NO: 21695 - DNA, 4926 bp, Artificial Sequence; identical to SEQ ID NO: 21693
  Description of Artificial Sequence: Synthetic coding sequence

SEQ ID NO: 21696 - DNA, 1653 bp, Artificial Sequence
  Description of Artificial Sequence: Synthetic coding sequence
atgatcaactgcctgctgcaggagagaggcggcgtgctgcaggagaaggtgcccgagatcgtgagcgtgctgagaagcaagctgcaggaggcccagggcgagcacgtgctgcccgccgcccagcacagcgtgtacctgctggccacccagcactgcgccgccgtggtgagcagcctgctgggcagccccctgcccctggacagccacacctgcatgctgtggagagccctggccgtggagcccagactggccgcccaggtgctgggcctgctgctggagaagatgagcagagacgtgcccttcaaggagagcagagccttcctgctgggcagaacccccgacagagtggccaccctgctgcccctgagcgccacctgcgccctgttcgaggtgatgagcacccccgccgccggccccgccgtgctggagctgtacccccagctgttcgtggtgctgctgctgagagtgagctgcaccgtgggcgtgcagctgcccagaaacctgcaggcccaggagagaagaggcgccagccccgccctggccaccagaaacctggagccctgcagcagcgccgtggacaccctgagaagcatgctgctgagaagcggcagcgaggacgtggtgcagagaatggacctggagggcggctgggagctgctgagaaccagcgccggccacgaggagggcgccaccagactggccagagccatggccgagcacgccggccccagactgcccctggtgctgaagaccctggcctgcacccacagcagcgcctacgagaaccagagagtgaccaccaccgccttcctggccgagctgctgaacagcaacgtggccaacgacctgatgctgctggacagcctgctggagagcctggccgccagacagaaggacacctgcgccagcgtgagaagactggtgctgagaggcctggccaacctggccagcggctgccccgacaaggtgagaacccacggcccccagctgctgaccgccatgatcggcggcctggacgacggcgacaacccccacagccccgtggccctggaggccatgctgggcctggccagactggtgcacctggtggagagctgggacctgagaagcggcctgctgcacgtggccatcagaatcagacccttcttcgacagcgagaagatggagttcagaaccgccagcatcagactgttcggccacctgaacaaggtgtgccacggcgactgcgaggacgtgttcctggaccaggtggtgggcggcctggcccccctgctgctgcacctgcaggacccccaggccaccgtggccagcgcctgcagattcgccctgagaatgtgcggccccaacctggcctgcgaggagctgagcgccgccttccagaagcacctgcaggagggcagagccctgcacttcggcgagttcctgaacaccacctgcaagcacctgatgcaccacttccccgacctgctgggcagactgctgaccacctgcctgttctacttcaagagcagctgggagaacgtgagagccgccgcccccctgttcaccggcttcctggtgctgcacagcgagcccagacagcagccccaggtggacctggaccagctgatcgccgcccccctgctgtacccccagagaagcagaagctgctag

SEQ ID NO: 21697 - DNA, 1269 bp, Artificial Sequence
  Description of Artificial Sequence: Synthetic coding sequence
atgaccgagagcagcatgaagaagctggccagcaccctgctggacgccatcaccgacaaggaccccctggtgcaggagcaggtgtgcagcgccctgtgcagcctgggcgaggccagacccgtggagaccctgagagcctgcgaggagtacctgagacagcacgacaagctggcccacccctacagagccgccgtgctgagagccatggagagagtgctgagcagcagagccagcgagctggacaaggacaccgccagcaccatcatcctgctggccagcagcgagatgaccaagaccaaggacctggtgtgggactggcagcaggccgccagcggcgtgctggtggccgtgggcagacagttcatcagcaaggtgatggaggagctgctgagaagactgcaccccggcaccctgccccactgcgccgtgctgcacaccctggccagcctgagcgtggccaacgccttcggcgtggtgcccttcctgcccagcgtgctgagcagcctgctgcccgtgctgggcgtggccaagcaggacaccgtgagagtggccttctgcagcgccctgcagagattcagcgagggcgccctggagtacctggccaacctggacagagcccccgaccccaccgtgagaaaggacgccttcgccaccgacatcttcagcgcctacgacgtgctgttccaccagtggctgcagagcagagaggccaagctgagactggccgtggtggaggccctgggccccatgagccacctgctgcccagcgagagactggaggagcagctgcccaagctgctgcccggcatcctggccctgtacaagaagcacgccgagaccttctacctgagcaagagcctgggccagatcctggaggccgccgtgagcgtgggcagcagaaccctggagacccagctggacgccctgctggccgccctgcacagccagatctgcgtgcccgtggagagcagcagccccctggtgatgagcaaccagaaggaggtgctgagatgcttcaccgtgctggcctgcagcagccccgacagactgctggccttcctgctgcccagactggacaccagcaacgagagaaccagagtgggcaccctgcaggtggtgagacacgtgatcaacagcgccggcagcaccaacaccagaatcaccctgatgctgcccagcgccgtgaccagactgaagcacgaggactgccccgccagagccgccccccagcccgccgacctgaccgccgcccccgccagcgtggcctag

SEQ ID NO: 21698 - DNA, 4926 bp, Artificial Sequence; identical to SEQ ID NO: 21693
  Description of Artificial Sequence: Synthetic coding sequence

SEQ ID NO: 21699 - DNA, 1848 bp, Artificial Sequence
  Description of Artificial Sequence: Synthetic coding sequence
atgagaatcatcgccaagagactgccccccgaccagctgatcagcctgctgctgaccatgttcgaggccctgggcgaccccgagaagaactgcagcagagccgccaccgtgatgatcaactgcctgctgcaggagagaggcggcgtgctgcaggagaaggtgcccgagatcgtgagcgtgctgagaagcaagctgcaggaggcccagggcgagcacgtgctgcccgccgcccagcacagcgtgtacctgctggccacccagcactgcgccgccgtggtgagcagcctgctgggcagccccctgcccctggacagccacacctgcatgctgtggagagccctggccgtggagcccagactggccgcccaggtgctgggcctgctgctggagaagatgagcagagacgtgcccttcaaggagagcagagccttcctgctgggcagaacccccgacagagtggccaccctgctgcccctgagcgccacctgcgccctgttcgaggtgatgagcacccccgccgccggccccgccgtgctggagctgtacccccagctgttcgtggtgctgctgctgagagtgagctgcaccgtgggcgtgcagctgcccagaaacctgcaggcccaggagagaagaggcgccagccccgccctggccaccagaaacctggagccctgcagcagcgccgtggacaccctgagaagcatgctgctgagaagcggcagcgaggacgtggtgcagagaatggacctggagggcggctgggagctgctgagaaccagcgccggccacgaggagggcgccaccagactggccagagccatggccgagcacgccggccccagactgcccctggtgctgaagaccctggcctgcacccacagcagcgcctacgagaaccagagagtgaccaccaccgccttcctggccgagctgctgaacagcaacgtggccaacgacctgatgctgctggacagcctgctggagagcctggccgccagacagaaggacacctgcgccagcgtgagaagactggtgctgagaggcctggccaacctggccagcggctgccccgacaaggtgagaacccacggcccccagctgctgaccgccatgatcggcggcctggacgacggcgacaacccccacagccccgtggccctggaggccatgctgggcctggccagactggtgcacctggtggagagctgggacctgagaagcggcctgctgcacgtggccatcagaatcagacccttcttcgacagcgagaagatggagttcagaaccgccagcatcagactgttcggccacctgaacaaggtgtgccacggcgactgcgaggacgtgttcctggaccaggtggtgggcggcctggcccccctgctgctgcacctgcaggacccccaggccaccgtggccagcgcctgcagattcgccctgagaatgtgcggccccaacctggcctgcgaggagctgagcgccgccttccagaagcacctgcaggagggcagagccctgcacttcggcgagttcctgaacaccacctgcaagcacctgatgcaccacttccccgacctgctgggcagactgctgaccacctgcctgttctacttcaagagcagctgggagaacgtgagagccgccgcccccctgttcaccggcaagcaccaccccctgccccacccccacgccgccagacagcccagactgatgccccccctgcacagagtgcccggcgccgccctgggcgcccaggccgccgccgccggcggccccggccccgcccactgcggcgcccccgaccccgccgagggccccggccccagaggcgccgacgagggctgctag

SEQ ID NO: 21700 - DNA, 4926 bp, Artificial Sequence; identical to SEQ ID NO: 21693
  Description of Artificial Sequence: Synthetic coding sequence

SEQ ID NO: 21701 - DNA, 3873 bp, Artificial Sequence
  Description of Artificial Sequence: Synthetic coding sequence
atgaaggccagcagctgcttcctgatcctggcccacagcaaccccggcgagctgatggagttcttcgacgagcaggtgagaagcaacaacgaggccatcagagtgggcatcctgaccctgctgagactggccgtgaacgccgacgagcccagactgagagaccacatcatcagcatcgagagaaccgtgaagatcgtgatgggcgacctgagcaccaaggtgagaaacagcgtgctgctgctgatccagaccatgtgcgagaagagctacatcgaggccagagagggctggcccctgatcgactacgtgttcagccagttcgccaccctgaacagaaacctggagaagcccgtgaagaccaacttccacgagaacgagaaggaggaggagagcgtgagagagaccagcctggaggtgctgaagaccctggaccccctggtgatcggcatgccccaggtgctgtggcccagaatcctgaccttcgtggtgcccgccgagtacaccgaggccctggagcccctgttcagcatcatcagaatcctgatcatggccgaggagaagaagcagcacagcgccaaggagagcaccgccctggtggtgagcaccggcgccgtgaagctgcccagcccccagcagctgctggccagactgctggtgatcagcatgcccgccagcctgggcgagctgagaggcgccggcgccatcggcctgctgaagatcctgcccgagatcatccaccccaagctggtggacctgtggaagaccagactgcccgagctgctgcagcccctggagggcaagaacatcagcaccgtgctgtgggagaccatgctgctgcagcagctgctgaaggagagcctgtggaagatcagcgacgtggcctggaccatccagctgacccaggacttcaagcagcagatgggcagctacagcaacaacagcaccgagaagaagttcctgtggaaggccctgggcaccaccctggcctgctgccaggacagcgacttcgtgaacagccagatcaaggagttcctgaccgcccccaaccagctgggcgaccagagacagggcatcaccagcatcctgggctactgcgccgagaaccacctggacatcgtgctgaaggtgctgaagaccttccagaaccaggagaagttcttcatgaacagatgcaagagcctgttcagcggcaagaagagcctgaccaagaccgacgtgatggtgatctacggcgccgtggccctgcacgcccccaagaagcagctgctgagcagactgaaccaggacatcatcagccaggtgctgagcctgcacggccagtgcagccaggtgctgggcatgagcgtgatgaacaaggacatggacctgcagatgagcttcaccagaagcatcaccgagatcggcatcgccgtgcaggacgccgaggaccagggcttccagttcagctacaaggagatgctgatcggctacatgctggacttcatcagagacgagcccctggacagcctggccagccccatcagatggaaggccctgatcgccatcagatacctgagcaagctgaagccccagctgagcctgcaggaccacctgaacatcctggaggagaacatcagaagactgctgcccctgccccccctggagaacctgaagagcgagggccagaccgacaaggacaaggagcacatccagttcctgtacgagagaagcatggacgccctgggcaagctgctgaagaccatgatgtgggacaacgtgaacgccgaggactgccaggagatgttcaacctgctgcagatgtggctggtgagccagaaggagtgggagagagagagagccttccagatcaccgccaaggtgctgaccaacgacatcgaggcccccgagaacttcaagatcggcagcctgctgggcctgctggccccccacagctgcgacaccctgcccaccatcagacaggccgccgccagcagcaccatcggcctgttctacatcaagggcatccacctggaggtggagagactgcagggcctgcaggagggcctggagagcgacgacgtgcaggtgcagatcaagatcagcagcaagatcgccaagatcgtgagcaagttcatccccaacgaggagatcctgatgttcctggaggagatgctggacggcctggagagcctgaaccccacctgcaccaaggcctgcggcatctggatgatcaccgtgctgaagcagcagggcgccgccctggaggaccagctgctggagatcctgggcaccatctaccaccacatgcccgtgctgagacagaaggaggagagcttccagttcatcctggaggccatcagccagatcgccagcttccacatggacaccgtggtggtgaacctgctgcagaagcccctgcccttcgacagagacaccaagaccctgtggaaggccctggccgagaagcccgccagcagcggcaagctgctgcaggccctgatcgacaagctggagaccgagctggaggacgacatcgccagagtggaggccatcagcgtggcctgcgccatgtacgaggtgatcagcatgggcaccagcgtgaccggcctgtaccccgagctgttcaccctgctgctgaagctggtgagctgcaccctgggccagaagatgctgacctgcccctggagccacagaagacacgtgatgcagcagggcgagcagcagcagatccccgacccctgcagactgagcaccgccaccctgaagtgcctgcaggcccaggccatgagagagggcctggccaaggagagcgacgagggcgacaacctgtggaccctgctgagcagccccagcacccaccacatcggcgtgtgcagcctggccagaagcatggccgtgtggcagcacggcgtgatcctggacatcatggagcagctgctgagcagcctgaccagcagcagcgagaactacagaatcaccggcgccgccttcttcagcgagctgatgaaggagcccatcctgtggaagcacggcaacctgagaaacgtgctgatcctgatggaccagagcgcctgggacagcaacgccaccctgagacagatggccatcagaggcctgggcaacaccgccagcggcgccccccacaaggtgaagaagcacaagcagctgatgctggagagcatcatcagaggcctgtaccacctggccagaaccgaggtggtgtgcgagagcctgaaggccctgaagaagatcctggagctgctgaccgacagagacgtgagcttctacttcaaggagatcgtgctgcagaccagaaccttcttcgaggacgagcaggacgacgtgagactgaccgccatcttcctgttcgaggacctggcccccctgaccggcagaagatggaagatcttcttcgccgaggagatcaagaagagcctgatcagcttcctgctgcacctgtgggaccccaaccccaagatcggcgtggcctgcagagacgtgctgatggtgtgcatccccttcctgggcctgcaggagctgtacggcgtgctggacagactgctggaccaggacctgcccagagccagagacttctacagacagttctgcgtgaagctggccaagaagaaccaggagatcctgtggatcctgcacacccacagcttcaccttcttcaccagcacctgggaggtgatcagaagcgccgccgtgaagctgaccgacgccgtggtgctgaacctgaccagccagtacgtggagctgctggacagagagcagctgaccaccagactgcaggccctgagacaggacccctgcatcagcgtgcagagagccgccgaggccgccctgcagaccctgctgagaagatgcaaggagaccagcatccccctgtag

SEQ ID NO: 21702 - DNA, 4758 bp, Artificial Sequence
  Description of Artificial Sequence: Synthetic coding sequence
atgaccctgagcaccgaggagagcatcgagatgttcggcgacatcaacctgaccctgggcatgctgaacaaggaggacatcgtgaacaaggaggacatctacagccacctgaccagcgtgatccagaacaccgacatcctggacgacgccatcgtgcagagactgatctactacgccagcaaggacatgagagacaacaacatgctgagagagatcagaatgctggccggcgaggtgctggtgagcctggccgcccacgacttcaacagcgtgatgtacgaggtgcagagcaacttcagaatcctggagctgcccgacgagttcgtggtgctggccctggccgagctggccaccagctacgtgagccagagcatccccttcatgatgatgaccctgctgaccatgcagaccatgctgagactggccgaggacgagagaatgaagggcaccttctgcatcgccctggagaagttcagcaaggccatctacaagtacgtgaaccactggagagacttcccctaccccagactggacgccaacagactgagcgacaagatcttcatgctgttctggtacatcatggagaagtgggcccccctggccagccccatgcagaccctgagcatcgtgaaggcccacggccccaccgtgagcctgctgctgcacagagaggacttcagaggctacgccctgggccaggtgccctggctgctgaaccagtacaaggacaaggagatcgacttccacgtgacccagagcctgaagcagatcctgaccgccgccgtgctgtacgacatcggcctgcccagaagcctgagaagaagcatcttcatcaacctgctgcagcagatctgcagagcccccgagccccccgtgaaggagaacgagatgaaggccagcagctgcttcctgatcctggcccacagcaaccccggcgagctgatggagttcttcgacgagcaggtgagaagcaacaacgaggccatcagagtgggcatcctgaccctgctgagactggccgtgaacgccgacgagcccagactgagagaccacatcatcagcatcgagagaaccgtgaagatcgtgatgggcgacctgagcaccaaggtgagaaacagcgtgctgctgctgatccagaccatgtgcgagaagagctacatcgaggccagagagggctggcccctgatcgactacgtgttcagccagttcgccaccctgaacagaaacctggagaagcccgtgaagaccaacttccacgagaacgagaaggaggaggagagcgtgagagagaccagcctggaggtgctgaagaccctggaccccctggtgatcggcatgccccaggtgctgtggcccagaatcctgaccttcgtggtgcccgccgagtacaccgaggccctggagcccctgttcagcatcatcagaatcctgatcatggccgaggagaagaagcagcacagcgccaaggagagcaccgccctggtggtgagcaccggcgccgtgaagctgcccagcccccagcagctgctggccagactgctggtgatcagcatgcccgccagcctgggcgagctgagaggcgccggcgccatcggcctgctgaagatcctgcccgagatcatccaccccaagctggtggacctgtggaagaccagactgcccgagctgctgcagcccctggagggcaagaacatcagcaccgtgctgtgggagaccatgctgctgcagctgctgaaggagagcctgtggaagatcagcgacgtggcctggaccatccagctgacccaggacttcaagcagcagatgggcagctacagcaacaacagcaccgagaagaagttcctgtggaaggccctgggcaccaccctggcctgctgccaggacagcgacttcgtgaacagccagatcaaggagttcctgaccgcccccaaccagctgggcgaccagagacagggcatcaccagcatcctgggctactgcgccgagaaccacctggacatcgtgctgaaggtgctgaagaccttccagaaccaggagaagttcttcatgaacagatgcaagagcctgttcagcggcaagaagagcctgaccaagaccgacgtgatggtgatctacggcgccgtggccctgcacgcccccaagaagcagctgctgagcagactgaaccaggacatcatcagccaggtgctgagcctgcacggccagtgcagccaggtgctgggcatgagcgtgatgaacaaggacatggacctgcagatgagcttcaccagaagcatcaccgagatcggcatcgccgtgcaggacgccgaggaccagggcttccagttcagctacaaggagatgctgatcggctacatgctggacttcatcagagacgagcccctggacagcctggccagccccatcagatggaaggccctgatcgccatcagatacctgagcaagctgaagccccagctgagcctgcaggaccacctgaacatcctggaggagaacatcagaagactgctgcccctgccccccctggagaacctgaagagcgagggccagaccgacaaggacaaggagcacatccagttcctgtacgagagaagcatggacgccctgggcaagctgctgaagaccatgatgtgggacaacgtgaacgccgaggactgccaggagatgttcaacctgctgcagatgtggctggtgagccagaaggagtgggagagagagagagccttccagatcaccgccaaggtgctgaccaacgacatcgaggcccccgagaacttcaagatcggcagcctgctgggcctgctggccccccacagctgcgacaccctgcccaccatcagacaggccgccgccagcagcaccatcggcctgttctacatcaagggcatccacctggaggtggagagactgcagggcctgcaggagggcctggagagcgacgacgtgcaggtgcagatcaagatcagcagcaagatcgccaagatcgtgagcaagttcatccccaacgaggagatcctgatgttcctggaggagatgctggacggcctggagagcctgaaccccacctgcaccaaggcctgcggcatctggatgatcaccgtgctgaagcagcagggcgccgccctggaggaccagctgctggagatcctgggcaccatctaccaccacatgcccgtgctgagacagaaggaggagagcttccagttcatcctggaggccatcagccagatcgccagcttccacatggacaccgtggtggtgaacctgctgcagaagcccctgcccttcgacagagacaccaagaccctgtggaaggccctggccgagaagcccgccagcagcggcaagctgctgcaggccctgatcgacaagctggagaccgagctggaggacgacatcgccagagtggaggccatcagcgtggcctgcgccatgtacgaggtgatcagcatgggcaccagcgtgaccggcctgtaccccgagctgttcaccctgctgctgaagctggtgagctgcaccctgggccagaagatgctgacctgcccctggagccacagaagacacgtgatgcagcagggcgagcagcagcagatccccgacccctgcagactgagcaccgccaccctgaagtgcctgcaggcccaggccatgagagagggcctggccaaggagagcgacgagggcgacaacctgtggaccctgctgagcagccccagcacccaccacatcggcgtgtgcagcctggccagaagcatggccgtgtggcagcacggcgtgatcctggacatcatggagcagctgctgagcagcctgaccagcagcagcgagaactacagaatcaccggcgccgccttcttcagcgagctgatgaaggagcccatcctgtggaagcacggcaacctgagaaacgtgctgatcctgatggaccagagcgcctgggacagcaacgccaccctgagacagatggccatcagaggcctgggcaacaccgccagcggcgccccccacaaggtgaagaagcacaagcagctgatgctggagagcatcatcagaggcctgtaccacctggccagaaccgaggtggtgtgcgagagcctgaaggccctgaagaagatcctggagctgctgaccgacagagacgtgagcttctacttcaaggagatcgtgctgcagaccagaaccttcttcgaggacgagcaggacgacgtgagactgaccgccatcttcctgttcgaggacctggcccccctgaccggcagaagatggaagatcttcttcgccgaggagatcaagaagagcctgatcagcttcctgctgcacctgtgggaccccaaccccaagatcggcgtggcctgcagagacgtgctgatggtgtgcatccccttcctgggcctgcaggagctgtacggcgtgctggacagactgctggaccaggacctgcccagagccagagacttctacagacagttctgcgtgaagctggccaagaagaaccaggagatcctgtggatcctgcacacccacagcttcaccttcttcaccagcacctgggaggtgatcagaagcgccgccgtgaagctgaccgacgccgtggtgctgaacctgaccagccagtacgtggagctgctggacagagagcagctgaccaccagactgcaggccctgagacaggacccctgcatcagcgtgcagagagccgccgaggccgccctgcagaccctgctgagaagatgcaaggagaccagcatccccctgtag

SEQ ID NO: 21703 - DNA, 225 bp, Artificial Sequence
  Description of Artificial Sequence: Synthetic coding sequence
atggacgtgagaggccccgaggcccccggcggcagagccctgagagacgccgccgagaacctgttccaggagctgcaggagcacttccaggccctgaccgccaccctgaacctgagaatggaggagatgggcaacagaatcgaggacctgcagaagaacgtgaaggacctgatggtgcaggccggcatcgagaacagcatcaaggagcagatgctgaagacctag

SEQ ID NO: 21704 - DNA, 549 bp, Artificial Sequence
  Description of Artificial Sequence: Synthetic coding sequence
atgagcggcagaagcgtgccccacgcccaccccgccaccgccgagtacgagttcgccaaccccagcagactgggcgagcagagattcggcgagggcctgctgcccgaggagatcctgacccccaccctgtaccacggctactacgtgagacccagagccgcccccgccggcgagggcagcagagccggcgccagcgagctgagactgagcgagggcaagttccaggccttcctggacgtgagccacttcacccccgacgaggtgaccgtgagaaccgtggacaacctgctggaggtgagcgccagacacccccagagactggacagacacggcttcgtgagcagagagttctgcagaacctacgtgctgcccgccgacgtggacccctggagagtgagagccgccctgagccacgacggcatcctgaacctggaggcccccagaggcggcagacacctggacaccgaggtgaacgaggtgtacatcagcctgctgcccgccccccccgaccccgaggaggaggaggaggccgccatcgtggagccctag

SEQ ID NO: 21705 - DNA, 435 bp, Artificial Sequence
  Description of Artificial Sequence: Synthetic coding sequence
atgagaaagatcgacctgtgcctgagcagcgagggcagcgaggtgatcctggccaccagcagcgacgagaagcacccccccgagaacatcatcgacggcaaccccgagaccttctggaccaccaccggcatgttcccccaggagttcatcatctgcttccacaagcacgtgagaatcgagagactggtgatccagagctacttcgtgcagaccctgaagatcgagaagagcaccagcaaggagcccgtggacttcgagcagtggatcgagaaggacctggtgcacaccgagggccagctgcagaacgaggagatcgtggcccacgacggcagcgccacctacctgagattcatcatcgtgagcgccttcgaccacttcgccagcgtgcacagcgtgagcgccgagggcaccgtggtgagcaacctgagcagctag

SEQ ID NO: 21706 - DNA, 225 bp, Artificial Sequence
  Description of Artificial Sequence: Synthetic coding sequence
atgagaaagatcgacctgtgcctgagcagcgagggcagcgaggtgatcctggccaccagcagcgacgagaagcacccccccgagaacatcatcgacggcaaccccgagaccttctggaccaccaccggcatgttcccccaggagttcatcatctgcttccacaagcacgtgagaatcgagagactggtgatccagagctacttcggcaagcagatcctgcactag

SEQ ID NO: 21707 - DNA, 339 bp, Artificial Sequence
  Description of Artificial Sequence: Synthetic coding sequence
atgagaaagatcgacctgtgcctgagcagcgagggcagcgaggtgatcctggccaccagcagcgacgagaagcacccccccgagaacatcatcgacggcaaccccgagaccttctggaccaccaccggcatgttcccccaggagttcatcatctgcttccacaagcacgtgagaatcgagagactggtgatccagagctacttcgtgcagaccctgaagatcgagaagagcaccagcaaggagcccgtggacttcgagcagtggatcgagaaggacctggtgcacaccgagggccagctgcagaacgaggagatcgtggtgagcgagtacaccctgtag

SEQ ID NO: 21708 - DNA, 435 bp, Artificial Sequence; identical to SEQ ID NO: 21705
  Description of Artificial Sequence: Synthetic coding sequence

SEQ ID NO: 21709 - DNA, 417 bp, Artificial Sequence
  Description of Artificial Sequence: Synthetic coding sequence
atgggcgtgagcaaccagggctgcagcagaaacgccagacaccagaaggccagaagcatgcccctgcaggaccagcacctggccctggccatcctgctggagctggccgtgcagagaggcaccctgagccagatgctgagcgccatcctgctgctgctgcagctgtgggacagcagagcccaggagaccgacaacgagagaagcgcccagggcaccagcaccctgctgctgagcctgctgcagaccttccagagcatcatctgcggcaaggacaccccccccagcgagggcaacatgcacctgctgagcggccccctgagccccagcgagagcttcctgagatacctgaccctgcacaagaccaccagcctgcccctgatctgcaacaagagacagctgctgagctggcccatctag

SEQ ID NO: 21710 - DNA, 7839 bp, Artificial Sequence
  Description of Artificial Sequence: Synthetic coding sequence
atggccgacgtggaccccgacaccctgctggagtggctgcagatgggccagggcgacgagagagacatgcagctgatcgccctggagcagctgtgcatgctgctgctgatgagcgacaacgtggacagatgcttcgagacctgcccccccagaaccttcctgcccgccctgtgcaagatcttcctggacgagagcgcccccgacaacgtgctggaggtgaccgccagagccatcacctactacctggacgtgagcgccgagtgcaccagaagaatcgtgggcgtggacggcgccatcaaggccctgtgcaacagactggtggtggtggagctgaacaacagaaccagcagagacctggccgagcagtgcgtgaaggtgctggagctgatctgcaccagagagagcggcgccgtgttcgaggccggcggcctgaactgcgtgctgaccttcatcagagacagcggccacctggtgcacaaggacaccctgcacagcgccatggccgtggtgagcagactgtgcggcaagatggagccccaggacagcagcctggagatctgcgtggagagcctgagcagcctgctgaagcacgaggaccaccaggtgagcgacggcgccctgagatgcttcgccagcctggccgacagattcaccagaagaggcgtggaccccgcccccctggccaagcacggcctgaccgaggagctgctgagcagaatggccgccgccggcggcaccgtgagcggccccagcagcgcctgcaagcccggcagaagcaccaccggcgcccccagcaccaccgccgacagcaagctgagcaaccaggtgagcaccatcgtgagcctgctgagcaccctgtgcagaggcagccccgtggtgacccacgacctgctgagaagcgagctgcccgacagcatcgagagcgccctgcagggcgacgagagatgcgtgctggacaccatgagactggtggacctgctgctggtgctgctgttcgagggcagaaaggccctgcccaagagcagcgccggcagcaccggcagaatccccggcctgagaagactggacagcagcggcgagagaagccacagacagctgatcgactgcatcagaagcaaggacaccgacgccctgatcgacgccatcgacaccggcgccttcgaggtgaacttcatggacgacgtgggccagaccctgctgaactgggccagcgccttcggcacccaggagatggtggagttcctgtgcgagagaggcgccgacgtgaacagaggccagagaagcagcagcctgcactacgccgcctgcttcggcagaccccaggtggccaagaccctgctgagacacggcgccaaccccgacctgagagacgaggacggcaagacccccctggacaaggccagagagagaggccacagcgaggtggtggccatcctgcagagccccggcgactggatgtgccccgtgaacaagggcgacgacaagaagaagaaggacaccaacaaggacgaggaggagtgcaacgagcccaagggcgaccccgagatggcccccatctacctgaagagactgctgcccgtgttcgcccagaccttccagcagaccatgctgcccagcatcagaaaggccagcctggccctgatcagaaagatgatccacttctgcagcgaggccctgctgaaggaggtgtgcgacagcgacgtgggccacaacctgcccaccatcctggtggagatcaccgccaccgtgctggaccaggaggacgacgacgacggccacctgctggccctgcagatcatcagagacctggtggacaagggcggcgacatcttcctggaccagctggccagactgggcgtgatcagcaaggtgagcaccctggccggccccagcagcgacgacgagaacgaggaggagagcaagcccgagaaggaggacgagccccaggaggacgccaaggagctgcagcagggcaagccctaccactggagagactggagcatcatcagaggcagagactgcctgtacatctggagcgacgccgccgccctggagctgagcaacggcagcaacggctggttcagattcatcctggacggcaagctggccaccatgtacagcagcggcagccccgagggcggcagcgacagcagcgagagcagaagcgagttcctggagaagctgcagagagccagaggccaggtgaagcccagcaccagcagccagcccatcctgagcgcccccggccccaccaagctgaccgtgggcaactggagcctgacctgcctgaaggagggcgagatcgccatccacaacagcgacggccagcaggccaccatcctgaaggaggacctgcccggcttcgtgttcgagagcaacagaggcaccaagcacagcttcaccgccgagaccagcctgggcagcgagttcgtgaccggctggaccggcaagagaggcagaaagctgaagagcaagctggagaagaccaagcagaaggtgagaaccatggccagagacctgtacgacgaccacttcaaggccgtggagagcatgcccagaggcgtggtggtgaccctgagaaacatcgccacccagctggagagcagctgggagctgcacaccaacagacagtgcatcgagagcgagaacacctggagagacctgatgaagaccgccctggagaacctgatcgtgctgctgaaggacgagaacaccatcagcccctacgagatgtgcagcagcggcctggtgcaggccctgctgaccgtgctgaacaacgtgagcctgagcagcagcaaggagcagaagtacagcttcacccccagcgtggagatcaacgtgttcaagaccgccttcagcgagaacgaggacgacgagagcagacccgccgtggccctgatcagaaagctgatcgccgtgctggagagcatcgagagactgcccctgcacctgtacgacacccccggcagcacctacaacctgcagatcctgaccagaagactgagattcagactggagagagcccccggcgagaccgccctgatcgacagaaccggcagaatgctgaagatggagcccctggccaccgtggagagcctggagcagtacctgctgaagatggtggccaagcagtggtacgacttcgacagaagcagcttcgtgttcgtgagaaagctgagagagggccagaacttcatcttcagacaccagcacgacttcgacgagaacggcatcatctactggatcggcaccaacgccaagaccgcctacgagtgggtgaaccccgccgcctacggcctggtggtggtgaccagcagcgagggcagaaacctgccctacggcagactggaggacatcctgagcagagacaacagcgccctgaactgccacagcaacgacgacaagaacgcctggttcgccatcgacctgggcctgtgggtgatccccagcgcctacaccctgagacacgccagaggctacggcagaagcgccctgagaaactgggtgttccaggtgagcaaggacggccagaactggaccagcctgtacacccacgtggacgactgcagcctgaacgagcccggcagcaccgccacctggcccctggacccccccaaggacgagaagcagggctggagacacgtgagaatcaagcagatgggcaagaacgccagcggccagacccactacctgagcctgagcggcttcgagctgtacggcaccgtgaacggcgtgtgcgaggaccagctgggcaaggccgccaaggaggccgaggccaacctgagaagacagagaagactggtgagaagccaggtgctgaagtacatggtgcccggcgccagagtgatcagaggcctggactggaagtggagagaccaggacggcagcccccagggcgagggcaccgtgaccggcgagctgcacaacggctggatcgacgtgacctgggacgccggcggcagcaacagctacagaatgggcgccgagggcaagttcgacctgaagctggcccccggctacgaccccgacaccgtggccagccccaagcccgtgagcagcaccgtgagcggcaccacccagagctggagcagcctggtgaagaacaactgccccgacaagaccagcgccgccgccggcagcagcagcagaaagggcagcagcagcagcgtgtgcagcgtggccagcagcagcgacatcagcctgggcagcaccaagaccgagagaagaagcgagatcgtgatggagcacagcatcgtgagcggcgccgacgtgcacgagcccatcgtggtgctgagcagcgccgagaacgtgccccagaccgaggtgggcagcagcagcagcgccagcaccagcaccctgaccgccgagaccggcagcgagaacgccgagagaaagctgggccccgacagcagcgtgagaacccccggcgagagcagcgccatcagcatgggcatcgtgagcgtgagcagccccgacgtgagcagcgtgagcgagctgaccaacaaggaggccgccagccagagacccctgagcagcagcgccagcaacagactgagcgtgagcagcctgctggccgccggcgcccccatgagcagcagcgccagcgtgcccaacctgagcagcagagagaccagcagcctggagagcttcgtgagaagagtggccaacatcgccagaaccaacgccaccaacaacatgaacctgagcagaagcagcagcgacaacaacaccaacaccctgggcagaaacgtgatgagcaccgccaccagccccctgatgggcgcccagagcttccccaacctgaccacccccggcaccaccagcaccgtgaccatgagcaccagcagcgtgaccagcagcagcaacgtggccaccgccaccaccgtgctgagcgtgggccagagcctgagcaacaccctgaccaccagcctgaccagcaccagcagcgagagcgacaccggccaggaggccgagtacagcctgtacgacttcctggacagctgcagagccagcaccctgctggccgagctggacgacgacgaggacctgcccgagcccgacgaggaggacgacgagaacgaggacgacaaccaggaggaccaggagtacgaggaggtgatgatcctgagaagacccagcctgcagagaagagccggcagcagaagcgacgtgacccaccacgccgtgaccagccagctgccccaggtgcccgccggcgccggcagcagacccatcggcgagcaggaggaggaggagtacgagaccaagggcggcagaagaagaacctgggacgacgactacgtgctgaagagacagttcagcgccctggtgcccgccttcgaccccagacccggcagaaccaacgtgcagcagaccaccgacctggagatccccccccccggcaccccccacagcgagctgctggaggaggtggagtgcacccccagccccagactggccctgaccctgaaggtgaccggcctgggcaccaccagagaggtggagctgcccctgaccaacttcagaagcaccatcttctactacgtgcagaagctgctgcagctgagctgcaacggcaacgtgaagagcgacaagctgagaagaatctgggagcccacctacaccatcatgtacagagagatgaaggacagcgacaaggagaaggagaacggcaagatgggctgctggagcatcgagcacgtggagcagtacctgggcaccgacgagctgcccaagaacgacctgatcacctacctgcagaagaacgccgacgccgccttcctgagacactggaagctgaccggcaccaacaagagcatcagaaagaacagaaactgcagccagctgatcgccgcctacaaggacttctgcgagcacggcaccaagagcggcctgaaccagggcgccatcagcaccctgcagagcagcgacatcctgaacctgaccaaggagcagccccaggccaaggccggcaacggccagaacagctgcggcgtggaggacgtgctgcagctgctgagaatcctgtacatcgtggccagcgacccctacagcagaatcagccaggaggacggcgacgagcagctgcagttcaccttcccccccgacgagttcaccagcaagaagatcaccaccaagatcctgcagcagatcgaggagcccctggccctggccagcggcgccctgcccgactggtgcgagcagctgaccagcaagtgccccttcctgatccccttcgagaccagacagctgtacttcacctgcaccgccttcggcgccagcagagccatcgtgtggctgcagaacagaagagaggccaccgtggagagaaccagaaccaccagcagcgtgagaagagacgaccccggcgagttcagagtgggcagactgaagcacgagagagtgaaggtgcccagaggcgagagcctgatggagtgggccgagaacgtgatgcagatccacgccgacagaaagagcgtgctggaggtggagttcctgggcgaggagggcaccggcctgggccccaccctggagttctacgccctggtggccgccgagttccagagaaccgacctgggcgcctggctgtgcgacgacaacttccccgacgacgagagcagacacgtggacctgggcggcggcctgaagccccccggctactacgtgcagagaagctgcggcctgttcaccgcccccttcccccaggacagcgacgagctggagagaatcaccaagctgttccacttcctgggcatcttcctggccaagtgcatccaggacaacagactggtggacctgcccatcagcaagcccttcttcaagctgatgtgcatgggcgacatcaagagcaacatgagcaagctgatctacgagagcagaggcgacagagacctgcactgcaccgagagccagagcgaggccagcaccgaggagggccacgacagcctgagcgtgggcagcttcgaggaggacagcaagagcgagttcatcctggacccccccaagcccaagccccccgcctggttcaacggcatcctgacctgggaggacttcgagctggtgaacccccacagagccagattcctgaaggagatcaaggacctggccatcaagagaagacagatcctgagcaacaagggcctgagcgaggacgagaagaacaccaagctgcaggagctggtgctgaagaaccccagcggcagcggcccccccctgagcatcgaggacctgggcctgaacttccagttctgccccagcagcagaatctacggcttcaccgccgtggacctgaagcccagcggcgaggacgagatgatcaccatggacaacgccgaggagtacgtggacctgatgttcgacttctgcatgcacaccggcatccagaagcagatggaggccttcagagacggcttcaacaaggtgttccccatggagaagctgagcagcttcagccacgaggaggtgcagatgatcctgtgcggcaaccagagccccagctgggccgccgaggacatcatcaactacaccgagcccaagctgggctacaccagagacagccccggcttcctgagattcgtgagagtgctgtgcggcatgagcagcgacgagagaaaggccttcctgcagttcaccaccggctgcagcaccctgccccccggcggcctggccaacctgcaccccagactgaccgtggtgagaaaggtggacgccaccgacgccagctaccccagcgtgaacacctgcgtgcactacctgaagctgcccgagtacagcagcgaggagatcatgagagagagactgctggccgccaccatggagaagggcttccacctgaactag

SEQ ID NO: 21711 - DNA, 516 bp, Artificial Sequence
  Description of Artificial Sequence: Synthetic coding sequence
aaggtgttcctgaaggccgtggccggcaactaccacatcttcagacacaccggcatccagaagcagatggaggccttcagagacggcttcaacaaggtgttccccatggagaagctgagcagcttcagccacgaggaggtgcagatgatcctgtgcggcaaccagagccccagctgggccgccgaggacatcatcaactacaccgagcccaagctgggctacaccagagacagccccggcttcctgagattcgtgagagtgctgtgcggcatgagcagcgacgagagaaaggccttcctgcagttcaccaccggctgcagcaccctgccccccggcggcctggccaacctgcaccccagactgaccgtggtgagaaaggtggacgccaccgacgccagctaccccagcgtgaacacctgcgtgcactacctgaagctgcccgagtacagcagcgaggagatcatgagagagagactgctggccgccaccatggagaagggcttccacctgaactag

SEQ ID NO: 21712 - DNA, 7833 bp, Artificial Sequence
  Description of Artificial Sequence: Synthetic coding sequence
atggccgacgtggaccccgacaccctgctggagtggctgcagatgggccagggcgacgagagagacatgcagctgatcgccctggagcagctgtgcatgctgctgctgatgagcgacaacgtggacagatgcttcgagacctgcccccccagaaccttcctgcccgccctgtgcaagatcttcctggacgagagcgcccccgacaacgtgctggaggtgaccgccagagccatcacctactacctggacgtgagcgccgagtgcaccagaagaatcgtgggcgtggacggcgccatcaaggccctgtgcaacagactggtggtggtggagctgaacaacagaaccagcagagacctggccgagcagtgcgtgaaggtgctggagctgatctgcaccagagagagcggcgccgtgttcgaggccggcggcctgaactgcgtgctgaccttcatcagagacagcggccacctggtgcacaaggacaccctgcacagcgccatggccgtggtgagcagactgtgcggcaagatggagccccaggacagcagcctggagatctgcgtggagagcctgagcagcctgctgaagcacgaggaccaccaggtgagcgacggcgccctgagatgcttcgccagcctggccgacagattcaccagaagaggcgtggaccccgcccccctggccaagcacggcctgaccgaggagctgctgagcagaatggccgccgccggcggcaccgtgagcggccccagcagcgcctgcaagcccggcagaagcaccaccggcgcccccagcaccaccgccgacagcaagctgagcaaccaggtgagcaccatcgtgagcctgctgagcaccctgtgcagaggcagccccgtggtgacccacgacctgctgagaagcgagctgcccgacagcatcgagagcgccctgcagggcgacgagagatgcgtgctggacaccatgagactggtggacctgctgctggtgctgctgttcgagggcagaaaggccctgcccaagagcagcgccggcagcaccggcagaatccccggcctgagaagactggacagcagcggcgagagaagccacagacagctgatcgactgcatcagaagcaaggacaccgacgccctgatcgacgccatcgacaccggcgccttcgaggtgaacttcatggacgacgtgggccagaccctgctgaactgggccagcgccttcggcacccaggagatggtggagttcctgtgcgagagaggcgccgacgtgaacagaggccagagaagcagcagcctgcactacgccgcctgcttcggcagaccccaggtggccaagaccctgctgagacacggcgccaaccccgacctgagagacgaggacggcaagacccccctggacaaggccagagagagaggccacagcgaggtggtggccatcctgcagagccccggcgactggatgtgccccgtgaacaagggcgacgacaagaagaagaaggacaccaacaaggacgaggaggagtgcaacgagcccaagggcgaccccgagatggcccccatctacctgaagagactgctgcccgtgttcgcccagaccttccagcagaccatgctgcccagcatcagaaaggccagcctggccctgatcagaaagatgatccacttctgcagcgaggccctgctgaaggaggtgtgcgacagcgacgtgggccacaacctgcccaccatcctggtggagatcaccgccaccgtgctggaccaggaggacgacgacgacggccacctgctggccctgcagatcatcagagacctggtggacaagggcggcgacatcttcctggaccagctggccagactgggcgtgatcagcaaggtgagcaccctggccggccccagcagcgacgacgagaacgaggaggagagcaagcccgagaaggaggacgagccccaggaggacgccaaggagctgcagcagggcaagccctaccactggagagactggagcatcatcagaggcagagactgcctgtacatctggagcgacgccgccgccctggagctgagcaacggcagcaacggctggttcagattcatcctggacggcaagctggccaccatgtacagcagcggcagccccgagggcggcagcgacagcagcgagagcagaagcgagttcctggagaagctgcagagagccagaggccaggtgaagcccagcaccagcagccagcccatcctgagcgcccccggccccaccaagctgaccgtgggcaactggagcctgacctgcctgaaggagggcgagatcgccatccacaacagcgacggccagcaggccaccatcctgaaggaggacctgcccggcttcgtgttcgagagcaacagaggcaccaagcacagcttcaccgccgagaccagcctgggcagcgagttcgtgaccggctggaccggcaagagaggcagaaagctgaagagcaagctggagaagaccaagcagaaggtgagaaccatggccagagacctgtacgacgaccacttcaaggccgtggagagcatgcccagaggcgtggtggtgaccctgagaaacatcgccacccagctggagagcagctgggagctgcacaccaacagacagtgcatcgagagcgagaacacctggagagacctgatgaagaccgccctggagaacctgatcgtgctgctgaaggacgagaacaccatcagcccctacgagatgtgcagcagcggcctggtgcaggccctgctgaccgtgctgaacaacagcatggacctggacatgaagcaggactgcagccagctggtggagagaatcaacgtgttcaagaccgccttcagcgagaacgaggacgacgagagcagacccgccgtggccctgatcagaaagctgatcgccgtgctggagagcatcgagagactgcccctgcacctgtacgacacccccggcagcacctacaacctgcagatcctgaccagaagactgagattcagactggagagagcccccggcgagaccgccctgatcgacagaaccggcagaatgctgaagatggagcccctggccaccgtggagagcctggagcagtacctgctgaagatggtggccaagcagtggtacgacttcgacagaagcagcttcgtgttcgtgagaaagctgagagagggccagaacttcatcttcagacaccagcacgacttcgacgagaacggcatcatctactggatcggcaccaacgccaagaccgcctacgagtgggtgaaccccgccgcctacggcctggtggtggtgaccagcagcgagggcagaaacctgccctacggcagactggaggacatcctgagcagagacaacagcgccctgaactgccacagcaacgacgacaagaacgcctggttcgccatcgacctgggcctgtgggtgatccccagcgcctacaccctgagacacgccagaggctacggcagaagcgccctgagaaactgggtgttccaggtgagcaaggacggccagaactggaccagcctgtacacccacgtggacgactgcagcctgaacgagcccggcagcaccgccacctggcccctggacccccccaaggacgagaagcagggctggagacacgtgagaatcaagcagatgggcaagaacgccagcggccagacccactacctgagcctgagcggcttcgagctgtacggcaccgtgaacggcgtgtgcgaggaccagctgggcaaggccgccaaggaggccgaggccaacctgagaagacagagaagactggtgagaagccaggtgctgaagtacatggtgcccggcgccagagtgatcagaggcctggactggaagtggagagaccaggacggcagcccccagggcgagggcaccgtgaccggcgagctgcacaacggctggatcgacgtgacctgggacgccggcggcagcaacagctacagaatgggcgccgagggcaagttcgacctgaagctggcccccggctacgaccccgacaccgtggccagccccaagcccgtgagcagcaccgtgagcggcaccacccagagctggagcagcctggtgaagaacaactgccccgacaagaccagcgccgccgccggcagcagcagcagaaagggcagcagcagcagcgtgtgcagcgtggccagcagcagcgacatcagcctgggcagcaccaagaccgagagaagaagcgagatcgtgatggagcacagcatcgtgagcggcgccgacgtgcacgagcccatcgtggtgctgagcagcgccgagaacgtgccccagaccgaggtgggcagcagcagcagcgccagcaccagcaccctgaccgccgagaccggcagcgagaacgccgagagaaagctgggccccgacagcagcgtgagaacccccggcgagagcagcgccatcagcatgggcatcgtgagcgtgagcagccccgacgtgagcagcgtgagcgagctgaccaacaaggaggccgccagccagagacccctgagcagcagcgccagcaacagactgagcgtgagcagcctgctggccgccggcgcccccatgagcagcagcgccagcgtgcccaacctgagcagcagagagaccagcagcctggagagcttcgtgagaagagtggccaacatcgccagaaccaacgccaccaacaacatgaacctgagcagaagcagcagcgacaacaacaccaacaccctgggcagaaacgtgatgagcaccgccaccagccccctgatgggcgcccagagcttccccaacctgaccacccccggcaccaccagcaccgtgaccatgagcaccagcagcgtgaccagcagcagcaacgtggccaccgccaccaccgtgctgagcgtgggccagagcctgagcaacaccctgaccaccagcctgaccagcaccagcagcgagagcgacaccggccaggaggccgagtacagcctgtacgacttcctggacagctgcagagccagcaccctgctggccgagctggacgacgacgaggacctgcccgagcccgacgaggaggacgacgagaacgaggacgacaaccaggaggaccaggagtacgaggaggtgatgatcctgagaagacccagcctgcagagaagagccggcagcagaagcgacgtgacccaccacgccgtgaccagccagctgccccaggtgcccgccggcgccggcagcagacccatcggcgagcaggaggaggaggagtacgagaccaagggcggcagaagaagaacctgggacgacgactacgtgctgaagagacagttcagcgccctggtgcccgccttcgaccccagacccggcagaaccaacgtgcagcagaccaccgacctggagatccccccccccggcaccccccacagcgagctgctggaggaggtggagtgcacccccagccccagactggccctgaccctgaaggtgaccggcctgggcaccaccagagaggtggagctgcccctgaccaacttcagaagcaccatcttctactacgtgcagaagctgctgcagctgagctgcaacggcaacgtgaagagcgacaagctgagaagaatctgggagcccacctacaccatcatgtacagagagatgaaggacagcgacaaggagaaggagaacggcaagatgggctgctggagcatcgagcacgtggagcagtacctgggcaccgacgagctgcccaagaacgacctgatcacctacctgcagaagaacgccgacgccgccttcctgagacactggaagctgaccggcaccaacaagagcatcagaaagaacagaaactgcagccagctgatcgccgcctacaaggacttctgcgagcacggcaccaagagcggcctgaaccagggcgccatcagcaccctgcagagcagcgacatcctgaacctgaccaaggagcagccccaggccaaggccggcaacggccagaacagctgcggcgtggaggacgtgctgcagctgctgagaatcctgtacatcgtggccagcgacccctacagcagaatcagccaggaggacggcgacgagcagctgcagttcaccttcccccccgacgagttcaccagcaagaagatcaccaccaagatcctgcagcagatcgaggagcccctggccctggccagcggcgccctgcccgactggtgcgagcagctgaccagcaagtgccccttcctgatccccttcgagaccagacagctgtacttcacctgcaccgccttcggcgccagcagagccatcgtgtggctgcagaacagaagagaggccaccgtggagagaaccagaaccaccagcagcgtgagaagagacgaccccggcgagttcagagtgggcagactgaagcacgagagagtgaaggtgcccagaggcgagagcctgatggagtgggccgagaacgtgatgcagatccacgccgacagaaagagcgtgctggaggtggagttcctgggcgaggagggcaccggcctgggccccaccctggagttctacgccctggtggccgccgagttccagagaaccgacctgggcgcctggctgtgcgacgacaacttccccgacgacgagagcagacacgtggacctgggcggcggcctgaagccccccggctactacgtgcagagaagctgcggcctgttcaccgcccccttcccccaggacagcgacgagctggagagaatcaccaagctgttccacttcctgggcatcttcctggccaagtgcatccaggacaacagactggtggacctgcccatcagcaagcccttcttcaagctgatgtgcatgggcgacatcaagagcaacatgagcaagctgatctacgagagcagaggcgacagagacctgcactgcaccgagagccagagcgaggccagcaccgaggagggccacgacagcctgagcgtgggcagcttcgaggaggacagcaagagcgagttcatcctggacccccccaagcccaagccccccgcctggttcaacggcatcctgacctgggaggacttcgagctggtgaacccccacagagccagattcctgaaggagatcaaggacctggccatcaagagaagacagatcctgagcaacaagggcctgagcgaggacgagaagaacaccaagctgcaggagctggtgctgaagaaccccagcggcagcggcccccccctgagcatcgaggacctgggcctgaacttccagttctgccccagcagcagaatctacggcttcaccgccgtggacctgaagcccagcggcgaggacgagatgatcaccatggacaacgccgaggagtacgtggacctgatgttcgacttctgcatgcacaccggcatccagaagcagatggaggccttcagagacggcttcaacaaggtgttccccatggagaagctgagcagcttcagccacgaggaggtgcagatgatcctgtgcggcaaccagagccccagctgggccgccgaggacatcatcaactacaccgagcccaagctgggctacaccagagacagccccggcttcctgagattcgtgagagtgctgtgcggcatgagcagcgacgagagaaaggccttcctgcagttcaccaccggctgcagcaccctgccccccggcggcctggccaacctgcaccccagactgaccgtggtgagaaaggtggacgccaccgacgccagctaccccagcgtgaacacctgcgtgcactacctgaagctgcccgagtacagcagcgaggagatcatgagagagagactgctggccgccaccatggagaagggcttccacctgaactag

SEQ ID NO: 21713 - DNA, 7833 bp, Artificial Sequence; identical to SEQ ID NO: 21712
  Description of Artificial Sequence: Synthetic coding sequence

SEQ ID NO: 21714 - DNA, 2781 bp, Artificial Sequence
  Description of Artificial Sequence: Synthetic coding sequence
atggccgacgtggaccccgacaccctgctggagtggctgcagatgggccagggcgacgagagagacatgcagctgatcgccctggagcagctgtgcatgctgctgctgatgagcgacaacgtggacagatgcttcgagacctgcccccccagaaccttcctgcccgccctgtgcaagatcttcctggacgagagcgcccccgacaacgtgctggaggtgaccgccagagccatcacctactacctggacgtgagcgccgagtgcaccagaagaatcgtgggcgtggacggcgccatcaaggccctgtgcaacagactggtggtggtggagctgaacaacagaaccagcagagacctggccgagcagtgcgtgaaggtgctggagctgatctgcaccagagagagcggcgccgtgttcgaggccggcggcctgaactgcgtgctgaccttcatcagagacagcggccacctggtgcacaaggacaccctgcacagcgccatggccgtggtgagcagactgtgcggcaagatggagccccaggacagcagcctggagatctgcgtggagagcctgagcagcctgctgaagcacgaggaccaccaggtgagcgacggcgccctgagatgcttcgccagcctggccgacagattcaccagaagaggcgtggaccccgcccccctggccaagcacggcctgaccgaggagctgctgagcagaatggccgccgccggcggcaccgtgagcggccccagcagcgcctgcaagcccggcagaagcaccaccggcgcccccagcaccaccgccgacagcaagctgagcaaccaggtgagcaccatcgtgagcctgctgagcaccctgtgcagaggcagccccgtggtgacccacgacctgctgagaagcgagctgcccgacagcatcgagagcgccctgcagggcgacgagagatgcgtgctggacaccatgagactggtggacctgctgctggtgctgctgttcgagggcagaaaggccctgcccaagagcagcgccggcagcaccggcagaatccccggcctgagaagactggacagcagcggcgagagaagccacagacagctgatcgactgcatcagaagcaaggacaccgacgccctgatcgacgccatcgacaccggcgccttcgaggtgaacttcatggacgacgtgggccagaccctgctgaactgggccagcgccttcggcacccaggagatggtggagttcctgtgcgagagaggcgccgacgtgaacagaggccagagaagcagcagcctgcactacgccgcctgcttcggcagaccccaggtggccaagaccctgctgagacacggcgccaaccccgacctgagagacgaggacggcaagacccccctggacaaggccagagagagaggccacagcgaggtggtggccatcctgcagagccccggcgactggatgtgccccgtgaacaagggcgacgacaagaagaagaaggacaccaacaaggacgaggaggagtgcaacgagcccaagggcgaccccgagatggcccccatctacctgaagagactgctgcccgtgttcgcccagaccttccagcagaccatgctgcccagcatcagaaaggccagcctggccctgatcagaaagatgatccacttctgcagcgaggccctgctgaaggaggtgtgcgacagcgacgtgggccacaacctgcccaccatcctggtggagatcaccgccaccgtgctggaccaggaggacgacgacgacggccacctgctggccctgcagatcatcagagacctggtggacaagggcggcgacatcttcctggaccagctggccagactgggcgtgatcagcaaggtgagcaccctggccggccccagcagcgacgacgagaacgaggaggagagcaagcccgagaaggaggacgagccccaggaggacgccaaggagctgcagcagggcaagccctaccactggagagactggagcatcatcagaggcagagactgcctgtacatctggagcgacgccgccgccctggagctgagcaacggcagcaacggctggttcagattcatcctggacggcaagctggccaccatgtacagcagcggcagccccgagggcggcagcgacagcagcgagagcagaagcgagttcctggagaagctgcagagagccagaggccaggtgaagcccagcaccagcagccagcccatcctgagcgcccccggccccaccaagctgaccgtgggcaactggagcctgacctgcctgaaggagggcgagatcgccatccacaacagcgacggccagcaggccaccatcctgaaggaggacctgcccggcttcgtgttcgagagcaacagaggcaccaagcacagcttcaccgccgagaccagcctgggcagcgagttcgtgaccggctggaccggcaagagaggcagaaagctgaagagcaagctggagaagaccaagcagaaggtgagaaccatggccagagacctgtacgacgaccacttcaaggccgtggagagcatgcccagaggcgtggtggtgaccctgagaaacatcgccacccagctggagagcagctgggagctgcacaccaacagacagtgcatcgagagcgagaacacctggagagacctgatgaagaccgccctggagaacctgatcgtgctgctgaaggacgagaacaccatcagcccctacgagatgtgcagcagcggcctggtgcaggccctgctgaccgtgctgaacaactag

SEQ ID NO: 21715 - DNA, 2331 bp, Artificial Sequence
  Description of Artificial Sequence: Synthetic coding sequence
atgagcgaggccgtgagagtgcccagccccgccacccccctggtggtggccgcccccgcccccgaggagagaaagggcaaggagagcgagagagagaagctgccccccatcgtgagcgccggcgccggcgccaccgccggcctggacagaggcgccaagggccagatcagcaccttcagcagcttcatcagcgccgtgagccccaagaaggaggccgccgagaacagaagcagccccgcccacctggtgttccccaacatcaagaacgtgagagagcccccccccatctgcctggacgtgagacagaagcagagaaccagcatggacgccagcagcagcgagatgaaggcccccgtgctgcccgagcccatcctgcccatccagcccaagaccgtgaaggacttccaggaggacgtggagaaggtgaagagcagcggcgactggaaggccgtgcacgacttctacctgaccaccttcgacagcttccccgagctgaacgccgccttcaagaaggacgccaccgccagcttcaacaccatcgaggacagcggcatcaacgccaagttcgtgaacgccgtgtacgacaccctgctgaacaccccccaggacgtgcagaagaccgtgctgaagggcatcatcaacagcctgctgagagagtggaagggccccagaaccaaggacgacctgagagcctacttcatcctgctgcagaacccccagttcaacaacaccagcacctacgtgatctacgcccacctgctgagacagatcgccaccctggtggaggccgaccaccacttcctggtgcactggttcaagaagctgagccagaagagattcaagcagctggtggagagactgctgcagttcatcagcctgagactgttccccgccaagcccgaggagttcccccccatcaccaagtgcagctggtggatccccagcgccgccaaggtgctggccctgctgaacaccgccaacaacctggtgcacccccccctgatcccctacaccgacttctacaacagcaccctggaccacatcgacctgatggaggagtaccacacctggcagaacttcggcaacagccacagattcagcttctgccagtaccccttcgtgatcagcgtggccgccaagaagatcatcatccagagagacagcgagcagcagatgatcaacatcgccagacagagcctggtggacaaggtgagcagaagacagagacccgacatgaacatcctgttcctgaacatgaaggtgagaagaacccacctggtgagcgacagcctggacgagctgaccagaaagagagccgacctgaagaagaagctgaaggtgaccttcgtgggcgaggccggcctggacatgggcggcctgaccaaggagtggttcctgctgctgatcagacagatcttccaccccgactacggcatgttcacctaccacaaggacagccactgccactggttcagcagcttcaagtgcgacaactacagcgagttcagactggtgggcatcctgatgggcctggccgtgtacaacagcatcaccctggacatcagattccccccctgctgctacaagaagctgctgagcccccccatcatccccagcgaccagaacatccccgtgggcatctgcaacgtgaccgtggacgacctgtgccagatcatgcccgagctggcccacggcctgagcgagctgctgagccacgagggcaacgtggaggaggacttctacagcaccttccaggtgttccaggaggagttcggcatcatcaagagctacaacctgaagcccggcggcgacaagatcagcgtgaccaaccagaacagaaaggagtacgtgcagctgtacaccgacttcctgctgaacaagagcatctacaagcagttcgccgccttctactacggcttccacagcgtgtgcgccagcaacgccctgatgctgctgagacccgaggaggtggagatcctggtgtgcggcagccccgacctggacatgcacgccctgcagagaagcacccagtacgacggctacgccaagaccgacctgaccatcaagtacttctgggacgtggtgctgggcttccccctggacctgcagaagaagctgctgcacttcaccaccggcagcgacagagtgcccgtgggcggcatggccgacctgaacttcaagatcagcaagaacgagaccagcaccaactgcctgcccgtggcccacacctgcttcaaccagctgtgcctgcccccctacaagagcaagaaggacctgaagcagaagctgatcatcggcatcagcaacagcgagggcttcggcctggagtag

SEQ ID NO: 21716 - DNA, 1281 bp, Artificial Sequence
  Description of Artificial Sequence: Synthetic coding sequence
atggaggagtaccacacctggcagaacttcggcaacagccacagattcagcttctgccagtaccccttcgtgatcagcgtggccgccaagaagatcatcatccagagagacagcgagcagcagatgatcaacatcgccagacagagcctggtggacaaggtgagcagaagacagagacccgacatgaacatcctgttcctgaacatgaaggtgagaagaacccacctggtgagcgacagcctggacgagctgaccagaaagagagccgacctgaagaagaagctgaaggtgaccttcgtgggcgaggccggcctggacatgggcggcctgaccaaggagtggttcctgctgctgatcagacagatcttccaccccgactacggcatgttcacctaccacaaggacagccactgccactggttcagcagcttcaagtgcgacaactacagcgagttcagactggtgggcatcctgatgggcctggccgtgtacaacagcatcaccctggacatcagattccccccctgctgctacaagaagctgctgagcccccccatcatccccagcgaccagaacatccccgtgggcatctgcaacgtgaccgtggacgacctgtgccagatcatgcccgagctggcccacggcctgagcgagctgctgagccacgagggcaacgtggaggaggacttctacagcaccttccaggtgttccaggaggagttcggcatcatcaagagctacaacctgaagcccggcggcgacaagatcagcgtgaccaaccagaacagaaaggagtacgtgcagctgtacaccgacttcctgctgaacaagagcatctacaagcagttcgccgccttctactacggcttccacagcgtgtgcgccagcaacgccctgatgctgctgagacccgaggaggtggagatcctggtgtgcggcagccccgacctggacatgcacgccctgcagagaagcacccagtacgacggctacgccaagaccgacctgaccatcaagtacttctgggacgtggtgctgggcttccccctggacctgcagaagaagctgctgcacttcaccaccggcagcgacagagtgcccgtgggcggcatggccgacctgaacttcaagatcagcaagaacgagaccagcaccaactgcctgcccgtggcccacacctgcttcaaccagctgtgcctgcccccctacaagagcaagaaggacctgaagcagaagctgatcatcggcatcagcaacagcgagggcttcggcctggagtag

SEQ ID NO: 21717 - DNA, 444 bp, Artificial Sequence
  Description of Artificial Sequence: Synthetic coding sequence
ctgagccagaagagattcaagcagctggtggagagactgctgcagttcatcagcctgagactgttccccgccaagcccgaggagttcccccccatcaccaagtgcagctggtggatccccagcgccgccaaggtgctggccctgctgaacaccgccaacaacctggtgcacccccccctgatcccctacaccgacttctacaacagcaccctggaccacatcgacctgatggaggagtaccacacctggcagaacttcggcaacagccacagaatggccgtgagaatcaagagaaactacacccacaccatcatcctgtacatggtgaagcacaaccccaaggtgatgttctacatcgccaccagaggcaccctggacagcctgagcatcatcctgctgaagatccaccacttcgccttcagcttcttccacctgctgagctag

SEQ ID NO: 21718 - DNA, 624 bp, Artificial Sequence
  Description of Artificial Sequence: Synthetic coding sequence
atgagcgaggccgtgagagtgcccagccccgccacccccctggtggtggccgcccccgcccccgaggagagaaagggcaaggagagcgagagagagaagctgccccccatcgtgagcgccggcgccggcgccaccgccggcctggacagaggcgccaagggccagatcagcaccttcagcagcttcatcagcgccgtgagccccaagaaggaggccgccgagaacagaagcagccccgcccacctggtgttccccaacatcaagaacgtgagagagcccccccccatctgcctggacgtgagacagaagcagagaaccagcatggacgccagcagcagcgagatgaaggcccccgtgctgcccgagcccatcctgcccatccagcccaagaccgtgaaggacttccaggaggacgtggagaaggtgaagagcagcggcgactggaaggccgtgcacgacttctacctgaccaccttcgacagcttccccgagctgaacgccgccttcaagaaggacgccaccgccagcttcaacaccatcgaggacagcggcatcaacgccaagttcgtgaacgccgtgtacgacaccctgctgaacaccgtgagcatcatgacctgcaagtag

SEQ ID NO: 21719 - DNA, 2343 bp, Artificial Sequence
  Description of Artificial Sequence: Synthetic coding sequence
atgagcgaggccgtgagagtgcccagccccgccacccccctggtggtggccgcccccgcccccgaggagagaaagggcaaggagagcgagagagagaagctgccccccatcgtgagcgccggcgccggcgccaccgccggcctggacagaggcgccaagggccagatcagcaccttcagcagcttcatcagcgccgtgagccccaagaaggaggccgccgagaacagaagcagccccgcccacctggtgttccccaacatcaagaacgtgagagagcccccccccatctgcctggacgtgagacagaagcagagaaccagcatggacgccagcagcagcgagatgaaggcccccgtgctgcccgagcccatcctgcccatccagcccaagaccgtgaaggacttccaggaggacgtggagaaggtgaagagcagcggcgactggaaggccgtgcacgacttctacctgaccaccttcgacagcttccccgagctgaacgccgccttcaagaaggacgccaccgccagcttcaacaccatcgaggacagcggcatcaacgccaagttcgtgaacgccgtgtacgacaccctgctgaacaccccccaggacgtgcagaagaccgtgctgaagggcatcatcaacagcctgctgagagagtggaagggccccagaaccaaggacgacctgagagcctacttcatcctgctgcagaacccccagttcaacaacaccagcacctacgtgatctacgcccacctgctgagacagatcgccaccctggtggaggccgaccaccacttcctggtgcactggttcaagaagcagtacagcagactgagccagaagagattcaagcagctggtggagagactgctgcagttcatcagcctgagactgttccccgccaagcccgaggagttcccccccatcaccaagtgcagctggtggatccccagcgccgccaaggtgctggccctgctgaacaccgccaacaacctggtgcacccccccctgatcccctacaccgacttctacaacagcaccctggaccacatcgacctgatggaggagtaccacacctggcagaacttcggcaacagccacagattcagcttctgccagtaccccttcgtgatcagcgtggccgccaagaagatcatcatccagagagacagcgagcagcagatgatcaacatcgccagacagagcctggtggacaaggtgagcagaagacagagacccgacatgaacatcctgttcctgaacatgaaggtgagaagaacccacctggtgagcgacagcctggacgagctgaccagaaagagagccgacctgaagaagaagctgaaggtgaccttcgtgggcgaggccggcctggacatgggcggcctgaccaaggagtggttcctgctgctgatcagacagatcttccaccccgactacggcatgttcacctaccacaaggacagccactgccactggttcagcagcttcaagtgcgacaactacagcgagttcagactggtgggcatcctgatgggcctggccgtgtacaacagcatcaccctggacatcagattccccccctgctgctacaagaagctgctgagcccccccatcatccccagcgaccagaacatccccgtgggcatctgcaacgtgaccgtggacgacctgtgccagatcatgcccgagctggcccacggcctgagcgagctgctgagccacgagggcaacgtggaggaggacttctacagcaccttccaggtgttccaggaggagttcggcatcatcaagagctacaacctgaagcccggcggcgacaagatcagcgtgaccaaccagaacagaaaggagtacgtgcagctgtacaccgacttcctgctgaacaagagcatctacaagcagttcgccgccttctactacggcttccacagcgtgtgcgccagcaacgccctgatgctgctgagacccgaggaggtggagatcctggtgtgcggcagccccgacctggacatgcacgccctgcagagaagcacccagtacgacggctacgccaagaccgacctgaccatcaagtacttctgggacgtggtgctgggcttccccctggacctgcagaagaagctgctgcacttcaccaccggcagcgacagagtgcccgtgggcggcatggccgacctgaacttcaagatcagcaagaacgagaccagcaccaactgcctgcccgtggcccacacctgcttcaaccagctgtgcctgcccccctacaagagcaagaaggacctgaagcagaagctgatcatcggcatcagcaacagcgagggcttcggcctggagtag

SEQ ID NO: 21720 - DNA, 1098 bp, Artificial Sequence
  Description of Artificial Sequence: Synthetic coding sequence
atgaacatcctgttcctgaacatgaaggtgagaagaacccacctggtgagcgacagcctggacgagctgaccagaaagagagccgacctgaagaagaagctgaaggtgaccttcgtgggcgaggccggcctggacatgggcggcctgaccaaggagtggttcctgctgctgatcagacagatcttccaccccgactacggcatgttcacctaccacaaggacagccactgccactggttcagcagcttcaagtgcgacaactacagcgagttcagactggtgggcatcctgatgggcctggccgtgtacaacagcatcaccctggacatcagattccccccctgctgctacaagaagctgctgagcccccccatcatccccagcgaccagaacatccccgtgggcatctgcaacgtgaccgtggacgacctgtgccagatcatgcccgagctggcccacggcctgagcgagctgctgagccacgagggcaacgtggaggaggacttctacagcaccttccaggtgttccaggaggagttcggcatcatcaagagctacaacctgaagcccggcggcgacaagatcagcgtgaccaaccagaacagaaaggagtacgtgcagctgtacaccgacttcctgctgaacaagagcatctacaagcagttcgccgccttctactacggcttccacagcgtgtgcgccagcaacgccctgatgctgctgagacccgaggaggtggagatcctggtgtgcggcagccccgacctggacatgcacgccctgcagagaagcacccagtacgacggctacgccaagaccgacctgaccatcaagtacttctgggacgtggtgctgggcttccccctggacctgcagaagaagctgctgcacttcaccaccggcagcgacagagtgcccgtgggcggcatggccgacctgaacttcaagatcagcaagaacgagaccagcaccaactgcctgcccgtggcccacacctgcttcaaccagctgtgcctgcccccctacaagagcaagaaggacctgaagcagaagctgatcatcggcatcagcaacagcgagggcttcggcctggagtag

SEQ ID NO: 21721 - DNA, 3306 bp, Artificial Sequence
  Description of Artificial Sequence: Synthetic coding sequence
atggacgagtgcggcagcagaatcagaagaagagtgagcctgcccaagagaaacagacccagcctgggctgcatcttcggcgcccccaccgccgccgagctggtgcccggcgacgagggcaaggaggaggaggagatggtggccgagaacagaagaagaaagaccgccggcgtgctgcccgtggaggtgcagcccctgctgctgagcgacagccccgagtgcctggtgctgggcggcggcgacaccaaccccgacctgctgagacacatgcccaccgacagaggcgtgggcgaccagcccaacgacagcgaggtggacatgttcggcgactacgacagcttcaccgagaacagcttcatcgcccaggtggacgacctggagcagaagtacatgcagctgcccgagcacaagaagcacgccaccgacttcgccaccgagaacctgtgcagcgagagcatcaagaacaagctgagcatcaccaccatcggcaacctgaccgagctgcagaccgacaagcacaccgagaaccagagcggctacgagggcgtgaccatcgagcccggcgccgacctgctgtacgacgtgcccagcagccaggccatctacttcgagaacctgcagaacagcagcaacgacctgggcgaccacagcatgaaggagagagactggaagagcagcagccacaacaccgtgaacgaggagctgccccacaactgcatcgagcagccccagcagaacgacgagagcagcagcaaggtgagaaccagcagcgacatgaacagaagaaagagcatcaaggaccacctgaagaacgccatgaccggcaacgccaaggcccagacccccatcttcagcagaagcaagcagctgaaggacaccctgctgagcgaggagatcaacgtggccaagaagaccgtggagagcagcagcaacgacctgggccccttctacagcctgcccagcaaggtgagagacctgtacgcccagttcaagggcatcgagaagctgtacgagtggcagcacacctgcctgaccctgaacagcgtgcaggagagaaagaacctgatctacagcctgcccaccagcggcggcaagaccctggtggccgagatcctgatgctgcaggagctgctgtgctgcagaaaggacgtgctgatgatcctgccctacgtggccatcgtgcaggagaagatcagcggcctgagcagcttcggcatcgagctgggcttcttcgtggaggagtacgccggcagcaagggcagattcccccccaccaagagaagagagaagaagagcctgtacatcgccaccatcgagaagggccacagcctggtgaacagcctgatcgagaccggcagaatcgacagcctgggcctggtggtggtggacgagctgcacatgatcggcgagggcagcagaggcgccaccctggagatgaccctggccaagatcctgtacaccagcaagaccacccagatcatcggcatgagcgccaccctgaacaacgtggaggacctgcagaagttcctgcaggccgagtactacaccagccagttcagacccgtggagctgaaggagtacctgaagatcaacgacaccatctacgaggtggacagcaaggccgagaacggcatgaccttcagcagactgctgaactacaagtacagcgacaccctgaagaagatggaccccgaccacctggtggccctggtgaccgaggtgatccccaactacagctgcctggtgttctgccccagcaagaagaactgcgagaacgtggccgagatgatctgcaagttcctgagcaaggagtacctgaagcacaaggagaaggagaagtgcgaggtgatcaagaacctgaagaacatcggcaacggcaacctgtgccccgtgctgaagagaaccatccccttcggcgtggcctaccaccacagcggcctgaccagcgacgagagaaagctgctggaggaggcctacagcaccggcgtgctgtgcctgttcacctgcaccagcaccctggccgccggcgtgaacctgcccgccagaagagtgatcctgagagccccctacgtggccaaggagttcctgaagagaaaccagtacaagcagatgatcggcagagccggcagagccggcatcgacaccatcggcgagagcatcctgatcctgcaggagaaggacaagcagcaggtgctggagctgatcaccaagcccctggagaactgctacagccacctggtgcaggagttcaccaagggcatccagaccctgttcctgagcctgatcggcctgaagatcgccaccaacctggacgacatctaccacttcatgaacggcaccttcttcggcgtgcagcagaaggtgctgctgaaggagaagagcctgtgggagatcaccgtggagagcctgagatacctgaccgagaagggcctgctgcagaaggacaccatctacaagagcgaggaggaggtgcagtacaacttccacatcaccaagctgggcagagccagcttcaagggcaccatcgacctggcctactgcgacatcctgtacagagacctgaagaagggcctggagggcctggtgctggagagcctgctgcacctgatctacctgaccaccccctacgacctggtgagccagtgcaaccccgactggatgatctacttcagacagttcagccagctgagccccgccgagcagaacgtggccgccatcctgggcgtgagcgagagcttcatcggcaagaaggccagcggccaggccatcggcaagaaggtggacaagaacgtggtgaacagactgtacctgagcttcgtgctgtacaccctgctgaaggagaccaacatctggaccgtgagcgagaagttcaacatgcccagaggctacatccagaacctgctgaccggcaccgccagcttcagcagctgcgtgctgcacttctgcgaggagctggaggagttctgggtgtacagagccctgctggtggagctgaccaagaagctgacctactgcgtgaaggccgagctgatccccctgatggaggtgaccggcgtgctggagggcagagccaagcagctgtacagcgccggctacaagagcctgatgcacctggccaacgccaaccccgaggtgctggtgagaaccatcgaccacctgagcagaagacaggccaagcagatcgtgagcagcgccaagatgctgctgcacgagaaggccgaggccctgcaggaggaggtggaggagctgctgagactgcccagcgacttccccggcgccgtggccagcagcaccgacaaggcctag

SEQ ID NO: 21722 - DNA, 546 bp, Artificial Sequence
  Description of Artificial Sequence: Synthetic coding sequence
atgaccaccaccaccaccttcaagggcgtggaccccaacagcagaaacagcagcagagtgctgagaccccccggcggcggcagcaacttcagcctgggcttcgacgagcccaccgagcagcccgtgagaaagaacaagatggccagcaacatcttcggcacccccgaggagaaccaggccagctgggccaagagcgccggcgccaagagcagcggcggcagagaggacctggagagcagcggcctgcagagaagaaacagcagcgaggccagcagcggcgacttcctggacctgaagaagatgtggacccagacctgccaggccgcctggggcagagtgaagagaagcccctgcctgctgagactgtgccccgccagatggcccagaccccagtgccaccccgaggagatccccctggccgccagccccgccagcagctgggtgagcagcgactgccccgagagatgcagaagcgtgtgcttcctgcacgcctgcgagctgcacaacctgagcctgaccgtgcacctgctggacctgttccactag

SEQ ID NO: 21723 - DNA, 327 bp, Artificial Sequence
  Description of Artificial Sequence: Synthetic coding sequence
atggccagcaacatcttcggcacccccgaggagaaccaggccagctgggccaagagcgccggcgccaagagcagcggcggcagagaggacctggagagcagcggcctgcagagaagaaacagcagcgaggccagcagcggcgacttcctggacctgaagaccagcggcggcaagatcgagaacgtggacaccgacctgcccggcagcctgggccagagcgaggagaagcccgtgcccgccgcccccgtgcccagccccgtggcccccgcccccgtgcccagcagaagaaacccccccggcggcaagagcagcctggtgctgggctag

SEQ ID NO: 21724 - DNA, 327 bp, Artificial Sequence
  Description of Artificial Sequence: Synthetic coding sequence
atggccagcaacatcttcggcacccccgaggagaaccaggccagctgggccaagagcgccggcgccaagagcagcggcggcagagaggacctggagagcagcggcctgcagagaagaaacagcagcgaggccagcagcggcgacttcctggacctgaagggcgagggcgacatccacgagaacgtggacaccgacctgcccggcagcctgggccagagcgaggagaagcccgtgcccgccgcccccgtgcccagccccgtggcccccgcccccgtgcccagcagaagaaacccccccggcggcaagagcagcctggtgctgggctag

SEQ ID NO: 21725 - DNA, 465 bp, Artificial Sequence
  Description of Artificial Sequence: Synthetic coding sequence
atgaccaccaccaccaccttcaagggcgtggaccccaacagcagaaacagcagcagagtgctgagaccccccggcggcggcagcaacttcagcctgggcttcgacgagcccaccgagcagcccgtgagaaagaacaagatggccagcaacatcttcggcacccccgaggagaaccaggccagctgggccaagagcgccggcgccaagagcagcggcggcagagaggacctggagagcagcggcctgcagagaagaaacagcagcgaggccagcagcggcgacttcctggacctgaagggcgagggcgacatccacgagaacgtggacaccgacctgcccggcagcctgggccagagcgaggagaagcccgtgcccgccgcccccgtgcccagccccgtggcccccgcccccgtgcccagcagaagaaacccccccggcggcaagagcagcctggtgctgggctag

SEQ ID NO: 21726 - DNA, 198 bp, Artificial Sequence
  Description of Artificial Sequence: Synthetic coding sequence
atgcagagcgaggtgcagagacagcccgacagaagcatccagaaccccctgaccgtgggcagccacaccccctgcctgaccccccccaccatgagctgcaacaacagccaggtgtggtggtgcgtgcccgtggtgcccgccacctgggagcccgaggccggcggcagcctggagagcagcagcagcagactgcagtag

SEQ ID NO: 21727 - DNA, 663 bp, Artificial Sequence
  Description of Artificial Sequence: Synthetic coding sequence
atggccctgagcagcgtgggcagagcctggtgcccccccggcttcatcagacagaacggcgtgtgcaccgacctggacgagtgcagagtgagaaacctgtgccagcacgcctgcagaaacaccgagggcagctaccagtgcctgtgccccgccggctacagactgctgcccagcggcaagaactgccaggacatcaacgagtgcgaggaggagagcatcgagtgcggccccggccagatgtgcttcaacaccagaggcagctaccagtgcgtggacaccccctgccccgccacctacagacagggccccagccccggcacctgcttcagaagatgcagccaggactgcggcaccggcggccccagcaccctgcagtacagactgctgcccctgcccctgggcgtgagagcccaccacgacgtggccagactgaccgccttcagcgaggtgggcgtgcccgccaacagaaccgagctgagcatgctggagcccgaccccagaagccccttcgccctgagacccctgagagccggcctgggcgccgtgtacaccagaagagccctgaccagagccggcctgtacagactgaccgtgagagccgccgcccccagacaccagagcgtgttcgtgctgctgatcgccgtgagcccctacccctactag

SEQ ID NO: 21728 - DNA, 990 bp, Artificial Sequence
  Description of Artificial Sequence: Synthetic coding sequence
atgatggcccccgtggtgctgacctgccacagcaccggcatccccgcccccaccgtgagctggagcaaggccggcgcccagctgggcgccagaggcagcggctacagagtgagccccagcggcgccctggagatcggccaggccctgcccatccacgccggcagatacacctgcagcgccagaaacagcgccggcgtggcccacaagcacgtgttcctgaccgtgcaggccagccccgtggtgaagcccctgcccagcgtggtgagagccgtggccgaggaggaggtgctgctgccctgcgaggccagcggcatccccagacccaccatcacctggcagaaggagggcctgaacgtggccaccggcgtgagcacccaggtgctgcccggcggccagctgagaatcgcccacgccagccccgaggacgccggcaactacctgtgcatcgccaagaacagcgccggcagcgccatgggcaagaccagactggtggtgcaggtgccccccgtgatcgagaacggcctgcccgacctgagcaccaccgagggcagccacgccttcctgccctgcaaggccagaggcagccccgagcccaacatcacctgggacaaggacggccagcccgtgagcggcgccgagggcaagttcaccatccagcccagcggcgagctgctggtgaagaacctggagggccaggacgccggcacctacacctgcaccgccgagaacgccgtgggcagagccagaagaagagtgcacctgaccatcctggtgctgcccgtgttcaccaccctgcccggcgacagaagcctgagactgggcgacagactgtggctgagatgcgccgccagaggcagccccacccccagaatcggctggaccgtgaacgacagacccgtgaccggcctgggcctgctgggcatgggcggcaccgagagccaggacaccggcagactgagaagagagggcagatggggcgaccccacctag

SEQ ID NO: 21729 - DNA, 462 bp, Artificial Sequence
  Description of Artificial Sequence: Synthetic coding sequence
atgagaggcgccagcgccagaccccccctgctgggcagcgaggagcccttctgccccgccagcagaagcgtgagagagggcggcggcggcgtgagccccccccccggccagcccccctgccccgagggcagatggggcggccagccccccgccagacccgccgaccccagcggcagagaggtgggcggcagcgccccctgccccgccagcagacccgtgagagaggtgagaggcgccagcgccagaccccccctgctgggcagcgaggagcccctgtgccccgccagcagacccatctgggagggcggcggcggcgtgagcccccccccctgccagcccccctgccccggcggcagaggcgccagcgccagaccccccctgctgggcaacgaggagcccctgtgccccgccaccacccccagcggcagatgcacccagcagctggtggagaacggcccctag

SEQ ID NO: 21730 - DNA, 1866 bp, Artificial Sequence
  Description of Artificial Sequence: Synthetic coding sequence
atgagccccgtgttccccatgctgaccgtgctgaccatgttctactacatctgcctgagaagaagagccagaaccgccaccagaggcgagatgatgaacacccacagagccatcgagagcaacagccagaccagccccctgaacgccgaggtggtgcagtacgccaaggaggtggtggacttcagcagccactacggcagcgagaacagcatgagctacaccatgtggaacctggccggcgtgcccaacgtgttccccagcagcggcgacttcacccagaccgccgtgttcagaacctacggcacctggtgggaccagtgccccagcgccagcctgcccttcaagagaaccccccccaacttccagagccaggactacgtggagctgaccttcgagcagcaggtgtaccccaccgccgtgcacgtgctggagacctaccaccccggcgccgtgatcagaatcctggcctgcagcgccaacccctacagccccaacccccccgccgaggtgagatgggagatcctgtggagcgagagacccaccaaggtgaacgccagccaggccagacagttcaagccctgcatcaagcagatcaacttccccaccaacctgatcagactggaggtgaacagcagcctgctggagtactacaccgagctggacgccgtggtgctgcacggcgtgaaggacaagcccgtgctgagcctgaagaccagcctgatcgacatgaacgacatcgaggacgacgcctacgccgagaaggacggctgcggcatggacagcctgaacaagaagttcagcagcgccgtgctgggcgagggccccaacaacggctacttcgacaagctgccctacgagctgatccagctgatcctgaaccacctgaccctgcccgacctgtgcagactggcccagacctgcaagctgctgagccagcactgctgcgaccccctgcagtacatccacctgaacctgcagccctactgggccaagctggacgacaccagcctggagttcctgcagagcagatgcaccctggtgcagtggctgaacctgagctggaccggcaacagaggcttcatcagcgtggccggcttcagcagattcctgaaggtgtgcggcagcgagctggtgagactggagctgagctgcagccacttcctgaacgagacctgcctggaggtgatcagcgagatgtgccccaacctgcaggccctgaacctgagcagctgcgacaagctgcccccccaggccttcaaccacatcgccaagctgtgcagcctgaagagactggtgctgtacagaaccaaggtggagcagaccgccctgctgagcatcctgaacttctgcagcgagctgcagcacctgagcctgggcagctgcgtgatgatcgaggactacgacgtgatcgccagcatgatcggcgccaagtgcaagaagctgagaaccctggacctgtggagatgcaagaacatcaccgagaacggcatcgccgagctggccagcggctgccccctgctggaggagctggacctgggctggtgccccaccctgcagagcagcaccggctgcttcaccagactggcccaccagctgcccaacctgcagaagctgttcctgaccgccaacagaagcgtgtgcgacaccgacatcgacgagctggcctgcaactgcaccagactgcagcagctggacatcctgggcaccagaatggtgagccccgccagcctgagaaagctgctggagagctgcaaggacctgagcctgctggacgtgagcttctgcagccagatcgacaacagagccgtgctggagctgaacgccagcttccccaaggtgttcatcaagaagagcttcacccagtag

SEQ ID NO: 21731 - DNA, 756 bp, Artificial Sequence
  Description of Artificial Sequence: Synthetic coding sequence
atgagcgcctacggcatgcccatgtacaagagcggcgacctggtgttcgccaagctgaagggctacgcccactggcccgccagaatcgagcacatgacccagcccaacagataccaggtgttcttcttcggcacccacgagaccgccttcctgagccccaagagactgttcccctacaaggagtgcaaggagaagttcggcaagcccaacaagagaagaggcttcagcgccggcctgtgggagatcgagaacaaccccaccgtgcaggccagcgactgccccctggccagcgagaagggcagcggcgacggcccctggcccgagcccgaggccgccgagggcgacgaggacaagcccacccacgccggcggcggcggcgacgagctgggcaagcccgacgacgacaagcccaccgaggaggagaagggccccctgaagagaagcgccggcgacccccccgaggacgcccccaagagacccaaggaggccgcccccgaccaggaggaggaggccgaggccgagagagccgccgaggccgagagagccgccgccgccgccgccgccaccgccgtggacgaggagagccccttcctggtggccgtggagaacggcagcgcccccagcgagcccggcctggtgtgcgagcccccccagcccgaggaggaggagctgagagaggaggaggtggccgacgaggaggccagccaggagtggcacgccgaggcccccggcggcggcgacagagacagcctgtag

SEQ ID NO: 21732 - DNA, 345 bp, Artificial Sequence
  Description of Artificial Sequence: Synthetic coding sequence
atgttcggcgcctgctacaagcagcccctgaagcccagcggcagcgagccccccgccgaggagtgcagaatgacccccagacacgccggctgcgacgtgaccgagatgcagagaatcctgagccagcccaccttcaccgagcacctgctgagagccgtgtgcaccaagctggccaacatgtacagcaccagcaccgactgcagagagcactgcagaagaggcatgaaggccaagcagctgaaggccgaggccggcagaagctgccagagaaagggcgtgcccatccagacccccagagagcacagctggatcagctgcaagaaggagttcgaggccaacccctag

SEQ ID NO: 21733 - DNA, 231 bp, Artificial Sequence
  Description of Artificial Sequence: Synthetic coding sequence
atgttcggcgcctgctacaagcagcccctgaagcccagcggcagcgagccccccgccgaggagtgcagaatgacccccagacacgccggctgcgacgtgaccgagatgcagagaatcctgagccagcccaccttcaccgagcacctgctgagagccgtgctgagcaccgagagaggcccctaccccgaccccaagagagccttcctggacctgctgcaggagagaatctag

SEQ ID NO: 21734 - DNA, 366 bp, Artificial Sequence
  Description of Artificial Sequence: Synthetic coding sequence
atgttcggcgcctgctacaagcagcccctgaagcccagcggcagcgagccccccgccgaggagtgcagaatgacccccagacacgccggctgcgacgtgaccgagatgcagagaatcctgagccagcccaccttcaccgagcacctgctgagagccgtgtgcctggtgaacggcaagggcagcctgagcagaccccaggagagcatcctgggcagcctggccagaaagaacctgagaagaatccacagagtgagcctggtgatgtgcgtgagacccctgagccccagcaaggccatcatcagccccgtgacctgcatgtacaccagcagatggcccgaggccagcgaggagagccagaagaagtag

SEQ ID NO: 21735 - DNA, 465 bp, Artificial Sequence
  Description of Artificial Sequence: Synthetic coding sequence
atgttcggcgcctgctacaagcagcccctgaagcccagcggcagcgagccccccgccgaggagtgcagaatgacccccagacacgccggctgcgacgtgaccgagatgcagagaatcctgagccagcccaccttcaccgagcacctgctgagagccgtgtgcaccaagctggccaacatgtacagcaccagcaccgactgcagagagcactgcagaagaggcatgaaggccaagcagctgaaggccgaggccggcagaggcctggtgaacggcaagggcagcctgagcagaccccaggagagcatcctgggcagcctggccagaaagaacctgagaagaatccacagagtgagcctggtgatgtgcgtgagacccctgagccccagcaaggccatcatcagccccgtgacctgcatgtacaccagcagatggcccgaggccagcgaggagagccagaagaagtag

SEQ ID NO: 21736 - DNA, 345 bp, Artificial Sequence; identical to SEQ ID NO: 21732
  Description of Artificial Sequence: Synthetic coding sequence

SEQ ID NO: 21737 - DNA, 1350 bp, Artificial Sequence
  Description of Artificial Sequence: Synthetic coding sequence
atgatgctgagcaccgagggcagagagggcttcgtggtgaaggtgagaggcctgccctggagctgcagcgccgacgaggtgatgagattcttcagcgactgcaagatccagaacggcaccagcggcatcagattcatctacaccagagagggcagacccagcggcgaggccttcgtggagctggagagcgaggaggaggtgaagctggccctgaagaaggacagagagaccatgggccacagatacgtggaggtgttcaagagcaacagcgtggagatggactgggtgctgaagcacaccggccccaacagccccgacaccgccaacgacggcttcgtgagactgagaggcctgcccttcggctgcagcaaggaggagatcgtgcagttcttcagcggcctggagatcgtgcccaacggcatgaccctgcccgtggacttccagggcagaagcaccggcgaggccttcgtgcagttcgccagccaggagatcgccgagaaggccctgaagaagcacaaggagagaatcggccacagatacatcgagatcttcaagagcagcagagccgaggtgagaacccactacgacccccccagaaagctgatggccatgcagagacccggcccctacgacagacccggcgccggcagaggctacaacagcatcggcagaggcgccggcttcgagagaatgagaagaggcgcctacggcggcggctacggcggctacgacgactacggcggctacaacgacggctacggcttcggcagcgacagattcggcagagacctgaactactgcttcagcggcatgagcgaccacagatacggcgacggcggcagcagcttccagagcaccaccggccactgcgtgcacatgagaggcctgccctacagagccaccgagaacgacatctacaacttcttcagccccctgaaccccatgagagtgcacatcgagatcggccccgacggcagagtgaccggcgaggccgacgtggagttcgccacccacgaggacgccgtggccgccatggccaaggacaaggccaacatgcagcacagatacgtggagctgttcctgaacagcaccgccggcaccagcggcggcgcctacgaccacagctacgtggagctgttcctgaacagcaccgccggcgccagcggcggcgcctacggcagccagatgatgggcggcatgggcctgagcaaccagagcagctacggcggccccgccagccagcagctgagcggcggctacggcggcggctacggcggccagagcagcatgagcggctacgaccaggtgctgcaggagaacagcagcgactaccagagcaacctggcctag

SEQ ID NO: 21738 - DNA, 1656 bp, Artificial Sequence
  Description of Artificial Sequence: Synthetic coding sequence
atggacgagggcgtgaacttcaagcccaccgaggccggcagactgatggcctggtactacatcaccttcgagaccgtgaagaagttctacaccatcagcggcaaggagaccctgagcgacctggtgaccctgatcgccggctgcaaggagttcctggacatccagctgagaatcaacgagaagaagaccctgaacaccctgaacaaggaccccaacagaatcaccatcagattccccatggagggcagaatcaagaccagagagatgaaggtgaactgcctgatccaggcccagctgggctgcatccccatccaggacttcgccctgacccaggacaccgccaagatcttcagacacggcagcagaatcaccagatggctgagcgacttcgtggccgcccaggagaagaagttcgccgtgctgctgaacagcctgatcctggccaagtgcttcagatgcaagctgtgggagaacagcctgcacgtgagcaagcagctggagaagatcggcatcaccctgagcaacgccatcgtgaacgccggcctgaccagcttcaagaagatcgaggagaccgacgccagagagctggagctgatcctgaacagacacccccccttcggcacccagatcaaggagaccgtgatgtacctgcccaagtacgagctgaaggtggagcagatcaccagatacagcgacaccaccgccgagatcctggtgaccgtgatcctgagaaacttcgagcagctgcagaccaagagaaccgccagcgacagccactacgtgaccctgatcatcggcgacgccgacaaccaggtggtgtacctgcacaagatcaccgacagcgtgctgctgaaggccggcagctgggccaagaagatcgccgtgaagagagccctgaagagcgaggacctgagcatcaacctgatcagcagcgagttcgtgggcctggacatccagcagaagctgaccgtgttctacctggagcccaagagattcggcaaccagatcaccatgcagagaaagagcgagacccagatcagccacagcaagcacagcgacatcagcaccatcgccggccccaacaagggcaccaccgccagcaagaagcccggcaacagagagtgcaaccacctgtgcaagagcaagcacacctgcggccacgactgctgcaagatcggcgtggcccagaagagcgagatcaaggagagcaccatcagcagctacctgagcgacctgagaaacagaaacgccgtgagcagcgtgccccccgtgaagagactgaagatccagatgaacaagagccagagcgtggacctgaaggagttcggcttcacccccaagcccagcctgcccagcatcagcagaagcgagtacctgaacatcagcgagctgcccatcatggagcagtgggaccagcccgagatctacggcaaggtgagacaggagcccagcgagtaccaggacaaggaggtgctgaacgtgaacttcgagctgggcaacgaggtgtgggacgacttcgacgacgagaacctggaggtgaccagcttcagcaccgacaccgagaagaccaagatcagcgtgctgttccaccacatgagatgcagaatcttcctgtaccagatcctgctgtgccccagcagcgtgcaccccccctag

SEQ ID NO: 21739 - DNA, 2493 bp, Artificial Sequence
  Description of Artificial Sequence: Synthetic coding sequence
atgatcgcctgcttcctgtggaagatctgcttcctgaagaaccagatgaagctgaagatggcccccatcaaggccctgtgcagccagagattcgacgactggaaggagaagttcggccccatcggcctgaactgcaaggagctgaccggcgacaccgtgatggacgacctgttcgagatccagcacgcccacatcatcatgaccacccccgagaagtgggacagcatgaccagaaagtggagagacaacagcctggtgcagctggtgagactgttcctgatcgacgaggtgcacatcgtgaaggacgagaacagaggccccaccctggaggtggtggtgagcagaatgaagaccgtgcagagcgtgagccagaccctgaagaacaccagcaccgccatccccatgagattcgtggccgtgagcgccaccatccccaacgccgaggacatcgccgagtggctgagcgacggcgagagacccgccgtgtgcctgaagatggacgagagccacagacccgtgaagctgcagaaggtggtgctgggcttcccctgcagcagcaaccagaccgagttcaagttcgacctgaccctgaactacaagatcgccagcgtgatccagatgtacagcgaccagaagcccaccctggtgttctgcgccaccagaaagggcgtgcagcaggccgccagcgtgctggtgaaggacgccaagttcatcatgaccgtggagcagaagcagagactgcagaagtacgcctacagcgtgagagacagcaagctgagagacatcctgaaggacggcgccgcctaccaccacgccggcatggagctgagcgacagaaaggtggtggagggcgccttcaccgtgggcgacctgcccgtgctgttcaccaccagcaccctggccatgggcgtgaacctgcccgcccacctggtggtgatcaagagcaccatgcactacgccggcggcctgttcgaggagtacagcgagaccgacatcctgcagatgatcggcagagccggcagaccccagttcgacaccaccgccaccgccgtgatcatgaccagactgagcaccagagacaagtacatccagatgctggcctgcagagacaccgtggagagcagcctgcacagacacctgatcgagcacctgaacgccgagatcgtgctgcacaccatcaccgacgtgaacatcgccgtggagtggatcagaagcaccctgctgtacatcagagccctgaagaaccccagccactacggcttcgccagcggcctgaacaaggacggcatcgaggccaagctgcaggagctgtgcctgaagaacctgaacgacctgagcagcctggacctgatcaagatggacgagggcgtgaacttcaagcccaccgaggccggcagactgatggcctggtactacatcaccttcgagaccgtgaagaagttctacaccatcagcggcaaggagaccctgagcgacctggtgaccctgatcgccggctgcaaggagttcctggacatccagctgagaatcaacgagaagaagaccctgaacaccctgaacaaggaccccaacagaatcaccatcagattccccatggagggcagaatcaagaccagagagatgaaggtgaactgcctgatccaggcccagctgggctgcatccccatccaggacttcgccctgacccaggacaccgccaagatcttcagacacggcagcagaatcaccagatggctgagcgacttcgtggccgcccaggagaagaagttcgccgtgctgctgaacagcctgatcctggccaagtgcttcagatgcaagctgtgggagaacagcctgcacgtgagcaagcagctggagaagatcggcatcaccctgagcaacgccatcgtgaacgccggcctgaccagcttcaagaagatcgaggagaccgacgccagagagctggagctgatcctgaacagacacccccccttcggcacccagatcaaggagaccgtgatgtacctgcccaagtacgagctgaaggtggagcagatcaccagatacagcgacaccaccgccgagatcctggtgaccgtgatcctgagaaacttcgagcagctgcagaccaagagaaccgccagcgacagccactacgtgaccctgatcatcggcgacgccgacaaccaggtggtgtacctgcacaagatcaccgacagcgtgctgctgaaggccggcagctgggccaagaagatcgccgtgaagagagccctgaagagcgaggacctgagcatcaacctgatcagcagcgagttcgtgggcctggacatccagcagaagctgaccgtgttctacctggagcccaagagattcggcaaccagatcaccatgcagagaaagagcgagacccagatcagccacagcaagcacagcgacatcagcaccatcgccggccccaacaagggcaccaccgccagcaagacctgggagcccagaatgcagagcagcctgtag

SEQ ID NO: 21740 - DNA, 3345 bp, Artificial Sequence
  Description of Artificial Sequence: Synthetic coding sequence
atggaggtgcccctgccctggctgaacatcaagatcgtgtacatggcccccatcaaggccctgtgcagccagagattcgacgactggaaggagaagttcggccccatcggcctgaactgcaaggagctgaccggcgacaccgtgatggacgacctgttcgagatccagcacgcccacatcatcatgaccacccccgagaagtgggacagcatgaccagaaagtggagagacaacagcctggtgcagctggtgagactgttcctgatcgacgaggtgcacatcgtgaaggacgagaacagaggccccaccctggaggtggtggtgagcagaatgaagaccgtgcagagcgtgagccagaccctgaagaacaccagcaccgccatccccatgagattcgtggccgtgagcgccaccatccccaacgccgaggacatcgccgagtggctgagcgacggcgagagacccgccgtgtgcctgaagatggacgagagccacagacccgtgaagctgcagaaggtggtgctgggcttcccctgcagcagcaaccagaccgagttcaagttcgacctgaccctgaactacaagatcgccagcgtgatccagatgtacagcgaccagaagcccaccctggtgttctgcgccaccagaaagggcgtgcagcaggccgccagcgtgctggtgaaggacgccaagttcatcatgaccgtggagcagaagcagagactgcagaagtacgcctacagcgtgagagacagcaagctgagagacatcctgaaggacggcgccgcctaccaccacgccggcatggagctgagcgacagaaaggtggtggagggcgccttcaccgtgggcgacctgcccgtgctgttcaccaccagcaccctggccatgggcgtgaacctgcccgcccacctggtggtgatcaagagcaccatgcactacgccggcggcctgttcgaggagtacagcgagaccgacatcctgcagatgatcggcagagccggcagaccccagttcgacaccaccgccaccgccgtgatcatgaccagactgagcaccagagacaagtacatccagatgctggcctgcagagacaccgtggagagcagcctgcacagacacctgatcgagcacctgaacgccgagatcgtgctgcacaccatcaccgacgtgaacatcgccgtggagtggatcagaagcaccctgctgtacatcagagccctgaagaaccccagccactacggcttcgccagcggcctgaacaaggacggcatcgaggccaagctgcaggagctgtgcctgaagaacctgaacgacctgagcagcctggacctgatcaagatggacgagggcgtgaacttcaagcccaccgaggccggcagactgatggcctggtactacatcaccttcgagaccgtgaagaagttctacaccatcagcggcaaggagaccctgagcgacctggtgaccctgatcgccggctgcaaggagttcctggacatccagctgagaatcaacgagaagaagaccctgaacaccctgaacaaggaccccaacagaatcaccatcagattccccatggagggcagaatcaagaccagagagatgaaggtgaactgcctgatccaggcccagctgggctgcatccccatccaggacttcgccctgacccaggacaccgccaagatcttcagacacggcagcagaatcaccagatggctgagcgacttcgtggccgcccaggagaagaagttcgccgtgctgctgaacagcctgatcctggccaagtgcttcagatgcaagctgtgggagaacagcctgcacgtgagcaagcagctggagaagatcggcatcaccctgagcaacgccatcgtgaacgccggcctgaccagcttcaagaagatcgaggagaccgacgccagagagctggagctgatcctgaacagacacccccccttcggcacccagatcaaggagaccgtgatgtacctgcccaagtacgagctgaaggtggagcagatcaccagatacagcgacaccaccgccgagatcctggtgaccgtgatcctgagaaacttcgagcagctgcagaccaagagaaccgccagcgacagccactacgtgaccctgatcatcggcgacgccgacaaccaggtggtgtacctgcacaagatcaccgacagcgtgctgctgaaggccggcagctgggccaagaagatcgccgtgaagagagccctgaagagcgaggacctgagcatcaacctgatcagcagcgagttcgtgggcctggacatccagcagaagctgaccgtgttctacctggagcccaagagattcggcaaccagatcaccatgcagagaaagagcgagacccagatcagccacagcaagcacagcgacatcagcaccatcgccggccccaacaagggcaccaccgccagcaagaagcccggcaacagagagtgcaaccacctgtgcaagagcaagcacacctgcggccacgactgctgcaagatcggcgtggcccagaagagcgagatcaaggagagcaccatcagcagctacctgagcgacctgagaaacagaaacgccgtgagcagcgtgccccccgtgaagagactgaagatccagatgaacaagagccagagcgtggacctgaaggagttcggcttcacccccaagcccagcctgcccagcatcagcagaagcgagtacctgaacatcagcgagctgcccatcatggagcagtgggaccagcccgagatctacggcaaggtgagacaggagcccagcgagtaccaggacaaggaggtgctgaacgtgaacttcgagctgggcaacgaggtgtgggacgacttcgacgacgagaacctggaggtgaccagcttcagcaccgacaccgagaagaccaagatcagcggcttcggcaacaccctgagcagcagcaccagaggcagcaagctgcccctgcaggagagcaagagcaagttccagagagagatgagcaacagcttcgtgagcagccacgagatgagcgacatcagcctgagcaacagcgccatgcccaagttcagcgccagcagcatgaccaagctgccccagcaggccggcaacgccgtgatcgtgcacttccaggagagaaagccccagaacctgagccccgagatcgagaagcagtgcttcaccttcagcgagaagaaccccaacagcagcaactacaagaaggtggacttcttcatcagaaacagcgagtgcaagaaggaggtggacttcagcatgtaccaccccgacgacgaggccgacgagatgaagagcctgctgggcatcttcgacggcatcttctag

SEQ ID NO: 21741 - DNA, 4308 bp, Artificial Sequence
  Description of Artificial Sequence: Synthetic coding sequence
atgctgaagagcaacgactgcctgttcagcctggagaacctgttcttcgagaagcccgacgaggtggagaaccaccccgacaacgagaagagcctggactggttcctgccccccgcccccctgatcagcgagatccccgacacccaggagctggaggaggagctggagagccacaagctgctgggccaggagaagagacccaagatgctgaccagcaacctgaagatcaccaacgaggacaccaactacatcagcctgacccagaagttccagttcgccttccccagcgacaagtacgagcaggacgacctgaacctggagggcgtgggcaacaacgacctgagccacatcgccggcaagctgacctacgccagccagaagtacaagaaccacatcggcaccgagatcgcccccgagaagagcgtgcccgacgacaccaagctggtgaacttcgccgaggacaagggcgagagcaccagcgtgttcagaaagagactgttcaagatcagcgacaacatccacggcagcgcctacagcaacgacaacgagctggacagccacatcggcagcgtgaagatcgtgcagaccgagatgaacaagggcaagagcagaaactacagcaacagcaagcagaagttccagtacagcgccaacgtgttcaccgccaacaacgccttcagcgccagcgagatcggcgagggcatgttcaaggcccccagcttcagcgtggccttccagccccacgacatccaggaggtgaccgagaacggcctgggcagcctgaaggccgtgaccgagatccccgccaagttcagaagcatcttcaaggagttcccctacttcaactacatccagagcaaggccttcgacgacctgctgtacaccgacagaaacttcgtgatctgcgcccccaccggcagcggcaagaccgtggtgttcgagctggccatcaccagactgctgatggaggtgcccctgccctggctgaacatcaagatcgtgtacatggcccccatcaaggccctgtgcagccagagattcgacgactggaaggagaagttcggccccatcggcctgaactgcaaggagctgaccggcgacaccgtgatggacgacctgttcgagatccagcacgcccacatcatcatgaccacccccgagaagtgggacagcatgaccagaaagtggagagacaacagcctggtgcagctggtgagactgttcctgatcgacgaggtgcacatcgtgaaggacgagaacagaggccccaccctggaggtggtggtgagcagaatgaagaccgtgcagagcgtgagccagaccctgaagaacaccagcaccgccatccccatgagattcgtggccgtgagcgccaccatccccaacgccgaggacatcgccgagtggctgagcgacggcgagagacccgccgtgtgcctgaagatggacgagagccacagacccgtgaagctgcagaaggtggtgctgggcttcccctgcagcagcaaccagaccgagttcaagttcgacctgaccctgaactacaagatcgccagcgtgatccagatgtacagcgaccagaagcccaccctggtgttctgcgccaccagaaagggcgtgcagcaggccgccagcgtgctggtgaaggacgccaagttcatcatgaccgtggagcagaagcagagactgcagaagtacgcctacagcgtgagagacagcaagctgagagacatcctgaaggacggcgccgcctaccaccacgccggcatggagctgagcgacagaaaggtggtggagggcgccttcaccgtgggcgacctgcccgtgctgttcaccaccagcaccctggccatgggcgtgaacctgcccgcccacctggtggtgatcaagagcaccatgcactacgccggcggcctgttcgaggagtacagcgagaccgacatcctgcagatgatcggcagagccggcagaccccagttcgacaccaccgccaccgccgtgatcatgaccagactgagcaccagagacaagtacatccagatgctggcctgcagagacaccgtggagagcagcctgcacagacacctgatcgagcacctgaacgccgagatcgtgctgcacaccatcaccgacgtgaacatcgccgtggagtggatcagaagcaccctgctgtacatcagagccctgaagaaccccagccactacggcttcgccagcggcctgaacaaggacggcatcgaggccaagctgcaggagctgtgcctgaagaacctgaacgacctgagcagcctggacctgatcaagatggacgagggcgtgaacttcaagcccaccgaggccggcagactgatggcctggtactacatcaccttcgagaccgtgaagaagttctacaccatcagcggcaaggagaccctgagcgacctggtgaccctgatcgccggctgcaaggagttcctggacatccagctgagaatcaacgagaagaagaccctgaacaccctgaacaaggaccccaacagaatcaccatcagattccccatggagggcagaatcaagaccagagagatgaaggtgaactgcctgatccaggcccagctgggctgcatccccatccaggacttcgccctgacccaggacaccgccaagatcttcagacacggcagcagaatcaccagatggctgagcgacttcgtggccgcccaggagaagaagttcgccgtgctgctgaacagcctgatcctggccaagtgcttcagatgcaagctgtgggagaacagcctgcacgtgagcaagcagctggagaagatcggcatcaccctgagcaacgccatcgtgaacgccggcctgaccagcttcaagaagatcgaggagaccgacgccagagagctggagctgatcctgaacagacacccccccttcggcacccagatcaaggagaccgtgatgtacctgcccaagtacgagctgaaggtggagcagatcaccagatacagcgacaccaccgccgagatcctggtgaccgtgatcctgagaaacttcgagcagctgcagaccaagagaaccgccagcgacagccactacgtgaccctgatcatcggcgacgccgacaaccaggtggtgtacctgcacaagatcaccgacagcgtgctgctgaaggccggcagctgggccaagaagatcgccgtgaagagagccctgaagagcgaggacctgagcatcaacctgatcagcagcgagttcgtgggcctggacatccagcagaagctgaccgtgttctacctggagcccaagagattcggcaaccagatcaccatgcagagaaagagcgagacccagatcagccacagcaagcacagcgacatcagcaccatcgccggccccaacaagggcaccaccgccagcaagaagcccggcaacagagagtgcaaccacctgtgcaagagcaagcacacctgcggccacgactgctgcaagatcggcgtggcccagaagagcgagatcaaggagagcaccatcagcagctacctgagcgacctgagaaacagaaacgccgtgagcagcgtgccccccgtgaagagactgaagatccagatgaacaagagccagagcgtggacctgaaggagttcggcttcacccccaagcccagcctgcccagcatcagcagaagcgagtacctgaacatcagcgagctgcccatcatggagcagtgggaccagcccgagatctacggcaaggtgagacaggagcccagcgagtaccaggacaaggaggtgctgaacgtgaacttcgagctgggcaacgaggtgtgggacgacttcgacgacgagaacctggaggtgaccagcttcagcaccgacaccgagaagaccaagatcagcggcttcggcaacaccctgagcagcagcaccagaggcagcaagctgcccctgcaggagagcaagagcaagttccagagagagatgagcaacagcttcgtgagcagccacgagatgagcgacatcagcctgagcaacagcgccatgcccaagttcagcgccagcagcatgaccaagctgccccagcaggccggcaacgccgtgatcgtgcacttccaggagagaaagccccagaacctgagccccgagatcgagaagcagtgcttcaccttcagcgagaagaaccccaacagcagcaactacaagaaggtggacttcttcatcagaaacagcgagtgcaagaaggaggtggacttcagcatgtaccaccccgacgacgaggccgacgagatgaagagcctgctgggcatcttcgacggcatcttctag

SEQ ID NO: 21742 - DNA, 417 bp, Artificial Sequence
  Description of Artificial Sequence: Synthetic coding sequence
atgctgaagagcaacgactgcctgttcagcctggagaacctgttcttcgagaagcccgacgaggtggagaaccaccccgacaacgagaagagcctggactggttcctgccccccgcccccctgatcagcgagatccccgacacccaggagctggaggaggagctggagagccacaagctgctgggccaggagaagagacccaagatgctgaccagcaacctgaagatcaccaacgaggacaccaactacatcagcctgacccagaagttccagttcgccttccccagcgacaagtacgagcaggacgacctgaacctggagggcgtgggcaacaacgacctgagccacatcgccggcaagctgacctacgccagccagaagtacaagaaccacatcggcaccgagatcgccccctag

SEQ ID NO: 21743 - DNA, 2187 bp, Artificial Sequence
  Description of Artificial Sequence: Synthetic coding sequence
agccaggcctggagaagcagcgagggcctgatcaacagaagaagcaccggcctgggcgccgtgagaagagagatctacgacaaggtgcagttcagcaccatgctgaagagcaacgactgcctgttcagcctggagaacctgttcttcgagaagcccgacgaggtggagaaccaccccgacaacgagaagagcctggactggttcctgccccccgcccccctgatcagcgagatccccgacacccaggagctggaggaggagctggagagccacaagctgctgggccaggagaagagacccaagatgctgaccagcaacctgaagatcaccaacgaggacaccaactacatcagcctgacccagaagttccagttcgccttccccagcgacaagtacgagcaggacgacctgaacctggagggcgtgggcaacaacgacctgagccacatcgccggcaagctgacctacgccagccagaagtacaagaaccacatcggcaccgagatcgcccccgagaagagcgtgcccgacgacaccaagctggtgaacttcgccgaggacaagggcgagagcaccagcgtgttcagaaagagactgttcaagatcagcgacaacatccacggcagcgcctacagcaacgacaacgagctggacagccacatcggcagcgtgaagatcgtgcagaccgagatgaacaagggcaagagcagaaactacagcaacagcaagcagaagttccagtacagcgccaacgtgttcaccgccaacaacgccttcagcgccagcgagatcggcgagggcatgttcaaggcccccagcttcagcgtggccttccagccccacgacatccaggaggtgaccgagaacggcctgggcagcctgaaggccgtgaccgagatccccgccaagttcagaagcatcttcaaggagttcccctacttcaactacatccagagcaaggccttcgacgacctgctgtacaccgacagaaacttcgtgatctgcgcccccaccggcagcggcaagaccgtggtgttcgagctggccatcaccagactgctgatggaggtgcccctgccctggctgaacatcaagatcgtgtacatggcccccatcaaggccctgtgcagccagagattcgacgactggaaggagaagttcggccccatcggcctgaactgcaaggagctgaccggcgacaccgtgatggacgacctgttcgagatccagcacgcccacatcatcatgaccacccccgagaagtgggacagcatgaccagaaagtggagagacaacagcctggtgcagctggtgagactgttcctgatcgacgaggtgcacatcgtgaaggacgagaacagaggccccaccctggaggtggtggtgagcagaatgaagaccgtgcagagcgtgagccagaccctgaagaacaccagcaccgccatccccatgagattcgtggccgtgagcgccaccatccccaacgccgaggacatcgccgagtggctgagcgacggcgagagacccgccgtgtgcctgaagatggacgagagccacagacccgtgaagctgcagaaggtggtgctgggcttcccctgcagcagcaaccagaccgagttcaagttcgacctgaccctgaactacaagatcgccagcgtgatccagatgtacagcgaccagaagcccaccctggtgttctgcgccaccagaaagggcgtgcagcaggccgccagcgtgctggtgaaggacgccaagttcatcatgaccgtggagcagaagcagagactgcagaagtacgcctacagcgtgagagacagcaagctgagagacatcctgaaggacggcgccgcctaccaccacgccggcatggagctgagcgacagaaaggtggtggagggcgccttcaccgtgggcgacctgcccgtgctgttcaccaccagcaccctggccatgggcgtgaacctgcccgcccacctggtggtgatcaagagcaccatgcactacgccggcggcctgttcgaggagtacagcgagaccgacatcctgcagatgatcggcagagccggcagaccccagttcgacaccaccgccaccgccgtgatcatgaccagactgagcaccagagacaagtacatccagatgctggcctgcagagacaccgtggagagcagactgcacgcccactag

SEQ ID NO: 21744 - DNA, 294 bp, Artificial Sequence
  Description of Artificial Sequence: Synthetic coding sequence
atgagcagcgacaaccagtggagcgccgacgaggacgagggccagctgagcagactgatcagaaagagcagagacagccccttcgtgcccatcggcatcgccggcttcgtgaccgtggtgagctgcggcctgtacaagctgaagtacagaagagaccagaagatgagcatccacctgatccacatgagagtggccgcccagggcttcgtggtgggcgccgtgaccctgggcgtgctgtacagcatgtacaaggactacatcagacccagattcttcagcgagagcaagaagtag

SEQ ID NO: 21745 - DNA, 603 bp, Artificial Sequence
  Description of Artificial Sequence: Synthetic coding sequence
atggccaagggcgaccccaagaagcccaagggcaagatgagcgcctacgccttcttcgtgcagacctgcagagaggagcacaagaagaagaaccccgaggtgcccgtgaacttcgccgagttcagcaagaagtgcagcgagagatggaagaccatgagcggcaaggagaagagcaagttcgacgagatggccaaggccgacaaggtgagatacgacagagagatgaaggactacggccccgccaagggcggcaagaagaagaaggaccccaacgcccccaagagaccccccagcggcttcttcctgttctgcagcgagttcagacccaagatcaagagcaccaaccccggcatcagcatcggcgacgtggccaagaagctgggcgagatgtggaacaacctgaacgacagcgagaagcagccctacatcaccaaggccgccaagctgaaggagaagtacgagaaggacgtggccgactacaagagcaagggcaagttcgacggcgccaagggccccgccaaggtggccagaaagaaggtggaggaggaggacgaggaggaggaggaggaggaggaggaggaggaggaggaggaggacgagtag

SEQ ID NO: 21746 - DNA, 267 bp, Artificial Sequence
  Description of Artificial Sequence: Synthetic coding sequence
atgcccaagagaaaggccaagggcgacgccaagggcgacaaggccaagagaagaagcaccagactgagcgccaagcccgccccccccaagccccagcccaagcccaagaaggcccccgccaagaagggcgagaagatccccaagggcaagaagggcaaggccgacgccggcaaggagggcaacaaccccgccgagaacggcgacgccaagaccgaccaggcccagaaggccgagggcgccggcgtggccaaggccagcgacgagtag

SEQ ID NO: 21747 - DNA, 576 bp, Artificial Sequence
  Description of Artificial Sequence: Synthetic coding sequence
atgggcaagaccaacagcaagctggcccccgaggtgctggaggacctggtgcagaacaccgagttcagcgagcaggagctgaagcagtggtacaagggcttcctgaaggactgccccagcggcatcctgaacctggaggagttccagcagctgtacatcaagttcttcccctacggcgacgccagcaagttcgcccagcacgccttcagaaccttcgacaagaacggcgacggcaccatcgacttcagagagttcatctgcgccctgagcgtgaccagcagaggcagcttcgagcagaagctgaactgggccttcgagatgtacgacctggacggcgacggcagaatcaccagactggagatgctggagatcatcgaggccatctacaagatggtgggcaccgtgatcatgatgagaatgaaccaggacggcctgaccccccagcagagagtggacaagatcttcaagaagatggaccaggacaaggacgaccagatcaccctggaggagttcaaggaggccgccaagagcgaccccagcatcgtgctgctgctgcagtgcgacatgcagaagtag

SEQ ID NO: 21748 - DNA, 552 bp, Artificial Sequence
  Description of Artificial Sequence: Synthetic coding sequence
atgggcaagaccaacagcaagctggcccccgaggtgctggaggacctggtgcagaacaccgagttcagcgagcaggagctgaaggactgccccagcggcatcctgaacctggaggagttccagcagctgtacatcaagttcttcccctacggcgacgccagcaagttcgcccagcacgccttcagaaccttcgacaagaacggcgacggcaccatcgacttcagagagttcatctgcgccctgagcgtgaccagcagaggcagcttcgagcagaagctgaactgggccttcgagatgtacgacctggacggcgacggcagaatcaccagactggagatgctggagatcatcgaggccatctacaagatggtgggcaccgtgatcatgatgagaatgaaccaggacggcctgaccccccagcagagagtggacaagatcttcaagaagatggaccaggacaaggacgaccagatcaccctggaggagttcaaggaggccgccaagagcgaccccagcatcgtgctgctgctgcagtgcgacatgcagaagtag

SEQ ID NO: 21749 - DNA, 1065 bp, Artificial Sequence
  Description of Artificial Sequence: Synthetic coding sequence
atggccgaggtgctgagaaccctggccggcaagcccaagtgccacgccctgagacccatgatcctgttcctgatcatgctggtgctggtgctgttcggctacggcgtgctgagccccagaagcctgatgcccggcagcctggagagaggcttctgcatggccgtgagagagcccgaccacctgcagagagtgagcctgcccagaatggtgtacccccagcccaaggtgctgaccccctgcagaaaggacgtgctggtggtgaccccctggctggcccccatcgtgtgggagggcaccttcaacatcgacatcctgaacgagcagttcagactgcagaacaccaccatcggcctgaccgtgttcgccatcaagaagtacgtggccttcctgaagctgttcctggagaccgccgagaagcacttcatggtgggccacagagtgcactactacgtgttcaccgaccagctggccgccgtgcccagagtgaccctgggcaccggcagacagctgagcgtgctggaggtgagagcctacaagagatggcaggacgtgagcatgagaagaatggagatgatcagcgacttctgcgagagaagattcctgagcgaggtggactacctggtgtgcgtggacgtggacatggagttcagagaccacgtgggcgtggagatcctgacccccctgttcggcaccctgcaccccggcttctacggcagcagcagagaggccttcacctacgagagaagaccccagagccaggcctacatccccaaggacgagggcgacttctactacctgggcggcttcttcggcggcagcgtgcaggaggtgcagagactgaccagagcctgccaccaggccatgatggtggaccaggccaacggcatcgaggccgtgtggcacgacgagagccacctgaacaagtacctgctgagacacaagcccaccaaggtgctgagccccgagtacctgtgggaccagcagctgctgggctggcccgccgtgctgagaaagctgagattcaccgccgtgcccaagaaccaccaggccgtgagaaacccctag

SEQ ID NO: 21750 - DNA, 126 bp, Artificial Sequence
  Description of Artificial Sequence: Synthetic coding sequence
ctggaggagcagcccgagtgcagagaggagaagagaggcagcctgcacgtgtggaagagcgagctggtggaggtggaggacgacgtgtacctgagacacagcagcagcctgacctacagactgtag

SEQ ID NO: 21751 - DNA, 3648 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctacgacagcgtgtacctgcaccccaacagctacagctgcgcctgcctggccagcggcagcgtgctgagactggtggacgccgtgctgggcgccgagatcagaaacggcatggccatcatcagaccccccggccaccacgcccagcacagcctgatggacggctactgcatgttcaaccacgtggccgtggccgccagatacgcccagcagaagcacagaatcagaagagtgctgatcgtggactgggacgtgcaccacggccagggcacccagttcaccttcgaccaggaccccagcgtgctgtacttcagcatccacagatacgagcagggcagattctggccccacctgaaggccagcaactggagcaccaccggcttcggccagggccagggctacaccatcaacgtgccctggaaccaggtgggcatgagagacgccgactacatcgccgccttcctgcacgtgctgctgcccgtggccctggagttccagccccagctggtgctggtggccgccggcttcgacgccctgcagggcgaccccaagggcgagatggccgccacccccgccggcttcgcccagctgacccacctgctgatgggcctggccggcggcaagctgatcctgagcctggagggcggctacaacctgagagccctggccgagggcgtgagcgccagcctgcacaccctgctgggcgacccctgccccatgctggagagccccggcgccccctgcagaagcgcccaggccagcgtgagctgcgccctggaggccctggagcccttctgggaggtgctggtgagaagcaccgagaccgtggagagagacaacatggaggaggacaacgtggaggagagcgaggaggagggcccctgggagccccccgtgctgcccatcctgacctggcccgtgctgcagagcagaaccggcctggtgtacgaccagaacatgatgaaccactgcaacctgtgggacagccaccaccccgaggtgccccagagaatcctgagaatcatgtgcagactggaggagctgggcctggccggcagatgcctgaccctgacccccagacccgccaccgaggccgagctgctgacctgccacagcgccgagtacgtgggccacctgagagccaccgagaagatgaagaccagagagctgcacagagagagcagcaacttcgacagcatctacatctgccccagcaccttcgcctgcgcccagctggccaccggcgccgcctgcagactggtggaggccgtgctgagcggcgaggtgctgaacggcgccgccgtggtgagaccccccggccaccacgccgagcaggacgccgcctgcggcttctgcttcttcaacagcgtggccgtggccgccagacacgcccagaccatcagcggccacgccctgagaatcctgatcgtggactgggacgtgcaccacggcaacggcacccagcacatgttcgaggacgaccccagcgtgctgtacgtgagcctgcacagatacgaccacggcaccttcttccccatgggcgacgagggcgccagcagccagatcggcagagccgccggcaccggcttcaccgtgaacgtggcctggaacggccccagaatgggcgacgccgactacctggccgcctggcacagactggtgctgcccatcgcctacgagttcaaccccgagctggtgctggtgagcgccggcttcgacgccgccagaggcgaccccctgggcggctgccaggtgagccccgagggctacgcccacctgacccacctgctgatgggcctggccagcggcagaatcatcctgatcctggagggcggctacaacctgaccagcatcagcgagagcatggccgcctgcaccagaagcctgctgggcgaccccccccccctgctgaccctgcccagaccccccctgagcggcgccctggccagcatcaccgagaccatccaggtgcacagaagatactggagaagcctgagagtgatgaaggtggaggacagagagggccccagcagcagcaagctggtgaccaagaaggccccccagcccgccaagcccagactggccgagagaatgaccaccagagagaagaaggtgctggaggccggcatgggcaaggtgaccagcgccagcttcggcgaggagagcacccccggccagaccaacagcgagaccgccgtggtggccctgacccaggaccagcccagcgaggccgccaccggcggcgccaccctggcccagaccatcagcgaggccgccatcggcggcgccatgctgggccagaccaccagcgaggaggccgtgggcggcgccacccccgaccagaccaccagcgaggagaccgtgggcggcgccatcctggaccagaccaccagcgaggacgccgtgggcggcgccaccctgggccagaccaccagcgaggaggccgtgggcggcgccaccctggcccagaccaccagcgaggccgccatggagggcgccaccctggaccagaccaccagcgaggaggcccccggcggcaccgagctgatccagacccccctggccagcagcaccgaccaccagaccccccccaccagccccgtgcagggcaccaccccccagatcagccccagcaccctgatcggcagcctgagaaccctggagctgggcagcgagagccagggcgccagcgagagccaggcccccggcgaggagaacctgctgggcgaggccgccggcggccaggacatggccgacagcatgctgatgcagggcagcagaggcctgaccgaccaggccatcttctacgccgtgacccccctgccctggtgcccccacctggtggccgtgtgccccatccccgccgccggcctggacgtgacccagccctgcggcgactgcggcaccatccaggagaactgggtgtgcctgagctgctaccaggtgtactgcggcagatacatcaacggccacatgctgcagcaccacggcaacagcggccaccccctggtgctgagctacatcgacctgagcgcctggtgctactactgccaggcctacgtgcaccaccaggccctgctggacgtgaagaacatcgcccaccagaacaagttcggcgaggacatgccccacccccactag

SEQ ID NO: 21752 - DNA, 312 bp, Artificial Sequence
  Description of Artificial Sequence: Synthetic coding sequence
atgagcggcagaggcaagggcggcaagggcctgggcaagggcggcgccaagagacacagaaaggtgctgagagacaacatccagggcatcaccaagcccgccatcagaagactggccagaagaggcggcgtgaagagaatcagcggcctgatctacgaggagaccagaggcgtgctgaaggtgttcctggagaacgtgatcagagacgccgtgacctacaccgagcacgccaagagaaagaccgtgaccgccatggacgtggtgtacgccctgaagagacagggcagaaccctgtacggcttcggcggctag

SEQ ID NO: 21753 - DNA, 312 bp, Artificial Sequence; identical to SEQ ID NO: 21752
  Description of Artificial Sequence: Synthetic coding sequence

SEQ ID NO: 21754 - DNA, 2145 bp, Artificial Sequence
  Description of Artificial Sequence: Synthetic coding sequence
atgcccgccgccgccggcgacggcctgctgggcgagcccgccgcccccggcggcggcggcggcgccgaggacgccgccagacccgccgccgcctgcgagggcagcttcctgcccgcctgggtgagcggcgtgcccagagagagactgagagacttccagcaccacaagagagtgggcaactacctgatcggcagcagaaagctgggcgagggcagcttcgccaaggtgagagagggcctgcacgtgctgaccggcgagaaggtggccatcaaggtgatcgacaagaagagagccaagaaggacacctacgtgaccaagaacctgagaagagagggccagatccagcagatgatcagacaccccaacatcacccagctgctggacatcctggagaccgagaacagctactacctggtgatggagctgtgccccggcggcaacctgatgcacaagatctacgagaagaagagactggaggagagcgaggccagaagatacatcagacagctgatcagcgccgtggagcacctgcacagagccggcgtggtgcacagagacctgaagatcgagaacctgctgctggacgaggacaacaacatcaagctgatcgacttcggcctgagcaactgcgccggcatcctgggctacagcgaccccttcagcacccagtgcggcagccccgcctacgccgcccccgagctgctggccagaaagaagtacggccccaagatcgacgtgtggagcatcggcgtgaacatgtacgccatgctgaccggcaccctgcccttcaccgtggagcccttcagcctgagagccctgtaccagaagatggtggacaaggagatgaaccccctgcccacccagctgagcaccggcgccatcagcttcctgagaagcctgctggagcccgaccccgtgaagagacccaacatccagcaggccctggccaacagatggctgaacgagaactacaccggcaaggtgccctgcaacgtgacctaccccaacagaatcagcctggaggacctgagccccagcgtggtgctgcacatgaccgagaagctgggctacaagaacagcgacgtgatcaacaccgtgctgagcaacagagcctgccacatcctggccatctacttcctgctgaacaagaagctggagagatacctgagcggcaagagcgacatccaggacagcctgtgctacaagaccagactgtaccagatcgagaagtacagagcccccaaggagagctacgaggccagcctggacacctggaccagagacctggagttccacgccgtgcaggacaagaagcccaaggagcaggagaagagaggcgacttcctgcacagacccttcagcaagaagctggacaagaacctgcccagccacaagcagcccagcggcagcctgatgacccagatccagaacaccaaggccctgctgaaggacagaaaggccagcaagagcagcttccccgacaaggacagcttcggctgcagaaacatcttcagaaagaccagcgacagcaactgcgtggccagcagcagcatggagttcatccccgtgcccccccccagaacccccagaatcgtgaagaagcccgagccccaccagcccggccccggcagcaccggcatcccccacaaggaggaccccctgatgctggacatggtgagaagcttcgagagcgtggacagagacgaccacgtggaggtgctgagccccagccaccactacagaatcctgaacagccccgtgagcctggccagaagaaacagcagcgagagaaccctgagccccggcctgcccagcggcagcatgagccccctgcacacccccctgcaccccaccctggtgagcttcgcccacgaggacaagaacagcccccccaaggaggagggcctgtgctgccccccccccgtgcccagcaacggccccatgcagcccctgggcagccccaactgcgtgaagagcagaggcagattccccatgatgggcatcggccagatgctgagaaagagacaccagagcctgcagcccagcgccgacagacccctggaggccagcctgccccccctgcagcccctggcccccgtgaacctggccttcgacatggccgacggcgtgaagacccagtgctag

SEQ ID NO: 21755 - DNA, 762 bp, Artificial Sequence
  Description of Artificial Sequence: Synthetic coding sequence
atgggcctgagccccggcgccgagggcgagtacgccctgagactgcccagaatccccccccccctgcccaagcccgccagcagaaccgccagcaccggccccaaggaccagccccccgccctgagaagaagcgccgtgccccacagcggcctgaacagcatcagccccctggagctggaggagagcgtgggcttcgccgccctggtgcagctgcccgccaagcagcccccccccggcaccctggagcagggcagaagcatccagcagggcgagaaggccgtggtgagcctggagaccacccccagccagaaggccgactggagcagcatccccaagcccgagaacgagggcaagctgatcaagcaggccgccgagggcaagcccagacccagacccggcgacctgatcgagatcttcagaatcggctacgagcactgggccatctacgtggaggacgactgcgtggtgcacctggccccccccagcgaggagttcgaggtgggcagcatcaccagcatcttcagcaacagagccgtggtgaagtacagcagactggaggacgtgctgcacggctgcagctggaaggtgaacaacaagctggacggcacctacctgcccctgcccgtggacaagatcatccagagaaccaagaagatggtgaacaagatcgtgcagtacagcctgatcgagggcaactgcagagccagacccgacggcagaagcgagggctgctggagcagctacttcagctgcagcggctag

SEQ ID NO: 21756 - DNA, 810 bp, Artificial Sequence
  Description of Artificial Sequence: Synthetic coding sequence
atgggcctgagccccggcgccgagggcgagtacgccctgagactgcccagaatccccccccccctgcccaagcccgccagcagaaccgccagcaccggccccaaggaccagccccccgccctgagaagaagcgccgtgccccacagcgaggagagcgtgggcttcgccgccctggtgcagctgcccgccaagcagcccccccccggcaccctggagcagggcagaagcatccagcagggcgagaaggccgtggtgagcctggagaccacccccagccagaaggccgactggagcagcatccccaagcccgagaacgagggcaagctgatcaagcaggccgccgagggcaagcccagacccagacccggcgacctgatcgagatcttcagaatcggctacgagcactgggccatctacgtggaggacgactgcgtggtgcacctggccccccccagcgaggagttcgaggtgggcagcatcaccagcatcttcagcaacagagccgtggtgaagtacagcagactggaggacgtgctgcacggctgcagctggaaggtgaacaacaagctggacggcacctacctgcccctgcccgtggacaagatcatccagagaaccaagaagatggtgaacaagatcgtgcagtacagcctgatcgagggcaactgcgagcacttcgtgaacggcctgagatacggcgtgcccagaagccagcaggtggagcacgccctgatggagggcgccaaggccgccggcgccgtgatcagcgccgtggtggacagcatcaagcccaagcccatcaccgcctag

SEQ ID NO: 21757 - DNA, 840 bp, Artificial Sequence
  Description of Artificial Sequence: Synthetic coding sequence
atgggcctgagccccggcgccgagggcgagtacgccctgagactgcccagaatccccccccccctgcccaagcccgccagcagaaccgccagcaccggccccaaggaccagccccccgccctgagaagaagcgccgtgccccacagcggcctgaacagcatcagccccctggagctggaggagagcgtgggcttcgccgccctggtgcagctgcccgccaagcagcccccccccggcaccctggagcagggcagaagcatccagcagggcgagaaggccgtggtgagcctggagaccacccccagccagaaggccgactggagcagcatccccaagcccgagaacgagggcaagctgatcaagcaggccgccgagggcaagcccagacccagacccggcgacctgatcgagatcttcagaatcggctacgagcactgggccatctacgtggaggacgactgcgtggtgcacctggccccccccagcgaggagttcgaggtgggcagcatcaccagcatcttcagcaacagagccgtggtgaagtacagcagactggaggacgtgctgcacggctgcagctggaaggtgaacaacaagctggacggcacctacctgcccctgcccgtggacaagatcatccagagaaccaagaagatggtgaacaagatcgtgcagtacagcctgatcgagggcaactgcgagcacttcgtgaacggcctgagatacggcgtgcccagaagccagcaggtggagcacgccctgatggagggcgccaaggccgccggcgccgtgatcagcgccgtggtggacagcatcaagcccaagcccatcaccgcctag

SEQ ID NO: 21758 - DNA, 2961 bp, Artificial Sequence
  Description of Artificial Sequence: Synthetic coding sequence
atggacagaatggccagcagcatgaagcaggtgcccaaccccctgcccaaggtgctgagcagaagaggcgtgggcgccggcctggaggccgccgagagagagagcttcgagagaacccagaccgtgagcatcaacaaggccatcaacacccaggaggtggccgtgaaggagaagcacgccagaacctgcatcctgggcacccaccacgagaagggcgcccagaccttctggagcgtggtgaacagactgcccctgagcagcaacgccgtgctgtgctggaagttctgccacgtgttccacaagctgctgagagacggccaccccaacgtgctgaaggacagcctgagatacagaaacgagctgagcgacatgagcagaatgtggggccacctgagcgagggctacggccagctgtgcagcatctacctgaagctgctgagaaccaagatggagtaccacaccaagaaccccagattccccggcaacctgcagatgagcgacagacagctggacgaggccggcgagagcgacgtgaacaacttcttccagctgaccgtggagatgttcgactacctggagtgcgagctgaacctgttccagaccgtgttcaacagcctggacatgagcagaagcgtgagcgtgaccgccgccggccagtgcagactggcccccctgatccaggtgatcctggactgcagccacctgtacgactacaccgtgaagctgctgttcaagctgcacagctgcctgcccgccgacaccctgcagggccacagagacagattcatggagcagttcaccaagctgaaggacctgttctacagaagcagcaacctgcagtacttcaagagactgatccagatcccccagctgcccgagaacccccccaacttcctgagagccagcgccctgagcgagcacatcagccccgtggtggtgatccccgccgaggccagcagccccgacagcgagcccgtgctggagaaggacgacctgatggacatggacgccagccagcagaacctgttcgacaacaagttcgacgacatcttcggcagcagcttcagcagcgaccccttcaacttcaacagccagaacggcgtgaacaaggacgagaaggaccacctgatcgagagactgtacagagagatcagcggcctgaaggcccagctggagaacatgaagaccgagagccagagagtggtgctgcagctgaagggccacgtgagcgagctggaggccgacctggccgagcagcagcacctgagacagcaggccgccgacgactgcgagttcctgagagccgagctggacgagctgagaagacagagagaggacaccgagaaggcccagagaagcctgagcgagatcgagagaaaggcccaggccaacgagcagagatacagcaagctgaaggagaagtacagcgagctggtgcagaaccacgccgacctgctgagaaagaacgccgaggtgaccaagcaggtgagcatggccagacaggcccaggtggacctggagagagagaagaaggagctggaggacagcctggagagaatcagcgaccagggccagagaaagacccaggagcagctggaggtgctggagagcctgaagcaggagctggccaccagccagagagagctgcaggtgctgcagggcagcctggagaccagcgcccagagcgaggccaactgggccgccgagttcgccgagctggagaaggagagagacagcctggtgagcggcgccgcccacagagaggaggagctgagcgccctgagaaaggagctgcaggacacccagctgaagctggccagcaccgaggagagcatgtgccagctggccaaggaccagagaaagatgctgctggtgggcagcagaaaggccgccgagcaggtgatccaggacgccctgaaccagctggaggagccccccctgatcagctgcgccggcagcgccgaccacctgctgagcaccgtgaccagcatcagcagctgcatcgagcagctggagaagagctggagccagtacctggcctgccccgaggacatcagcggcctgctgcacagcatcaccctgctggcccacctgaccagcgacgccatcgcccacggcgccaccacctgcctgagagccccccccgagcccgccgacagcctgaccgaggcctgcaagcagtacggcagagagaccctggcctacctggccagcctggaggaggagggcagcctggagaacgccgacagcaccgccatgagaaactgcctgagcaagatcaaggccatcggcgaggagctgctgcccagaggcctggacatcaagcaggaggagctgggcgacctggtggacaaggagatggccgccaccagcgccgccatcgagaccgccaccgccagaatcgagggcaccgccagccccaaggagttctacgccaagaacagcagatggaccgagggcctgatcagcgccagcaaggccgtgggctggggcgccaccgtgatggtggacgccgccgacctggtggtgcagggcagaggcaagttcgaggagctgatggtgtgcagccacgagatcgccgccagcaccgcccagctggtggccgccagcaaggtgaaggccgacaaggacagccccaacctggcccagctgcagcaggccagcagaggcgtgaaccaggccaccgccggcgtggtggccagcaccatcagcggcaagagccagatcgaggagaccgacaacatggacttcagcagcatgaccctgacccagatcaagagacaggagatggacagccaggtgagagtgctggagctggagaacgagctgcagaaggagagacagaagctgggcgagctgagaaagaagcactacgagctggccggcgtggccgagggctgggaggagggcaccgaggccagcccccccaccctgcaggaggtggtgaccgagaaggagtag

SEQ ID NO: 21759 - DNA, 1308 bp, Artificial Sequence
  Description of Artificial Sequence: Synthetic coding sequence
atggccgcccacctgctgcccatctgcgccctgttcctgaccctgctggacatggcccagggcttcagaggccccctgctgcccaacagacccttcaccaccgtgtggaacgccaacacccagtggtgcctggagagacacggcgtggacgtggacgtgagcgtgttcgacgtggtggccaaccccggccagaccttcagaggccccgacatgaccatcttctacagcagccagctgggcacctacccctactacacccccaccggcgagcccgtgttcggcggcctgccccagaacgccagcctgatcgcccacctggccagaaccttccaggacatcctggccgccatccccgcccccgacttcagcggcctggccgtgatcgactgggaggcctggagacccagatgggccttcaactgggacaccaaggacatctacagacagagaagcagagccctggtgcaggcccagcaccccgactggcccgccccccaggtggaggccgtggcccaggaccagttccagggcgccgccagagcctggatggccggcaccctgcagctgggcagagccctgagacccagaggcctgtggggcttctacggcttccccgactgctacaactacgacttcctgagccccaactacaccggccagtgccccagcggcatcagagcccagaacgaccagctgggctggctgtggggccagagcagagccctgtaccccagcatctacatgcccgccgtgctggagggcaccggcaagagccagatgtacgtgcagcacagagtggccgaggccttcagagtggccgtggccgccggcgaccccaacctgcccgtgctgccctacgtgcagatcttctacgacaccaccaaccacttcctgcccctggacgagctggagcacagcctgggcgagagcgccgcccagggcgccgccggcgtggtgctgtgggtgagctgggagaacaccagaaccaaggagagctgccaggccatcaaggagtacatggacaccaccctgggccccttcatcctgaacgtgaccagcggcgccctgctgtgcagccaggccctgtgcagcggccacggcagatgcgtgagaagaaccagccaccccaaggccctgctgctgctgaaccccgccagcttcagcatccagctgacccccggcggcggccccctgagcctgagaggcgccctgagcctggaggaccaggcccagatggccgtggagttcaagtgcagatgctaccccggctggcaggccccctggtgcgagagaaagagcatgtggtag

SEQ ID NO: 21760 - DNA, 1308 bp, Artificial Sequence; identical to SEQ ID NO: 21759
  Description of Artificial Sequence: Synthetic coding sequence

SEQ ID NO: 21761 - DNA, 1422 bp, Artificial Sequence
  Description of Artificial Sequence: Synthetic coding sequence
atgagagccggccccggccccaccgtgaccctggccctggtgctggccgtgagctgggccatggagctgaagcccaccgccccccccatcttcaccggcagacccttcgtggtggcctgggacgtgcccacccaggactgcggccccagactgaaggtgcccctggacctgaacgccttcgacgtgcaggccagccccaacgagggcttcgtgaaccagaacatcaccatcttctacagagacagactgggcctgtaccccagattcgacagcgccggcagaagcgtgcacggcggcgtgccccagaacgtgagcctgtgggcccacagaaagatgctgcagaagagagtggagcactacatcagaacccaggagagcgccggcctggccgtgatcgactgggaggactggagacccgtgtgggtgagaaactggcaggacaaggacgtgtacagaagactgagcagacagctggtggccagcagacaccccgactggccccccgacagaatcgtgaagcaggcccagtacgagttcgagttcgccgcccagcagttcatgctggagaccctgagatacgtgaaggccgtgagacccagacacctgtggggcttctacctgttccccgactgctacaaccacgactacgtgcagaactgggagagctacaccggcagatgccccgacgtggaggtggccagaaacgaccagctggcctggctgtgggccgagagcaccgccctgttccccagcgtgtacctggacgagaccctggccagcagcagacacggcagaaacttcgtgagcttcagagtgcaggaggccctgagagtggccagaacccaccacgccaaccacgccctgcccgtgtacgtgttcaccagacccacctacagcagaagactgaccggcctgagcgagatggacctgatcagcaccatcggcgagagcgccgccctgggcgccgccggcgtgatcctgtggggcgacgccggctacaccaccagcaccgagacctgccagtacctgaaggactacctgaccagactgctggtgccctacgtggtgaacgtgagctgggccacccagtactgcagcagagcccagtgccacggccacggcagatgcgtgagaagaaaccccagcgccagcaccttcctgcacctgagcaccaacagcttcagactggtgcccggccacgcccccggcgagccccagctgagacccgtgggcgagctgagctgggccgacatcgaccacctgcagacccacttcagatgccagtgctacctgggctggagcggcgagcagtgccagtgggaccacagacaggccgccggcggcgccagcgaggcctgggccggcagccacctgaccagcctgctggccctggccgccctggccttcacctggaccctgtag

SEQ ID NO: 21762 - DNA, 1422 bp, Artificial Sequence; identical to SEQ ID NO: 21761
  Description of Artificial Sequence: Synthetic coding sequence

SEQ ID NO: 21763 - DNA, 1164 bp, Artificial Sequence
  Description of Artificial Sequence: Synthetic coding sequence
atgaccacccagctgggccccgccctggtgctgggcgtggccctgtgcctgggctgcggccagcccctgccccaggtgcccgagagacccttcagcgtgctgtggaacgtgcccagcgcccactgcgaggccagattcggcgtgcacctgcccctgaacgccctgggcatcatcgccaacagaggccagcacttccacggccagaacatgaccatcttctacaagaaccagctgggcctgtacccctacttcggccccagaggcaccgcccacaacggcggcatcccccaggccctgcccctggacagacacctggccctggccgcctaccagatccaccacagcctgagacccggcttcgccggccccgccgtgctggactgggaggagtggtgccccctgtgggccggcaactggggcagaagaagagcctaccaggccgccagctgggcctgggcccagcaggtgttccccgacctggacccccaggagcagctgtacaaggcctacaccggcttcgagcaggccgccagagccctgatggaggacaccctgagagtggcccaggccctgagaccccacggcctgtggggcttctaccactaccccgcctgcggcaacggctggcacagcatggccagcaactacaccggcagatgccacgccgccaccctggccagaaacacccagctgcactggctgtgggccgccagcagcgccctgttccccagcatctacctgccccccagactgccccccgcccaccaccaggccttcgtgagacacagactggaggaggccttcagagtggccctggtgggccacagacaccccctgcccgtgctggcctacgtgagactgacccacagaagaagcggcagattcctgagccaggaggagtgctggcacctgcacgactacctggtggacaccctgggcccctacgtgatcaacgtgaccagagccgccatggcctgcagccaccagagatgccacggccacggcagatgcgccagaagagaccccggccagatggaggccttcctgcacctgtggcccgacggcagcctgggcgactggaagagcttcagctgccactgctactggggctgggccggccccacctgccaggagcccagacccggccccaaggaggccgtgtag

SEQ ID NO: 21764 - DNA, 612 bp, Artificial Sequence
  Description of Artificial Sequence: Synthetic coding sequence
atgaaggtgaaggtgatccccgtgctggaggacaactacatgtacctggtgatcgaggagctgaccagagaggccgtggccgtggacgtggccgtgcccaagagactgctggagatcgtgggcagagagggcgtgagcctgaccgccgtgctgaccacccaccaccactgggaccacgccagaggcaaccccgagctggccagactgagacccggcctggccgtgctgggcgccgacgagagaatcttcagcctgaccagaagactggcccacggcgaggagctgagagtgagcgccagaagcagagagggcagaggcggcagacccggcagcaccagaccccacagaagcgcctgcagcagcgccgccgtgagaggccaccccagagccctgccccccgacgccagaccccacagaagaccccacgagctgctgcccgtgggcggcagactgcccggccccaccagacccgtgctgggcagaagagccgtgggcggcagactgagactggtgcccggcggccagagacccgccgacgtgcccgagcccggcagagccggctaccccgcccccagagacgagggcgtgctgagacccagagcccacgcctag

SEQ ID NO: 21765 - DNA, 849 bp, Artificial Sequence
  Description of Artificial Sequence: Synthetic coding sequence
atgaaggtgaaggtgatccccgtgctggaggacaactacatgtacctggtgatcgaggagctgaccagagaggccgtggccgtggacgtggccgtgcccaagagactgctggagatcgtgggcagagagggcgtgagcctgaccgccgtgctgaccacccaccaccactgggaccacgccagaggcaaccccgagctggccagactgagacccggcctggccgtgctgggcgccgacgagagaatcttcagcctgaccagaagactggcccacggcgaggagctgagattcggcgccatccacgtgagatgcctgctgacccccggccacaccgccggccacatgagctacttcctgtgggaggacgactgccccgacccccccgccctgttcagcggcgacgccctgagcgtggccggctgcggcagctgcctggagggcagcgcccagcagatgtaccagagcctggccgagctgggcaccctgccccccgagaccaaggtgttctgcggccacgagcacaccctgagcaacctggagttcgcccagaaggtggagccctgcaacgaccacgtgagagccaagctgagctgggccaagaagagagacgaggacgacgtgcccaccgtgcccagcaccctgggcgaggagagactgtacaaccccttcctgagagtggccgaggagcccgtgagaaagttcaccggcaaggccgtgcccgccgacgtgctggaggccctgtgcaaggagagagccagattcgagcaggccggcgagcccagacagccccaggccagagccctgctggccctgcagtggggcctgctgagcgccgccccccacgactag

SEQ ID NO: 21766 - DNA, 609 bp, Artificial Sequence
  Description of Artificial Sequence: Synthetic coding sequence
atgaaggtgaaggtgatccccgtgctggaggacaactacatgtacctggtgatcgaggagctgaccagagaggccgtggccgtggacgtggccgtgcccaagagactgctggagatcgtgggcagagagggcgtgagcctgaccgccgtgctgaccacccaccaccactgggaccacgccagaggcaaccccgagctggccagactgagacccggcctggccgtgctgggcgccgacgagagaatcttcagcctgaccagaagactggcccacggcgaggagctgagattcggcgccatccacgtgagatgcctgctgacccccggccacaccgccggccacatgagctacttcctgtgggaggacgactgccccgacccccccgccctgttcagcggcaccagaagcgccgagagagcccaccccgccagcagaagacccagacccatctgcagcgacccccccagccccgccagaagaagagccgtgggcggcagactgagactggtgcccggcggccagagacccgccgacgtgcccgagcccggcagagccggctaccccgcccccagagacgagggcgtgctgagacccagagcccacgcctag

SEQ ID NO: 21767 - DNA, 507 bp, Artificial Sequence
  Description of Artificial Sequence: Synthetic coding sequence
atgttccccctgatcagcagccaccacctgtggtggggcggcctgagaagaaccgtgtgcctgaacctgcccgtgctgaccctgcagcacttccagcacatgcacatcaaggtgggcgacagagccgagctgagaagagccttcacccagaccgacgtggccaccttcagcgagctgaccggcgacgtgaaccccctgcacctgaacgaggacttcgccaagcacaccaagttcggcaacaccatcgtgcacggcgtgctgatcaacggcctgatcagcgccctgctgggcaccaagatgcccggccccggctgcgtgttcctgagccaggagatcagcttccccgcccccctgtacatcggcgaggtggtgctggccagcgccgaggtgaagaagctgaagagattcatcgccatcatcgccgtgagctgcagcgtgatcgagagcaagaagaccgtgatggagggctgggtgaaggtgatggtgcccgaggccagcaagagctag

SEQ ID NO: 21768 - DNA, 1164 bp, Artificial Sequence
  Description of Artificial Sequence: Synthetic coding sequence
atgaacagacaccacctgcaggaccacttcctggagatcgacaagaagaactgctgcgtgttcagagacgacttcatcgccaaggtgctgccccccgtgctgggcctggagttcatcttcggcctgctgggcaacggcctggccctgtggatcttctgcttccacctgaagagctggaagagcagcagaatcttcctgttcaacctggccgtggccgacttcctgctgatcatctgcctgcccttcgtgatggactactacgtgagaagaagcgactggaagttcggcgacatcccctgcagactggtgctgttcatgttcgccatgaacagacagggcagcatcatcttcctgaccgtggtggccgtggacagatacttcagagtggtgcacccccaccacgccctgaacaagatcagcaactggaccgccgccatcatcagctgcctgctgtggggcatcaccgtgggcctgaccgtgcacctgctgaagaagaagctgctgatccagaacggcaccgccaacgtgtgcatcagcttcagcatctgccacaccttcagatggcacgaggccatgttcctgctggagttcttcctgcccctgggcatcatcctgttctgcagcgccagaatcatctggagcctgagacagagacagatggacagacacgccaagatcaagagagccatcaccttcatcatggtggtggccatcgtgttcgtgatctgcttcctgcccagcgtggtggtgagaatccacatcttctggctgctgcacaccagcggcacccagaactgcgaggtgtacagaagcgtggacctggccttcttcatcaccctgagcttcacctacatgaacagcatgctggaccccgtggtgtactacttcagcagccccagcttccccaacttcttcagcaccctgatcaacagatgcctgcagagaaagatcaccggcgagcccgacaacaacagaagcaccagcgtggagctgaccggcgaccccaacaagaccagaggcgcccccgaggccctgatcgccaacagcggcgagccctggagccccagctacctgggccccaccagcaacaaccacagcaagaagggccactgccaccaggagcccgccagcctggagaagcagctgggctgctgcatcgagtag

SEQ ID NO: 21769 - DNA, 966 bp, Artificial Sequence
  Description of Artificial Sequence: Synthetic coding sequence
atgagcggcaacggcaacgccgccgccaccgccgaggagaacagccccaagatgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagatcctgcaccccgaggagtgcatgtacgccgtgggccaggagggcggctgcagcgtgcccgtggccgtgcacaccgccatgaaggacggccagctgtacctgaccggcggcgtgtggagcctggacggcagcgacagcatccaggagaccatgcaggccaccatccacgtgcccgcccagcacgaggacggccccgaggacgacccccagctggtgggcatcaccgccagaaacatccccagaggcccccagctggccgcccagaacctgggcatcagcctggccaacctgctgctgagcaagggcgccaagaacatcctggacgtggccagacagctgaacgacgcccactag

SEQ ID NO: 21770 - DNA, 1035 bp, Artificial Sequence
  Description of Artificial Sequence: Synthetic coding sequence
atgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagatcctgcaccccgaggagtgcatgtacgccgtgggccagggcgccctgggcgtggaggtgagagccaaggaccaggacatcctggacctggtgggcgtgctgcacgaccccgagaccctgctgagatgcatcgccgagagagccttcctgagacacctggagggcggctgcagcgtgcccgtggccgtgcacaccgccatgaaggacggccagctgtacctgaccggcggcgtgtggagcctggacggcagcgacagcatccaggagaccatgcaggccaccatccacgtgcccgcccagcacgaggacggccccgaggacgacccccagctggtgggcatcaccgccagaaacatccccagaggcccccagctggccgcccagaacctgggcatcagcctggccaacctgctgctgagcaagggcgccaagaacatcctggacgtggccagacagctgaacgacgcccactag

SEQ ID NO: 21771 - DNA, 915 bp, Artificial Sequence
  Description of Artificial Sequence: Synthetic coding sequence
atgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagatcctgcaccccgaggagtgcatgtacgccgtgggccaggagggcggctgcagcgtgcccgtggccgtgcacaccgccatgaaggacggccagctgtacctgaccggcggcgtgtggagcctggacggcagcgacagcatccaggagaccatgcaggccaccatccacgtgcccgcccagcacgaggacggccccgaggacgacccccagctggtgggcatcaccgccagaaacatccccagaggcccccagctggccgcccagaacctgggcatcagcctggccaacctgctgctgagcaagggcgccaagaacatcctggacgtggccagacagctgaacgacgcccactag

SEQ ID NO: 21772 - DNA, 834 bp, Artificial Sequence
  Description of Artificial Sequence: Synthetic coding sequence
atggcccccctgagattcagcgccaacctgagctggctgttccccgagctgagcggcctgcccgccagagtgagagccgccggcagcagcggcttcgaggccgtggaggtggcctggccctacgccgagacccccgaggccctggccagagccgccagagaggccggcctgagactggtgctgatcaacaccccccccggcgaccaggagaagggcgagatgggcctgggcgccgtgcccggcagacaggccgccttcagagagggcctggagcaggccgtgagatacgccaaggccctgggctgccccagaatccacctgatggccggcagagtgccccagggcgccgacagaatcgccgtgaaggccgagatggaggccgtgttcctggagaacctgagacacgccgccggcgtgctggcccaggaggacctggtgggcctgctggagcccatcaacaccagaatcaccgacccccagtacttcctggacaccccccagcaggccgccgccatcctgcagaaggtgggcagacccaacctgcagctgcagatggacatcttccactggcagatcatggacggcaacctgaccggcaacatcagagagttcctgcccatcgtgggccacgtgcaggtggcccaggtgcccggcagaggcgagcccagcagccccggcgagctgaacttcccctacctgttccagctgctggaggacgagggctacaagggcttcgtgggctgcgagtaccagcccagaggcgacaccgtggagggcctgagctggctgagaagctactgggacagaagaggccaccccgaggccggccagtag

SEQ ID NO: 21773 - DNA, 690 bp, Artificial Sequence
  Description of Artificial Sequence: Synthetic coding sequence
atgggcctgggcgccgtgcccggcagacaggccgccttcagagagggcctggagcaggccgtgagaagcggccactgcctgatgggcagaaagctgagcgtgccctgcaagggcgccgtggccagaggcggcctggtgtacctggccgccttcctgagactggacatgatccacctgatggccggcagagtgccccagggcgccgacagaatcgccgtgaaggccgagatggaggccgtgttcctggagaacctgagacacgccgccggcgtgctggcccaggaggacctggtgggcctgctggagcccatcaacaccagaatcaccgacccccagtacttcctggacaccccccagcaggccgccgccatcctgcagaaggtgggcagacccaacctgcagctgcagatggacatcttccactggcagatcatggacggcaacctgaccggcaacatcagagagttcctgcccatcgtgggccacgtgcaggtggcccaggtgcccggcagaggcgagcccagcagccccggcgagctgaacttcccctacctgttccagctgctggaggacgagggctacaagggcttcgtgggctgcgagtaccagcccagaggcgacaccgtggagggcctgagctggctgagaagctactgggacagaagaggccaccccgaggccggccagtag

SEQ ID NO: 21774 - DNA, 615 bp, Artificial Sequence
  Description of Artificial Sequence: Synthetic coding sequence
atgggcctgggcgccgtgcccggcagacaggccgccttcagagagggcctggagcaggccgtgagatacgccaaggccctgggctgccccagaatccacctgatggccggcagagtgccccagggcgccgacagaatcgccgtgaaggccgagatggaggccgtgttcctggagaacctgagacacgccgccggcgtgctggcccaggaggacctggtgggcctgctggagcccatcaacaccagaatcaccgacccccagtacttcctggacaccccccagcaggccgccgccatcctgcagaaggtgggcagacccaacctgcagctgcagatggacatcttccactggcagatcatggacggcaacctgaccggcaacatcagagagttcctgcccatcgtgggccacgtgcaggtggcccaggtgcccggcagaggcgagcccagcagccccggcgagctgaacttcccctacctgttccagctgctggaggacgagggctacaagggcttcgtgggctgcgagtaccagcccagaggcgacaccgtggagggcctgagctggctgagaagctactgggacagaagaggccaccccgaggccggccagtag

SEQ ID NO: 21775 - DNA, 744 bp, Artificial Sequence
  Description of Artificial Sequence: Synthetic coding sequence
atggcccccctgagattcagcgccaacctgagctggctgttccccgagctgagcggcctgcccgccagagtgagagccgccggcagcagcggcttcgaggccgtggaggtggcctggccctacgccgagacccccgaggccctggccagagccgccagagaggccggcctgagactggtgctgatcaacaccccccccggcgaccaggagaagggcgagatgggcctgggcgccgtgcccggcagacaggccgccttcagagagggcctggagcaggccgtgagatacgccaaggccctgggctgccccagaatccacctgatggccggcagagtgccccagggcgccgacagaatcgccgtgaaggccgagatggaggccgtgttcctggagaacctgagacacgccgccggcgtgctggcccaggaggacctggtgggcctgctggagcccatcaacaccagaatcaccgacccccagtacttcctggacaccccccagcaggccgccgccatcctgcagaaggtgggcagacccaacctgcagctgcagatggacatcttccactggcagatcatggacggcaacctgaccggcaacatcagagagttcctgcccatcgtgggccacgtgcaggtggcccaggtgcccggcagaggcgagcccagcagccccggcgagctgaacttcccctacctgttccagctgctggaggacgagggctacaagggcttcgtgggctag

SEQ ID NO: 21776 - DNA, 909 bp, Artificial Sequence
  Description of Artificial Sequence: Synthetic coding sequence
atggcccccctgagattcagcgccaacctgagctggctgttccccgagctgagcggcctgcccgccagagtgagagccgccggcagcagcggcttcgaggccgtggaggtggcctggccctacgccgagacccccgaggccctggccagagccgccagagaggccggcctgagactggtgctgatcaacaccccccccggcgaccaggagaagggcgagatgggcctgggcgccgtgcccggcagacaggccgccttcagagagggcctggagcaggccgtgagaagcggccactgcctgatgggcagaaagctgagcgtgccctgcaagggcgccgtggccagaggcggcctggtgtacctggccgccttcctgagactggacatgatccacctgatggccggcagagtgccccagggcgccgacagaatcgccgtgaaggccgagatggaggccgtgttcctggagaacctgagacacgccgccggcgtgctggcccaggaggacctggtgggcctgctggagcccatcaacaccagaatcaccgacccccagtacttcctggacaccccccagcaggccgccgccatcctgcagaaggtgggcagacccaacctgcagctgcagatggacatcttccactggcagatcatggacggcaacctgaccggcaacatcagagagttcctgcccatcgtgggccacgtgcaggtggcccaggtgcccggcagaggcgagcccagcagccccggcgagctgaacttcccctacctgttccagctgctggaggacgagggctacaagggcttcgtgggctgcgagtaccagcccagaggcgacaccgtggagggcctgagctggctgagaagctactgggacagaagaggccaccccgaggccggccagtag

SEQ ID NO: 21777 - DNA, 162 bp, Artificial Sequence
  Description of Artificial Sequence: Synthetic coding sequence
atgtgcagctactaccacatgaagaagagaagcgtgagcggctgcaacatcaccatcttcgccgtgatgttcagccacctgagcgccggcaagagcccctgcggcaaccaggccaacgtgctgtgcatcagcagactggagttcgtgcagtaccagagctag

SEQ ID NO: 21778 - DNA, 1011 bp, Artificial Sequence
  Description of Artificial Sequence: Synthetic coding sequence
atgcccccccccgcccccggcgccagactgagactgctggccgccgccgccctggccggcctggccgtgatcagcagaggcctgctgagccagagcctggagttcaacagccccgccgacaactacaccgtgtgcgagggcgacaacgccaccctgagctgcttcatcgacgagcacgtgaccagagtggcctggctgaacagaagcaacatcctgtacgccggcaacgacagatggaccagcgaccccagagtgagactgctgatcaacacccccgaggagttcagcatcctgatcaccgaggtgggcctgggcgacgagggcctgtacacctgcagcttccagaccagacaccagccctacaccacccaggtgtacctgatcgtgcacgtgcccgccagaatcgtgaacatcagcagccccgtgaccgtgaacgagggcggcaacgtgaacctgctgtgcctggccgtgggcagacccgagcccaccgtgacctggagacagctgagagacggcttcaccagcgagggcgagatcctggagatcagcgacatccagagaggccaggccggcgagtacgagtgcgtgacccacaacggcgtgaacagcgcccccgacagcagaagagtgctggtgaccgtgaactacccccccaccatcaccgacgtgaccagcgccagaaccgccctgggcagagccgccctgctgagatgcgaggccatggccgtgccccccgccgacttccagtggtacaaggacgacagactgctgagcagcggcaccgccgagggcctgaaggtgcagaccgagagaaccagaagcatgctgctgttcgccaacgtgagcgccagacactacggcaactacacctgcagagccgccaacagactgggcgccagcagcgccagcatgagactgctgagacccggcagcctggagaacagcgcccccagaccccccggcctgctggccctgctgagcgccctgggctggctgtggtggagaatgtag

SEQ ID NO: 21779 - DNA, 1215 bp, Artificial Sequence
  Description of Artificial Sequence: Synthetic coding sequence
atggagtgcgccctggacgcccagagcctgatcagcatcagcctgagaaagatccacagcagcagaacccagagaggcggcatcaagctgcacaagaacctgctggtgagctacgtgctgagaaacgccagacagctgtacctgagcgagagatacgccgagctgtacagaagacagcagcagcagcagcagcagcagcccccccaccaccagcaccagcacctggcctacgccgcccccggcatgcccgccagcgccgccgacttcggccccctgcagctgggcggcggcggcgacgccgaggccagagagcccgccgccagacaccagctgcaccagctgcaccagctgcaccagctgcacctgcagcagcagctgcaccagcaccagcaccccgcccccagaggctgcgccgccgccgccgccgccggcgcccccgccggcggcgccggcgccctgagcgagctgcccggctgcgccgccctgcagcccccccacggcgccccccacagaggccagcccctggagcccctgcagcccggccccgcccccctgcccctgcccctgcccccccccgcccccgccgccctgtgccccagagaccccagagcccccgccgcctgcagcgccccccccggcgccgccccccccgccgccgccgccagcccccccgccagccccgcccccgccagcagccccggcttctacagaggcgcctaccccacccccagcgacttcggcctgcactgcagcagccagaccaccgtgctggacctggacacccacgtggtgaccaccgtggagaacggctacctgcaccaggactgctgcgccagcgcccactgcccctgctgcggccagggcgcccccggccccggcctggccagcgccgccggctgcaagagaaagtactaccccggccaggaggaggaggaggacgacgaggaggacgccggcggcctgggcgccgagccccccggcggcgcccccttcgccccctgcaagagagccagattcgaggacttctgccccgacagcagccccgacgccagcaacatcagcaacctgatcagcatcttcggcagcggcttcagcggcctggtgagcagacagcccgacagcagcgagcagcccccccccctgaacggccagctgtgcgccaagcaggccctggccagcctgggcgcctggaccagagccatcgtggccttctag

SEQ ID NO: 21780 - DNA, 1392 bp, Artificial Sequence
  Description of Artificial Sequence: Synthetic coding sequence
atggccaccagcaagctgcccgtggtgcccggcgaggaggagaacaccatcctgatggccaaggagagactggaggccctgagaaccgccttcgagagcggcgacctgccccaggccgccagccacctgcaggagctgctggccagcaccgagagcatcagactggaggtgggcgtgaccggcgagagcggcgccggcaagagcagcctgatcaacgccctgagaggcctggaggccgaggaccccggcgccgccctgaccggcgtgatggagaccaccatgcagcccagcccctacccccacccccagttccccgacgtgaccctgtgggacctgcccggcgccggcagccccggctgccccgccgacaagtacctgaagcaggtggacttcagcagatacgacttcttcctgctggtgagccccagaagatgcggcgccgtggagaccagactggccgccgagatcctgtgccagggcaagaagttctacttcgtgagaaccaaggtggacgaggacctggccgccaccagaacccagagacccagcggcttcagagaggccgccgtgctgcaggagatcagagaccactgcgccgagagactgagagaggccggcgtggccgaccccagaatcttcctggtgagcaacctgagccccgccagatacgacttccccaccctggtgagcacctgggagcacgacctgcccagccacagaagacacgccggcctgctgagcctgcccgacatcagcctggaggccctgcagaagaagaaggccatgctgcaggagcaggtgctgaagaccgccctggtgctgggcgtgatccaggccctgcccgtgcccggcctggccgccgcctacgacgacgccctgctgatccacagcctgagaggctaccacagaagcttcggcctggacgacgacagcctggccaagctggccgagcaggtgggcaagcaggccggcgacctgagaagcgtgatcagaagccccctggccaacgaggtgagccccgagaccgtgctgagactgtacagccagagcagcgacggcgccatgagagtggccagagccttcgagagaggcatccccgtgttcggcaccctggtggccggcggcatcagcttcggcgccgtgtacaccatgctgcagggctgcctgaacgagatggccgaggacgcccagagagtgagaatcaaggccctggaggacgacgagccccagcccgaggtgagcctggaggtggccagcgacaacggcgtggagaagggcggcagcggcgagggcggcggcgaggaggcccccctgagcacctgcagaaagctgggcctgctgctgaagtacatcctggacagctggaagaagcacgacagcgaggagaagtag

SEQ ID NO: 21781 - DNA, 1872 bp, Artificial Sequence
  Description of Artificial Sequence: Synthetic coding sequence
atgccccccccccagggcgacgtgaccgccctgttcctgggcccccccggcctgggcaagagcgccctgatcgccgccctgtgcgacaaggacgtggagaccctggaggcccccgagggcagacccgacagcggcgtgcccagcctgagagccgccggccccggcctgttcctgggcgagctgagctgcccccccgccgcccccggcccctgggccgccgaggccaacgtgctggtgctggtgctgcccggccccgagggcaacggcgagcccctggcccccgccctgggcgaggccgccctggccgccctggccagaggcacccccctgctggccgtgagaaacctgagacccggcgacagccagaccgccgcccaggccagagaccagaccgccgccctgctgaacagcgccggcctgggcgccgccgacctgttcgtgctgcccgccaactgcggcagcagcgacggctgcgaggagctggagagactgagagccgccctgcagagccaggccgaggccctgagaagactgctgccccccgcccaggacggcttcgaggtgctgggcgccgccgagctggaggccgtgagagaggccttcgagaccggcggcctggaggccgccctgagctgggtgagaagcggcctggagagactgggcagcgccagactggacctggccgtggccggcaaggccgacgtgggcctggtggtggacatgctgctgggcctggaccccggcgaccccggcgccgcccccgccagcgtgcccaccgcccccacccccttccccgcccccgagagacccaacgtggtgctgtggaccgtgcccctgggccacaccggcaccgccaccaccgccgccgccgccagccaccccacccactacgacgccctgatcctggtgacccccggcgcccccaccgagaaggactgggcccaggtgcaggccctgctgctgcccgacgcccccctggtgtgcgtgagaaccgacggcgagggcgaggaccccgagtgcctgggcgagggcaagatggagaaccccaagggcgagagcctgaagaacgccggcggcggcggcctggagaacgccctgagcaagggcagagagaagtgcagcgccggcagccagaaggccggcagcggcgagggccccggcaaggccggcagcgagggcctgcagcaggtggtgggcatgaagaagagcggcggcggcgacagcgagagagccgccgccctgagccccgaggacgagacctgggaggtgctggaggaggcccccccccccgtgttccccctgagacccggcggcctgcccggcctgtgcgagtggctgagaagagccctgccccccgcccaggccggcgccctgctgctggccctgccccccgccagccccagcgccgccagaaccaaggccgccgccctgagagccggcgcctggagacccgccctgctggccagcctggccgccgccgccgcccccctgcccggcctgggctgggcctgcgacgtggccctgctgagaggccagctggccgagtggagaagaggcctgggcctggagcccaccgccctggccagaagagagagagccctgggcctggccagcggcgagctggccgccagagcccacttccccggccccgtgaccagagccgaggtggaggccagactgggcgcctgggccggcgagggcaccgccggcggcgccgccctgggcgccctgagcttcctgtggcccgccggcggcgccgccgccaccggcggcctgggctacagagccgcccacggcgtgctgctgcaggccctggacgagatgagagccgacgccgaggccgtgctggccccccccgagcccgcccagtag

SEQ ID NO: 21782 - DNA, 3981 bp, Artificial Sequence
  Description of Artificial Sequence: Synthetic coding sequence
atgaccaccatccacagcagacagatgctgcaggagcacgtgagcatggagttcagcagcagcaccacccacgtgcagaccttcagccagaccaccaagatcgtgggcgaggaggtggtgagaagaaagagcagcagcatcgtggagttcttcagcctggtgaccagaagcagcaacatccccgccggcgacagcgtgcccgagttcgtggagaagccccagcccgtgaccgcccccgagggcgacaaggccgtgttcagagccagagtgcagggcaacgccaagccccacatcagctggaagagagagagcggcatccccatcaaggagagcgccaagatcttctacgacagcatcaacaaggagcacgtgctgaagctggagcccctgaccagcgacgacagcgacaactacaagtgcatcgccagcaacgaccacgccgacgccatctacaccgtgagcctgctggtgaccgagggccaggagaagatggacttcaagaagatgctgaagaagagagccccccccgcccccaagaagaagcagaagaaggtggccaacgagaaggagatgctggagatcctgagcaaggtgcccaagaaggacttcgagaaggtgtgcatggagtacggcttcaccgacttcagaggcctgctgagaaagctgaaggagatgaagaagaaggtggaggtggaggccatcagaatcctgaagcccctggaggacaaggagaccaaggtggacaccaccgtggtgttcgactgcatcatggagctgaaggaccccaacgtgaagatgatctggatcaagggcaccgagcccctgagaatccagtacagcctgggcaagtacgacgtgaagcagatgggcaccaagtacatgctggtgatcagcaacgtgaacatgaacgacgccggcatctacagcctgagcgtgggcgacaagagaatgagcgccgagctgaccgtgctggacgagcccctgaagttcctgggcgagatgaagcccgtgaaggtgaccgagagacagaccgccgtgttcgagatcagactgagcaagaaggagcccaacttcgtgtggaagttcaacggcaaggagctgaagagagacgacaagtacgagatcaccgtgagcgaggacggcctgacccacaccctgaagatcaaggacgccagactgagcgacagcggcgagttcagcgccgaggccggcaacctggtgcagaaggcccagctgaccgtggacagaatccccatcaagttcgtgagcaacctgaagaacgtgagagtgaaggagagaagcagagcctgcctggagtgcgagctgaccagcaaggacgtgaccctgagatggaagaaggacggccagctgctgatgcacggcaccaagtacagcatgaaccacgagggcaagagagccgagctgatcatcgaggacgcccagctgagcgacggcggcgagtacaccgtggtggccatgcaggacggcgaccccaccgagtactacagcaccgccatcgtgaccgtggaggagagactggccaccgtgaagagcggcatgagcgacgtgcacgccgccaccggcagccccgccgagctgtgcgtggtgctgaacgacgagaaggtggagggcgtgtggctgaaggacggcaaggagatcaccgacctgcccggcatgcagatcgtgaagcagggcgccgtgcacaagctgatcttccccagcatgggccccgagcacgagggcaagtacaccttcagagccaagggcaccgagagcgaggccagcgtgttcatcgccgacccccccaccatcgaccccagcgtgctggaggccctggccgcccacgccatcaccgtgaaggtgggccacaccgcccacatcaaggtgcccttcagaggcaagcccctgcccaaggtgacctggtacaaggacggcatggaggtgaccgaggaggagagagtgagcatggagagaggcgaggaccaggccctgctgaccatcagcaactgcgtgagagaggacagcggcctgatcctgctgaagctgaagaacgaccacggcagcgccaccgccaccctgcacctgagcgtgctggacagacccaagcccccccagggcagagtggagttcctggagctgagcggcagctgcgtgcacatgaagtggaaggcccccaaggacaacggcggcagacccgtgacccagttcatcgtggagagaagagccgtgggcaagaagagctggatcaagatcggcgaggtggacggcaaggtgaccaacttcagcaccaacaaggtggaggagggcaaggcctaccagttcagaatcctggccgtgaacagcgagggcgtgagcgaccccctggagaccgaggaggtgttcgccggcaaccccatcgagccccccggcttcgccagccagccccaggtgaccgacgtgaccaaggaggccgtgaccatcacctggaacgcccccacccaggacggcggcgcccccgtgctgggctacatcgtggagagaagaaagaagggcagcaacctgtgggtgcccgtgaacaaggaccccatccagggcaccaagtgcaccgtggacggcctgctggaggacaccgagtacgagttcagagtgatcgccgtgaacaaggccggccccggccagcccagcgtgcccagcagcagcgtggtggccaaggaccccgtgaagccccccggcctggtgcaggacctgcacgtgagcgacagcagcaacagcagcatcagcctggcctggagagagcccgccgagggcgacccccccagcggctacatcctggagatgagagccgaggacaccaaggagtggagcaagtgcaccaagatccccatcagcggcacctgctacaccgtgggcggcctgatcgagagacagaagtacttcttcagaatcagagccgtgaacgaggccggcgtgggcgagcccgtggagctggacaagggcgtgagagccatgcccccccccgccgcccccaagttcgacctgagcgccagactgaagagccacatggtggtgagagccggcaccgccctgtgcatccacgccgccttcagcggcagccccccccccgacgtgatctggcagaaggacggcgtgcccaccaagggcagagagaccatcaccaagagcaagaaccacagccagttcctgatcaacagcaccaagagaagcgacagcggcgtgtacagaatcctgctgcagaacgagttcggcgaggccagatacgacatccacgtgagagtggccgacttccccagaccccccaccaacctgagactgttcgaggaggtgcccaacaccgtgaccctgacctggaaccacagccccgacgtgcaggaggacggcgaggcccactacatcatcatgaagagagacgccagcaccgccacctggtacaccgccgccgagagagtgttcagcaacaagtacaccgtgaccggcctgctgcccggcagaaagtactacttcagagtggtggccagaaacgagatcggcgacagcgagcccctggacagcagagacacctggctgatcaacaaggaccagatccaggacctgagcgccaagctgaagccctacgagaagaaggactggagacacgcccccagattcgtgacccccctgaagccccacaccgtgctgagaggccaggactgcaccatgacctgcgccttcctgggcaaccccagacccaccgtgaccctgtacaagggcgacgtgaacatcaccgccaacagcaagttctggtacaacagcaccagcggcgtgtgcaccctggtgatccccacctgcaccctgaaggacagcggcgactacagcgtgctggtggagaacgagctgggcaaggacagaagcagctgcaccctgaccgtgtacgacaaggacgacaagagcgtggtggccagcatcaccgagagcctgcagaagaagagcaagcacctgatgtag

SEQ ID NO: 21783 - DNA, 1827 bp, Artificial Sequence
  Description of Artificial Sequence: Synthetic coding sequence
atgggctggcagcccatgggcgagaactggggctgcctggaggagatgctgaacgaggaccagagcagagagccccccggccacctgggcagcagaagaagcggcaaggacggcagactggacatctacggcgagagaagagacgccaccagaagcagcaccagcagatacaagcccggcaccggcagcttcagcaaggacgcccagggccccatgggccacttcagccagggcctggccgacatggaggtgcagcccggcgaggccgccaccctgagctgcaccctgaccagcgacctgggccccggcacctggttcaaggacggcgtgaagctgaccacccaggacggcgtgatcttcaagcaggacggcctggtgcacagcctgttcatcacccacgtgcagggcacccaggccggcagatacaccttcgtggccggcgaccagcagagcgaggccaccctgaccgtgcaggacagccccaccatcgcccccgacgtgaccgagaagctgagagagcccctggtggtgaaggccggcaagcccgtgatcgtgaagatccccttccagagccacctgcccatccaggccgcctggagaaaggacggcgccgaggtggtgggcagcagcgacagagaggcccaggtggacctgggcgacggctacaccagactgtgcctgcccagcgccggcagaaaggactgcggccagtacagcgtgaccctgagaagcgagggcggcagcgtgcaggccgagctgaccctgcaggtgatcgacaagcccgaccccccccagggccccatggaggtgcaggactgccacagagccggcgtgtgcctgagatggagaccccccagagacaacggcggcagaaccgtggagtgctacgtggtggagagaagacaggccggcagaagcacctggctgaaggtgggcgaggcccccgccgacagcaccaccttcaccgacgcccacgtggagcccggcagaaagtacaccttcagagtgagagccgtgaccagcgagggcgccggcgaggccctggagagcgaggagatcctggtggcccccgaggccctgcccaaggcccccagcgcccccgccatcctgagcgccagcagccagggcatcaccctgacctggaccgcccccagaggccccggcagcgcccacatcctgggctacctgatcgagagaagaaagaagggcagcaacacctggaccgccgtgaacgaccagcccgtgcccgagagaagatggaccgtggccgacgtgagacagggctgccagtacgagttcagagtgaccgccgtggcccccagcggccccggcgagcccggcccccccagcgacgccgtgttcgccagagaccccatgagaccccccggcctggtgagaaacctgcaggtgaccgacagaagcaacaccagcatcaccctgagctgggccggccccgacacccaggagggcgacgaggcccagggctacgtggtggagctgtgcagcagcgacagcctgcagtggctgccctgccacgtgggcaccgtgcccgtgaccacctacaccgccaagggcctgagacccggcgagggctacttcgtgagagtgaccgccgtgaacgagggcggccagagccagcccagcgccctggacaccctggtgcaggccatgcccgtgaccgtgtgccccaagttcctggtggacagcagcaccaaggacctgctgaccgtgaaggtgggcgacaccgtgagagtgcccgtgagcttcgagcacgccagaagacccctgggccccagcacctgcagaagaacctgcctgggcagatag

SEQ ID NO: 21784 - DNA, 11127 bp, Artificial Sequence
  Description of Artificial Sequence: Synthetic coding sequence
atggccggcaagctgagaaagagccacatccccggcgtgagcatctggcagctggtggaggagatccccgagggctgcagcacccccgacttcgagcagaagcccgtgaccagcgccctgcccgagggcaagaacgccgtgttcagagccgtggtgtgcggcgagcccagacccgaggtgagatggcagaacagcaagggcgacctgagcgacagcagcaagtacaagatcagcagcagccccggcagcaaggagcacgtgctgcagatcaacaagctgaccggcgaggacaccgacctgtacagatgcaccgccgtgaacgcctacggcgaggccgcctgcagcgtgagactgaccgtgatcgaggtgggcttcagaaagaacagaaagagacacagagagccccaggaggacctgagaaaggagctgatggacttcagaaagctgctgaagaagagagccccccccgcccccaagaagaagatggacctggagcagatctggcagctgctgatgaccgccgacagaaaggactacgagaagatctgcctgaagtacggcatcgtggactacagaggcatgctgagaagactgcaggagatgaagaaggagcaggaggacaagatggcccagtacatcaacaccatcagcagcctgagacacatcagagtgaccaaggacggcaacgccaagttcgacctggagctggacctgaaggacagccagagcaagatctacctgtacaaggacggcgagatgatcccctacggcttcaacaaccagaccaagcactgcctgagaagactgggcaagagatacgagttccagatccaggacctgagacccgaggacagcggcatctaccaggtgaaggtggaggacgccgtggtgttcagcaccgagctggaggccagcgccatcccccccagagtggtggtgcccctggccgagacccactgcgaggagcagggcgacgccgtgttcgagtgcaccctgagcagcccctgccccagcgccgcctggcacttcagacacagactgctgcaccccagcgacaagtacgaggtgtacgtgagccccgacggcctgacccacagactggtggtgagaggcgccagattcagcgacatgggcccctacagcctgggcaccggcctgtacaccagcagcgcctggctggtggtggaggccggcaaggacaaggacctgcagagcaccagcgccgaccacaagctgcagagacagggcgcccaggccagcggcgccgaggagagcggcagcatcgagagccagggcgagaagagcagagagcagggccccagaggcggcagcctggagggcgccggccccgccagcggcctgcagcacatcgccagccccgacagagacggcctgggcagacacggctacagcctgatgggcgacaagggcaccgccgacagcgcctggggccccggccaggagggcgagggcttccccgtggccgagggcagcagagccaccctgcccagagagaaccagagccacagagagggcggctgggccagaagcctggccgagagaccccacctgcagggcgagagcagcgagagcggcctgggcctgcccgagaagcagcagcaggacagaggcagagacagcaacagcgacgagtgctggagaaaggccggcggctgggaggccggcagcagcagactgcaggccggcggcctgggcagcagcagagagggcaaggagcacagaggcgacagcggcagacagctggacagacacgcccccgagcagctgtgggacgccagactgggccccggcagaggcaagagcgacctgcagggctgccagagcgaccccgtgggcagctggcccagaggcaagcagatcgagatcagccaggacgacagcctggccgagatggacagaggcgacgcccccagcagagagagaggcagaggcatcgtggtgtggggcggcggcaccggcctgggcgaggccggcgacagcaacggcgccggcggccccggcaccctggagctgaccggcggcagaggcagcggcagcaaggtgggcatggcccccgagagctggggcagccagggcggcagagacgccgactacggcgaggccagaggctactggggcagcggcgagctgctggagcagatccccggcggcaaggacttccaggagcccagcatcagcggcggcagaaagttcctgctgggcgacggcagccccgagatcaaggccgaggacagcctgcaggaggccgacggcatctgcagaggcgagagcgtggtgaccggcagcgcctacaagaccggccccggcggccccggcgaccccagaggctgcgagggcgtgctgcaggagctgagaggcagagacggccaggagaccgcctgggccagcggcgaggtggagtacgaccccagaagcttccagagcagccagggctggaccgccggccacagagccgccggcggcatcggcagaatcgagagcaagggcaccagcccctgggacgacacccccagcagcctgagaaagaccggcgcccaccacggccccggcgtgctgggccccagcggcggccaggagggcatgggcggcatctgggtggccggcctgaccgagagcggccagggcgtggacgccagaagccactggctgagcagagcccccggcctgggcgcccagggcagcggcggcaccctgggcgacaagaagggcctgagaggccccggcagcatcggcagcgagcccgacttctggaacggcagcggcagcagcagagtgaagggccccagaggcgagaccggctacaaggacggcctggagggccccggcagaatggagagcagatacgagggcggcctgggctacagcagagagatcagcagcaagagcggcgccggctacagctacggcagcggcgtgcccggcgagatgggcagcggccacggcgccggctgcagagtgagccccagagcccccgccggcgtggagagcgaggagggcggcggctacagacacggcagcggcgcccccggcggcgtgtggagcggcaacgaggacagcggccccgccggcggcggcagcggcagagtggccagcctgaagaacggcagcggcggccccgacggcgcccccatgaacgacaccagaaactgggccagcgcctgccaggccggcatggaccccagaggcggccaccacagcgacggcggcctgggcagccccggcgtgaccggcagcgccggcagaggcggcctgaaggcccccggcgtggtggagaccgtgggcatgggctgcgtggaggccgagcccgagagcagcggcagaatcagaccctggggccagaccggcaactacggcggcttcagagccagcgaggccctgggcgccttcggcgagggcggctacgaggacggcagcggcggccccggcgccatgggccccggcagcctgagagccggcagcaaggtgggcgagggcgacggcaccagatgccccggcgccaaggccagcggcgccggcgccggctacagagacgacaccagacaccccgagagcctggccccccacaacggcgccgccagcggcagccagtgggcctacggcgccggcaacgtgctgggctacgaggacggcagcgagctgcccggcccccagggcaccggcgtgagaaccgcctacggcgagagaagcagaggcctgggccccagaagcaccggccccggcggcgaggccggcttcagagacggcagcggcggcctgcagggcatgggcagcgccgacggccccggctgcagaaagggcatcggcagcagcggcgagatgggcagcgtggacaaggagggctacaagaaggacctgggcgcccccgagaacatgggcagcggcagcaaggccgactacagagacggcgtgggcggcagcggcgccatgggcagcatggacgaggccggctacagaaaggacctgggcgcccccgagggcatcagcagcggcagcaaggccgactacagaggcggcctgcaggacagcagagaggccggcagcggcagcaaggccgactacagcggcggcctgaagggcagcagagagatcggcagcatggacgagaccgacaacagaaaggacctgggcgtgcccgagggcatgggcgccggctacagagccggcctgagaggccccggcgagatgggcagcctggacgagagcggccacagaaacggcatcggcggctacggcgagatgggcagcggctacagagaggacctgggcgcccccgagggcatgggcaccggcagcaaggccggctacagagacggcctgagaggcagcggcgagatgagaagcatggacgaggccggctacagaaagaacctgggcgcccccgagagaatggacagcggcagcaaggccggctacagaggcggcctgagaggcagcggcgagatgggcctgatcgaggccggctacagaaaggacctgggcgtgagcgagggcggcggcagcggcagcaaggccggctacagaggcggcctgggcagcggcgagatgggcagcgtggacaaggccggctacagaaaggacctgggcgccagcgaggccatcggcagcggcagcaaggccggcttcaccgacggcctgggcggcagcgaggagatgggcagcgtgaacaaggccggctacagaaaggacctgggcgcccccaagggcatgggcagcggcagcaaggccagcttcagagacggcctgggcggcagcggcgagatgggcagcgtgaacgaggccggctacagaaaggacctgggcgtgcccgagggcatcggcagcggcagcaaggccggcttcagagacggcctgggcggcagcgaggagatgggcagcgtgaacaaggccggctacagaaaggacctgggcgcccccaagggcatcggcagcggcagcaaggccggcttcagagacggcctgggcagcagcggcgagatgggcagcatggacgaggccggctacagaaagaacctgggcgcccccgagggcatcggcagcggcagcaaggccggcttcagagacggcctgggcagcagcgtggagatgggcagcgtgaacgaggccggctacagaaaggacctgggcgcccccgagggcatgggcagcggcagcaaggccggcttcagagacggcctgggcggcagcggcgagatgggcagcgtgaacgaggccggctacagaaaggacctgggcgcccccaagggcatcggcagcggcagcaaggccgacttcagagacgccctgggcagcagcggcgagatgggcagcatggacgaggccggctacagaaaggacctgtgggcccccgagggcatcggcagcggcagcaaggccggcttcagagacggcctgggcagcagcgtggagatgggcagcgtgaacgaggccggctacagaaaggacctgggcgcccccgagggcatgggcagcggcagcaaggccggcttcagagacggcctgggcggcagcggcgagatgggcagcgtgaacgaggccggctacagaaaggacctgggcgcccccaagggcatcggcagcggcagcaaggccgacttcagagacgccctgggcagcagcggcgagatgggcagcatggacgaggccggctacagaaaggacctgtgggcccccgagggcatcggcagcggcagcaaggccggcttcagagacggcctgggcagcagcgtggagatgggcagcgtgaacgaggccggctacagaaaggacctgggcgcccccgagggcatgggcagcggcagcaaggagggcttcagagacggcctgggcggcagcgaggagatgggcagcgtgaacaaggccggctacagaaaggacctgggcgcccccaagggcatgggcagcggcagcaaggagggcttcagagacggcctgggcggcagcgaggagatgggcagcatggacgaggccggctacagaaaggacctgggcgcccccgagggcatcggcagcggcagcaaggccggcttcagagacggcctgggcggcagcgaggagatgagaagcatggacgaggccggctacagaaaggacctgggcgcccccgagagaatcggcagcggcagcaaggccggcttcagagacggcctgggcagcagcgtggagatgggcagcgtgaacgaggccggctacagaaaggacctgggcgcccccaagggcatgggcagcggcagcaagaccggcttcagagacggcctgggcggcagcgaggagatggagagcatggacgaggccggctacagaaaggacctgggcgcccccgagggcatcggcagcggcagcaaggccggcttcagagacggcctgggcagcagcaccgagatgggcagcgtgaacgaggccggctacagaaaggacctgggcgcccccaagggcatgggcagcgagagcaaggccggcttcagagacggcctgggcagcagcggcgagatgggcagcatggacgaggccggctacagaaaggacctgggcgcccccgagggcatgggcagcggcagcaaggccggcttcagagacggcctgggcggcagcgaggagatgggcagcgtgaacaaggccggctacagaaaggacctgggcgcccccaagggcatgggcagcggcagcaaggccggcttcagagacggcctgggcagcagcggcgagatgggcagcatggacgaggccgactacagaaaggacctgggcgcccccgaggagatgggcagcggcagctacaccgactacagaaacggcctgggcagcagcggcaagatcagcagcggcgacgaggccggctacaagaacgtgctgggcggcagcggcagaaaccccctgggcagcgaggccggcagcagaggcagcctggaggacagcggctacatcctgagctggaacgaggccggcagcagacagggcttcggcggcaccagcggcatgggcagcggcagcgaggtgagctacagaggcggcagcggcggcagcggcgagaccggccccgagggcaagatgggctacggcgacggcagcggcagactgggcgtgcccggcagcctggccggcatcggccacgaggccggccccagaggccacaaggccatgggccacagaagcggctactgggtggccagcgagggcgacaccaacagcaaggacggccccgagagagccagagagaccagactggtggacggcgccggccccggcgtggagcccggcatggccggcatgcccggcaccgccggcggcatggcccacagagacagcctgagaggcaccggcgtgctgggcagccagggcggcagacagaccctgagcgacgagagaggcagcaccaaggacctgggcggctacggcaccagcggcatccccgaggccagcgaggccgccggcgccaagggcaagcccgacgtgaaggagtggcaggacagcagcggcacccccggcagcagcagagacagaggcgcccccagagtgaaggacagaagccccgaccaggccggcatcatgggcgccagcggcttcctggacggcaagggcgccgtggagggcgagacctgggccggcatggccgccctgggcagcggctacgagagagacatctggaaggccggccccggcatgaccgacagaggcagagtggccggccagggcggcctggccagccagggcggcggcgacagcctgctgggcggcagaagagtgggcagcggcagcagcgtgggcaccggccaggacctggacagcggcagcatgcccggcggcagaggcaagagcaccagcggccccgccgacagacagggcaccagcaacgcctgggcccccgactgggagaaccagggcttcagccagggcagcatcgacgccggcaagcagcccgccggcagcagagccagcggcagcctgcaggagaaggacgccgccttcggcggcacccacgagggccccggcggcttcaagggcggcgagggcgcccccggccaggaggccgccggcggctgcagaagcccctggagcctggacagcaagggcagcagccccggcagaggcagcagcgtggacgccgaggacagcggcatcctgggcaagggcaacagcaccgagtggggcaacgccctgacccccaagcccggcgagagcggcccccagggcgcctggaacggcctggacggccccttcggcagaaaggccagcagagacagaagcggcggcacccaggacctgagcagccagagaggcaagggccagagaggcggcaagagaagcctgggcgagcagggcagcctggaggccgagaacggcgaggtgcagggccccggcgccctgaaggaggacgagggccagggcgtggaggaggccggcagaagcggcagaagacccggcagcctgagaagcagaagccaggcccagagcggcgccgaggtgggcggcggcaagagaagaggcgccgacgaggccggcagcatgggctggcagcccatgggcgagaactggggctgcctggaggagatgctgaacgaggaccagagcagagagccccccggccacctgggcagcagaagaagcggcaaggacggcagactggacatctacggcgagagaagagacgccaccagaagcagcaccagcagatacaagcccggcaccggcagcttcagcaaggacgcccagggccccatgggccacttcagccagggcctggccgacatggaggtgcagcccggcgaggccgccaccctgagctgcaccctgaccagcgacctgggccccggcacctggttcaaggacggcgtgaagctgaccacccaggacggcgtgatcttcaagcaggacggcctggtgcacagcctgttcatcacccacgtgcagggcacccaggccggcagatacaccttcgtggccggcgaccagcagagcgaggccaccctgaccgtgcaggacagccccaccatcgcccccgacgtgaccgagaagctgagagagcccctggtggtgaaggccggcaagcccgtgatcgtgaagatccccttccagagccacctgcccatccaggccgcctggagaaaggacggcgccgaggtggtgggcagcagcgacagagaggcccaggtggacctgggcgacggctacaccagactgtgcctgcccagcgccggcagaaaggactgcggccagtacagcgtgaccctgagaagcgagggcggcagcgtgcaggccgagctgaccctgcaggtgatcgacaagcccgaccccccccagggccccatggaggtgcaggactgccacagagccggcgtgtgcctgagatggagaccccccagagacaacggcggcagaaccgtggagtgctacgtggtggagagaagacaggccggcagaagcacctggctgaaggtgggcgaggcccccgccgacagcaccaccttcaccgacgcccacgtggagcccggcagaaagtacaccttcagagtgagagccgtgaccagcgagggcgccggcgaggccctggagagcgaggagatcctggtggcccccgaggccctgcccaaggcccccagcgcccccgccatcctgagcgccagcagccagggcatcaccctgacctggaccgcccccagaggccccggcagcgcccacatcctgggctacctgatcgagagaagaaagaagggcagcaacacctggaccgccgtgaacgaccagcccgtgcccgagagaagatggaccgtggccgacgtgagacagggctgccagtacgagttcagagtgaccgccgtggcccccagcggccccggcgagcccggcccccccagcgacgccgtgttcgccagagaccccatgagaccccccggcctggtgagaaacctgcaggtgaccgacagaagcaacaccagcatcaccctgagctgggccggccccgacacccaggagggcgacgaggcccagggctacgtggtggagctgtgcagcagcgacagcctgcagtggctgccctgccacgtgggcaccgtgcccgtgaccacctacaccgccaagggcctgagacccggcgagggctacttcgtgagagtgaccgccgtgaacgagggcggccagagccagcccagcgccctggacaccctggtgcaggccatgcccgtgaccgtgtgccccaagttcctggtggacagcagcaccaaggacctgctgaccgtgaaggtgggcgacaccgtgagagtgcccgtgagcttcgaggccatgcccatgcccgaggtgacctggctgaaggacggcctgcccctgcccaagagaagcgtgaccgtgaccaaggacggcctgacccagctgctgatccccgtggccggcctgagcgacagcggcctgtacaccgtggtgctgagaaccctgcagggcaaggaggtggcccacagcttcagaatcagagtggccgcctgcccccaggcccccggccccatccacctgcaggagaacgtgcccggcaccgtgaccgccgagtgggagcccagccccgacgaggcccaggacgtgcccctgcactacgccgtgttcaccagaagcagcgcccacggcccctggcacgaggccgccgacagaatccacaccaacagattcaccctgctgggcatcctgcccggccacgagtaccacttcagagtggtggccaagaacgagctgggcgccagcaagcccagcgacaccagccagccctggtgcatccccagacagagagacagattcaccgtgaaggccccctgctacagagagcccgacctgagccagaagcccagattcctggtgggcctgagaagccacctgctgccccagggctgcgagtgctgcatgagctgcgccgtgcagggcagccccagaccccacgtgacctggttcaagaacgacagaagcctggagggcaaccccgccgtgtacagcaccgacctgctgggcgtgtgcagcctgaccatccccagcgtgagccccaaggacagcggcgagtacaaggccgtggccgagaacaccctgggccaggccgtgagcaccgccaccctgatcgtgatcgagcccagcacctag

SEQ ID NO: 21785 - DNA, 1713 bp, Artificial Sequence
  Description of Artificial Sequence: Synthetic coding sequence
atggccggcaagctgagaaagagccacatccccggcgtgagcatctggcagctggtggaggagatccccgagggctgcagcacccccgacttcgagcagaagcccgtgaccagcgccctgcccgagggcaagaacgccgtgttcagagccgtggtgtgcggcgagcccagacccgaggtgagatggcagaacagcaagggcgacctgagcgacagcagcaagtacaagatcagcagcagccccggcagcaaggagcacgtgctgcagatcaacaagctgaccggcgaggacaccgacctgtacagatgcaccgccgtgaacgcctacggcgaggccgcctgcagcgtgagactgaccgtgatcgaggtgggcttcagaaagaacagaaagagacacagagagccccaggaggacctgagaaaggagctgatggacttcagaaagctgctgaagaagagagccccccccgcccccaagaagaagatggacctggagcagatctggcagctgctgatgaccgccgacagaaaggactacgagaagatctgcctgaagtacggcatcgtggactacagaggcatgctgagaagactgcaggagatgaagaaggagcaggaggacaagatggcccagtacatcaacaccatcagcagcctgagacacatcagagtgaccaaggacggcaacgccaagttcgacctggagctggacctgaaggacagccagagcaagatctacctgtacaaggacggcgagatgatcccctacggcttcaacaaccagaccaagcactgcctgagaagactgggcaagagatacgagttccagatccaggacctgagacccgaggacagcggcatctaccaggtgaaggtggaggacgccgtggtgttcagcaccgagctggaggccagcgccatcccccccagagtggtggtgcccctggccgagacccactgcgaggagcagggcgacgccgtgttcgagtgcaccctgagcagcccctgccccagcgccgcctggcacttcagacacagactgctgcaccccagcgacaagtacgaggtgtacgtgagccccgacggcctgacccacagactggtggtgagaggcgccagattcagcgacatgggcccctacagcctgggcaccggcctgtacaccagcagcgcctggctggtggtggaggccggcaaggacaaggacctgcagagcaccagcgccgaccacaagctgcagagcagaagaagcggcaaggacggcagactggacatctacggcgagagaagagacgccaccagaagcagcaccagcagatacaagcccggcaccggcagcttcagcaaggacgcccagggccccatgggccacttcagccagggcctggccgacatggaggtgcagcccggcgaggccgccaccctgagctgcaccctgaccagcgacctgggccccggcacctggttcaaggacggcgtgaagctgaccacccaggacggcgtgatcttcaagcaggacggcctggtgcacagcctgttcatcacccacgtgcagggcacccaggccggcagatacaccttcgtggccggcgaccagcagagcgaggccaccctgaccgtgcaggacagccccaccatcgcccccgacgtgaccgagaagctgagagagcccctggtggtgaaggccggcaagcccatccagacctaccactag

SEQ ID NO: 21786 - DNA, 1446 bp, Artificial Sequence
  Description of Artificial Sequence: Synthetic coding sequence
atgatgctgaagagcatcaccgagagcttcgccaccgccatccacggcctgaaggtgggccacctgaccgacagagtgatccagagaagcaagagaatgatcctggacaccctgggcgccggcttcctgggcaccaccaccgaggtgttccacatcgccagccagtacagcaagatctacagcagcaacatcagcagcaccgtgtggggccagcccgacatcagactgccccccacctacgccgccttcgtgaacggcgtggccatccacagcatggacttcgacgacacctggcaccccgccacccaccccagcggcgccgtgctgcccgtgctgaccgccctggccgaggccctgcccagaagccccaagttcagcggcctggacctgctgctggccttcaacgtgggcatcgaggtgcagggcagactgctgcacttcgccaaggaggccaacgacatgcccaagagattccacccccccagcgtggtgggcaccctgggcagcgccgccgccgccagcaagttcctgggcctgagcagcaccaagtgcagagaggccctggccatcgccgtgagccacgccggcgcccccatggccaacgccgccacccagaccaagcccctgcacatcggcaacgccgccaagcacggcatcgaggccgccttcctggccatgctgggcctgcagggcaacaagcaggtgctggacctggaggccggcttcggcgccttctacgccaactacagccccaaggtgctgcccagcatcgccagctacagctggctgctggaccagcaggacgtggccttcaagagattccccgcccacctgagcacccactgggtggccgacgccgccgccagcgtgagaaagcacctggtggccgagagagccctgctgcccaccgactacatcaagagaatcgtgctgagaatccccaacgtgcagtacgtgaacagacccttccccgtgagcgagcacgaggccagacacagcttccagtacgtggcctgcgccatgctgctggacggcggcatcaccgtgcccagcttccacgagtgccagatcaacagaccccaggtgagagagctgctgagcaaggtggagctggagtacccccccgacaacctgcccagcttcaacatcctgtactgcgagatcagcgtgaccctgaaggacggcgccaccttcaccgacagaagcgacaccttctacggccactggagaaagcccctgagccaggaggacctggaggagaagttcagagccaacgccagcaagatgctgagctgggacaccgtggagagcctgatcaagatcgtgaagaacctggaggacctggaggactgcagcgtgctgaccaccctgctgaagggccccagcccccccgaggtggccagcaacagccccgcctgcaacaacagcatcaccaacctgagctag

SEQ ID NO: 21787 - DNA, 1446 bp, Artificial Sequence
  Description of Artificial Sequence: Synthetic coding sequence
ttccccctgaagagcatcaccgagagcttcgccaccgccatccacggcctgaaggtgggccacctgaccgacagagtgatccagagaagcaagagaatgatcctggacaccctgggcgccggcttcctgggcaccaccaccgaggtgttccacatcgccagccagtacagcaagatctacagcagcaacatcagcagcaccgtgtggggccagcccgacatcagactgccccccacctacgccgccttcgtgaacggcgtggccatccacagcatggacttcgacgacacctggcaccccgccacccaccccagcggcgccgtgctgcccgtgctgaccgccctggccgaggccctgcccagaagccccaagttcagcggcctggacctgctgctggccttcaacgtgggcatcgaggtgcagggcagactgctgcacttcgccaaggaggccaacgacatgcccaagagattccacccccccagcgtggtgggcaccctgggcagcgccgccgccgccagcaagttcctgggcctgagcagcaccaagtgcagagaggccctggccatcgccgtgagccacgccggcgcccccatggccaacgccgccacccagaccaagcccctgcacatcggcaacgccgccaagcacggcatcgaggccgccttcctggccatgctgggcctgcagggcaacaagcaggtgctggacctggaggccggcttcggcgccttctacgccaactacagccccaaggtgctgcccagcatcgccagctacagctggctgctggaccagcaggacgtggccttcaagagattccccgcccacctgagcacccactgggtggccgacgccgccgccagcgtgagaaagcacctggtggccgagagagccctgctgcccaccgactacatcaagagaatcgtgctgagaatccccaacgtgcagtacgtgaacagacccttccccgtgagcgagcacgaggccagacacagcttccagtacgtggcctgcgccatgctgctggacggcggcatcaccgtgcccagcttccacgagtgccagatcaacagaccccaggtgagagagctgctgagcaaggtggagctggagtacccccccgacaacctgcccagcttcaacatcctgtactgcgagatcagcgtgaccctgaaggacggcgccaccttcaccgacagaagcgacaccttctacggccactggagaaagcccctgagccaggaggacctggaggagaagttcagagccaacgccagcaagatgctgagctgggacaccgtggagagcctgatcaagatcgtgaagaacctggaggacctggaggactgcagcgtgctgaccaccctgctgaagggccccagcccccccgaggtggccagcaacagccccgcctgcaacaacagcatcaccaacctgagctag

SEQ ID NO: 21788 - DNA, 963 bp, Artificial Sequence
  Description of Artificial Sequence: Synthetic coding sequence
atggccgagggcgacgccggcagcgaccagagacagaacgaggagatcgaggccatggccgccatctacggcgaggagtggtgcgtgatcgacgactgcgccaagatcttctgcatcagaatcagcgacgacatcgacgaccccaagtggaccctgtgcctgcaggtgatgctgcccaacgagtaccccggcaccgccccccccatctaccagctgaacgccccctggctgaagggccaggagagagccgacctgagcaacagcctggaggagatctacatccagaacatcggcgagagcatcctgtacctgtgggtggagaagatcagagacgtgctgatccagaagagccagatgaccgagcccggccccgacgtgaagaagaagaccgaggaggaggacgtggagtgcgaggacgacctgatcctggcctgccagcccgagagcagcctgaaggccctggacttcgacatcagcgagaccagaaccgaggtggaggtggaggagctgccccccatcgaccacggcatccccatcaccgacagaagaagcaccttccaggcccacctggcccccgtggtgtgccccaagcaggtgaagatggtgctgagcaagctgtacgagaacaagaagatcgccagcgccacccacaacatctacgcctacagaatctactgcgaggacaagcagaccttcctgcaggactgcgaggacgacggcgagaccgccgccggcggcagactgctgcacctgatggagatcctgaacgtgaagaacgtgatggtggtggtgagcagatggtacggcggcatcctgctgggccccgacagattcaagcacatcaacaactgcgccagaaacatcctggtggagaagaactacaccaacagccccgaggagagcagcaaggccctgggcaagaacaagaaggtgagaaaggacaagaagagaaacgagcactag

SEQ ID NO: 21789 - DNA, 492 bp, Artificial Sequence
  Description of Artificial Sequence: Synthetic coding sequence
atgagcaccaacgagaacgccaacacccaggccgcccacctgcacagaagcaagaacaagggcaaggacagcaccgagaccagaagacacagaatcgaggtgaacgtggagctgagaaaggccaagaaggacgaccagatgctgaagagaagaaacgtgagcagcttccccgacgacgccaccagccccctgcaggagaactgcaacaaccagacccccgccctgagagccatcggcaacatcgtgaccggcaccgacgagcagacccaggtggtgatcgacgccggcgccctggccgtgttccccagcctgctgaccaaccccaagaccaacatccagaaggaggccacctggaccatgagcaacatcaccgccagcagacaggaccagatccagcaggtggtgaaccacggcctggtgcccttcctggtgagcgacctgagcaagatcctgagacacaagagaaagctgtacggcccctggaacagctag

SEQ ID NO: 21790 - DNA, 156 bp, Artificial Sequence
  Description of Artificial Sequence: Synthetic coding sequence
atgagcggccccctgagccccgtgtgcagctgcccccagctgcccttcatgctgagcccctgccacatgcaccaccaccccggccacgtggccctgagccagaccgtgagccccgccagcctgctgacccagggcctgggcctgccccagcactag

SEQ ID NO: 21791 - DNA, 2775 bp, Artificial Sequence
  Description of Artificial Sequence: Synthetic coding sequence
atggagatcaaggaggagggcgccagcgaggagggccagcacttcctgcccaccgcccaggccaacgaccccggcgactgccagttcaccagcatccagaagacccccaacgagccccagctggagttcatcctggcctgcaaggacctggtggcccccgtgagagacagaaagctgaacaccctggtgcagatcagcgtgatccaccccgtggagcagagcctgaccagatacagcagcaccgagatcgtggagggcaccagagaccccctgttcctgaccggcgtgaccttccccagcgagtaccccatctacgaggagaccaagatcaagctgaccgtgtacgacgtgaaggacaagagccacgacaccgtgagaaccagcgtgctgcccgagcacaaggaccccccccccgaggtgggcagaagcttcctgggctacgccagcttcaaggtgggcgagctgctgaagagcaaggagcagctgctggtgctgagcctgagaaccagcgacggcggcaaggtggtgggcaccatcgaggtgagcgtggtgaagatgggcgagatcgaggacggcgaggccgaccacatcaccaccgacgtgcagggccagaagtgcgccctggtgtgcgagtgcaccgcccccgagagcgtgagcggcaaggacaacctgcccttcctgaacagcgtgctgaagaaccccgtgtgcaagctgtacagattccccaccagcgacaacaagtggatgagaatcagagagcagatgagcgagagcatcctgagcttccacatccccaaggagctgatcagcctgcacatcaaggaggacctgtgcagaaaccaggagatcaaggagctgggcgagctgagcccccactgggacaacctgagaaagaacgtgctgacccactgcgaccagatggtgaacatgtaccaggacatcctgaccgagctgagcaaggagaccggcagcagcttcaagagcagcagcagcaagggcgagaagaccctggagttcgtgcccatcaacctgcacctgcagagaatgcaggtgcacagcccccacctgaaggacgccctgtacgacgtgatcaccgtgggcgcccccgccgcccacttccagggcttcaagaacggcggcctgagaaagctgctgcacagattcgagaccgagagaagaaacaccggctaccagttcatctactacagccccgagaacaccgccaaggccaaggaggtgctgagcaacatcaaccagctgcagcccctgatcgccacccacgccgacctgctgctgaacagcgccagccagcacagccccgacagcctgaagaacagcctgaagatgctgagcgagaagaccgagctgttcgtgcacgccttcaaggaccagctggtgagaagcgccctgctggccctgtacaccgccagacccggcggcatcctgaagaagccccccagccccaagagcagcaccgaggagagcagcccccaggaccagccccccgtgatgagaggccaggacagcatcccccaccacagcgactacgacgaggaggagtgggacagagtgtgggccaacgtgggcaagagcctgaactgcatcatcgccatggtggacaagctgatcgagagagacggcggcagcgagggcagcggcggcaacaacgacggcgagaaggagcccagcctgaccgacgccatccccagccaccccagagaggactggtacgagcagctgtaccccctgatcctgaccctgaaggactgcatgggcgaggtggtgaacagagccaagcagagcctgaccttcgtgctgctgcaggagctggcctacagcctgccccagtgcctgatgctgaccctgagaagagacatcgtgttcagccaggccctggccggcctggtgtgcggcttcatcatcaagctgcagaccagcctgtacgaccccggcttcctgcagcagctgcacaccgtgggcctgatcgtgcagtacgagggcctgctgagcacctacagcgacgagatcggcatgctggaggacatggccgtgggcatcagcgacctgaagaaggtggccttcaagatcatcgaggccaagagcaacgacgtgctgcccgtgatcaccggcagaagagagcactacgtggtggaggtgaagctgcccgccagaatgttcgagagcctgcccctgcagatcaaggagggccagctgctgcacgtgtaccccgtgctgttcaacgtgggcatcaacgagcagcagaccctggccgagagattcggcgacgtgagcctgcaggagagcatcaaccaggagaacttcgagctgctgcaggagtactacaagatcttcatggagaagatgccccccgactacatcagccacttccaggagcagaacgacctgaaggccctgctggagaacctgctgcagaacatccagagcaagaagagaaagaacgtggagatcatgtggctggccgccaccatctgcagaaagctgaacggcatcagattcacctgctgcaagagcgccaaggacagaaccagcatgagcgtgaccctggagcagtgcagcatcctgagagacgagcaccagctgcacaaggacttcttcatcagagccctggactgcatgagaagagagggctgcagaatcgagaacgtgctgaagaacatcaagtgcagaaagtacgccttcaacatgctgcagctgatggccttccccaagtactacagaccccccgagggcacctacggcaaggccgacacctag

SEQ ID NO: 21792 - DNA, 2775 bp, Artificial Sequence; identical to SEQ ID NO: 21791
  Description of Artificial Sequence: Synthetic coding sequence

SEQ ID NO: 21793 - DNA, 120 bp, Artificial Sequence
  Description of Artificial Sequence: Synthetic coding sequence
atggagatcaaggaggagggcgccagcgaggagggccagcacttcctgcccaccgcccaggccaacgaccccggcgactgccagttcaccagcatccagaagacccccaacgagccctag

SEQ ID NO: 21794 - DNA, 396 bp, Artificial Sequence
  Description of Artificial Sequence: Synthetic coding sequence
atggagatcaaggaggagggcgccagcgaggagggccagcacttcctgcccaccgcccaggccaacgaccccggcgactgccagttcaccagcatccagaagacccccaacgagccccagctggagttcatcctggcctgcaaggacctggtggcccccgtgagagacagaaagctgaacaccctggtgcagatcagcgtgatccaccccgtggagcagagcctgaccagatacagcagcaccgagatcgtggagggcaccagagaccccctgttcctgaccggcgtgaccttccccagcgagtaccccatctacgaggagaccaagatcaagctgaccgtgtacgacgtgaaggacaagagccacgacaccatcgccaacagcagcagaatctag

SEQ ID NO: 21795 - DNA, 255 bp, Artificial Sequence
  Description of Artificial Sequence: Synthetic coding sequence
atggagatcaaggaggagggcgccagcgaggagggccagcacttcctgcccaccgcccaggccaacgaccccggcgactgccagttcaccagcatccagaagacccccaacgagccccagctggagttcatcctggcctgcaaggacctggtggcccccgtgagagacagaaagctgaacaccctggtgcagatcagcgtgatccaccccgtggagcagagcctgaccagatacagcagcaccgagatcgtgtag

SEQ ID NO: 21796 - DNA, 162 bp, Artificial Sequence
  Description of Artificial Sequence: Synthetic coding sequence
atggagatcaaggaggagggcgccagcgaggagggccagcacttcctgcccaccgcccaggccaacgaccccggcgactgccagttcaccagcatccagaagacccccaacgagccccagctggagttcatcctggacctgaaccaggagctgagagactag

SEQ ID NO: 21797 - DNA, 2775 bp, Artificial Sequence; identical to SEQ ID NO: 21791
  Description of Artificial Sequence: Synthetic coding sequence

SEQ ID NO: 21798 - DNA, 2817 bp, Artificial Sequence
  Description of Artificial Sequence: Synthetic coding sequence
atggagatcaaggaggagggcgccagcgaggagggccagcacttcctgcccaccgcccaggccaacgaccccggcgactgccagttcaccagcatccagaagacccccaacgagccccagctggagttcatcctggcctgcaaggacctggtggcccccgtgagagacagaaagctgaacaccctggtgcagatcagcgtgatccaccccgtggagcagagcctgaccagatacagcagcaccgagatcgtggagggcaccagagaccccctgttcctgaccggcgtgaccttccccagcgagtaccccatctacgaggagaccaagatcaagctgaccgtgtacgacgtgaaggacaagagccacgacaccgtgagaaccagcgtgctgcccgagcacaaggaccccccccccgaggtgggcagaagcttcctgggctacgccagcttcaaggtgggcgagctgctgaagagcaaggagcagctgctggtgctgagcctgagaaccagcgacggcggcaaggtggtgggcaccatcgaggtgagcgtggtgaagatgggcgagatcgaggacggcgaggccgaccacatcaccaccgacgtgcagggccagaagtgcgccctggtgtgcgagtgcaccgcccccgagagcgtgagcggcaaggacaacctgcccttcctgaacagcgtgctgaagaaccccgtgtgcaagctgtacagattccccaccagcgacaacaagtggatgagaatcagagagcagatgagcgagagcatcctgagcttccacatccccaaggagctgatcagcctgcacatcaaggaggacctgtgcagaaaccaggagatcaaggagctgggcgagctgagcccccactgggacaacctgagaaagaacgtgctgacccactgcgaccagatggtgaacatgtaccaggacatcctgaccgagctgagcaaggagaccggcagcagcttcaagagcagcagcagcaagggcgagaagaccctggagttcgtgcccatcaacctgcacctgcagagaatgcaggtgcacagcccccacctgaaggacgccctgtacgacgtgatcaccgtgggcgcccccgccgcccacttccagggcttcaagaacggcggcctgagaaagctgctgcacagattcgagaccgagagaagaaacaccggctaccagttcatctactacagccccgagaacaccgccaaggccaaggaggtgctgagcaacatcaaccagctgcagcccctgatcgccacccacgccgacctgctgctgaacagcgccagccagcacagccccgacagcctgaagaacagcctgaagatgctgagcgagaagaccgagctgttcgtgcacgccttcaaggaccagctggtgagaagcgccctgctggccctgtacaccgccagacccggcggcatcctgaagaagccccccagccccaagagcagcaccgaggagagcagcccccaggaccagccccccgtgatgagaggccaggacagcatcccccaccacagcgactacgacgaggaggagtgggacagagtgtgggccaacgtgggcaagagcctgaactgcatcatcgccatggtggacaagctgatcgagagagacggcggcagcgagggcagcggcggcaacaacgacggcgagaaggagcccagcctgaccgacgccatccccagccaccccagagaggactggtacgagcagctgtaccccctgatcctgaccctgaaggactgcatgggcgaggtggtgaacagagccaagcagagcctgaccttcgtgctgctgcaggagctggcctacagcctgccccagtgcctgatgctgaccctgagaagagacatcgtgttcagccaggccctggccggcctggtgtgcggcttcatcatcaagctgcagaccagcctgtacgaccccggcttcctgcagcagctgcacaccgtgggcctgatcgtgcagtacgagggcctgctgagcacctacagcgacgagatcggcatgctggaggacatggccgtgggcatcagcgacctgaagaaggtggccttcaagatcatcgaggccaagagcaacgacgtgctgcccgtgatcaccggcagaagagagcactacgtggtggaggtgaagctgcccgccagaatgttcgagagcctgcccctgcagatcaaggagggccagctgctgcacgtgtaccccgtgctgttcaacgtgggcatcaacgagcagcagaccctggccgagagattcggcgacgtgagcctgcaggagagcatcaaccaggagaacttcgagctgctgcaggagtactacaagatcttcatggagaagatgccccccgactacatcagccacttccaggagcagaacgacctgaaggccctgctggagaacctgctgcagaacatccagagcaagaagagaaagaacgtggagatcatgtggctggccgccaccatctgcagaaagctgaacggcatcagattcacctgctgcaagagcgccaaggacagaaccagcatgagcgtgaccctggagcagtgcagcatcctgagagacgagcaccagctgcacaaggacttcttcatcagagccctggactgcatgagaagcagacagacccagggcgccctgaacgagagcgacgaccccgagaccggctgcctgaccgacaacaagcccaccagcagacacttctaccccgtggccctgctgctggtgagcagccacctgctggtggtgtggctgatcctgagcctggccctgctgctggccaagtaccagtag

SEQ ID NO: 21799 - DNA, 2454 bp, Artificial Sequence
  Description of Artificial Sequence: Synthetic coding sequence
atggagatcaaggaggagggcgccagcgaggagggccagcacttcctgcccaccgcccaggccaacgaccccggcgactgccagttcaccagcatccagaagacccccaacgagccccagctggagttcatcctggcctgcaaggacctggtggcccccgtgagagacagaaagctgaacaccctggtgcagatcagcgtgatccaccccgtggagcagagcctgaccagatacagcagcaccgagatcgtggagggcaccagagaccccctgttcctgaccggcgtgaccttccccagcgagtaccccatctacgaggagaccaagatcaagctgaccgtgtacgacgtgaaggacaagagccacgacaccgtgagaaccagcgtgctgcccgagcacaaggaccccccccccgaggtgggcagaagcttcctgggctacgccagcttcaaggtgggcgagctgctgaagagcaaggagcagctgctggtgctgagcctgagaaccagcgacggcggcaaggtggtgggcaccatcgaggtgagcgtggtgaagatgggcgagatcgaggacggcgaggccgaccacatcaccaccgacgtgcagggccagaagtgcgccctggtgtgcgagtgcaccgcccccgagagcgtgagcggcaaggacaacctgcccttcctgaacagcgtgctgaagaaccccgtgtgcaagctgtacagattccccaccagcgacaacaagtggatgagaatcagagagcagatgagcgagagcatcctgagcttccacatccccaaggagctgatcagcctgcacatcaaggaggacctgtgcagaaaccaggagatcaaggagctgggcgagctgagcccccactgggacaacctgagaaagaacgtgctgacccactgcgaccagatggtgaacatgtaccaggacatcctgaccgagctgagcaaggagaccggcagcagcttcaagagcagcagcagcaagggcgagaagaccctggagttcgtgcccatcaacctgcacctgcagagaatgcaggtgcacagcccccacctgaaggacgccctgtacgacgtgatcaccgtgggcgcccccgccgcccacttccagggcttcaagaacggcggcctgagaaagctgctgcacagattcgagaccgagagaagaaacaccggctaccagttcatctactacagccccgagaacaccgccaaggccaaggaggtgctgagcaacatcaaccagctgcagcccctgatcgccacccacgccgacctgctgctgaacagcgccagccagcacagccccgacagcctgaagaacagcctgaagatgctgagcgagaagaccgagctgttcgtgcacgccttcaaggaccagctggtgagaagcgccctgctggccctgtacaccgccagacccggcggcatcctgaagaagccccccagccccaagagcagcaccgaggagagcagcccccaggaccagccccccgtgatgagaggccaggacagcatcccccaccacagcgactacgacgaggaggagtgggacagagtgtgggccaacgtgggcaagagcctgaactgcatcatcgccatggtggacaagctgatcgagagagacggcggcagcgagggcagcggcggcaacaacgacggcgagaaggagcccagcctgaccgacgccatccccagccaccccagagaggactggtacgagcagctgtaccccctgatcctgaccctgaaggactgcatgggcgaggtggtgaacagagccaagcagagcctgaccttcgtgctgctgcaggagctggcctacagcctgccccagtgcctgatgctgaccctgagaagagacatcgtgttcagccaggccctggccggcctggtgtgcggcttcatcatcaagctgcagaccagcctgtacgaccccggcttcctgcagcagctgcacaccgtgggcctgatcgtgcagtacgagggcctgctgagcacctacagcgacgagatcggcatgctggaggacatggccgtgggcatcagcgacctgaagaaggtggccttcaagatcatcgaggccaagagcaacgacgtgctgcccgtgatcaccggcagaagagagcactacgtggtggaggtgaagctgcccgccagaatgttcgagagcctgcccctgcagatcaaggagggccagctgctgcacgtgtaccccgtgctgttcaacgtgggcatcaacgagcagcagaccctggccgagagattcggcgacgtgagcctgcaggagagcatcaaccaggagaacttcgagctgctgcaggagtactacaagatcttcatggagaagatgccccccgactacatcagccacttccaggagcagaacgacctgaaggccctgctggagaacctgctgcagaacatccagagcaagaagtag

SEQ ID NO: 21800 - DNA, 2775 bp, Artificial Sequence; identical to SEQ ID NO: 21791
  Description of Artificial Sequence: Synthetic coding sequence

SEQ ID NO: 21801 - DNA, 1971 bp, Artificial Sequence
  Description of Artificial Sequence: Synthetic coding sequence
atgggcgagatcgaggacggcgaggccgaccacatcaccaccgacgtgcagggccagaagtgcgccctggtgtgcgagtgcaccgcccccgagagcgtgagcggcaaggacaacctgcccttcctgaacagcgtgctgaagaaccccgtgtgcaagctgtacagattccccaccagcgacaacaagtggatgagaatcagagagcagatgagcgagagcatcctgagcttccacatccccaaggagctgatcagcctgcacatcaaggaggacctgtgcagaaaccaggagatcaaggagctgggcgagctgagcccccactgggacaacctgagaaagaacgtgctgacccactgcgaccagatggtgaacatgtaccaggacatcctgaccgagctgagcaaggagaccggcagcagcttcaagagcagcagcagcaagggcgagaagaccctggagttcgtgcccatcaacctgcacctgcagagaatgcaggtgcacagcccccacctgaaggacgccctgtacgacgtgatcaccgtgggcgcccccgccgcccacttccagggcttcaagaacggcggcctgagaaagctgctgcacagattcgagaccgagagaagaaacaccggctaccagttcatctactacagccccgagaacaccgccaaggccaaggaggtgctgagcaacatcaaccagctgcagcccctgatcgccacccacgccgacctgctgctgaacagcgccagccagcacagccccgacagcctgaagaacagcctgaagatgctgagcgagaagaccgagctgttcgtgcacgccttcaaggaccagctggtgagaagcgccctgctggccctgtacaccgccagacccggcggcatcctgaagaagccccccagccccaagagcagcaccgaggagagcagcccccaggaccagccccccgtgatgagaggccaggacagcatcccccaccacagcgactacgacgaggaggagtgggacagagtgtgggccaacgtgggcaagagcctgaactgcatcatcgccatggtggacaagctgatcgagagagacggcggcagcgagggcagcggcggcaacaacgacggcgagaaggagcccagcctgaccgacgccatccccagccaccccagagaggactggtacgagcagctgtaccccctgatcctgaccctgaaggactgcatgggcgaggtggtgaacagagccaagcagagcctgaccttcgtgctgctgcaggagctggcctacagcctgccccagtgcctgatgctgaccctgagaagagacatcgtgttcagccaggccctggccggcctggtgtgcggcttcatcatcaagctgcagaccagcctgtacgaccccggcttcctgcagcagctgcacaccgtgggcctgatcgtgcagtacgagggcctgctgagcacctacagcgacgagatcggcatgctggaggacatggccgtgggcatcagcgacctgaagaaggtggccttcaagatcatcgaggccaagagcaacgacgtgctgcccgtgatcaccggcagaagagagcactacgtggtggaggtgaagctgcccgccagaatgttcgagagcctgcccctgcagatcaaggagggccagctgctgcacgtgtaccccgtgctgttcaacgtgggcatcaacgagcagcagaccctggccgagagattcggcgacgtgagcctgcaggagagcatcaaccaggagaacttcgagctgctgcaggagtactacaagatcttcatggagaagatgccccccgactacatcagccacttccaggagcagaacgacctgaaggccctgctggagaacctgctgcagaacatccagagcaagaagaaggagtgcagaaactacgtggccggctgcaacgacctgccccagaccgagtggtacagcttccacctgctgtag

SEQ ID NO: 21802 - DNA, 2061 bp, Artificial Sequence
  Description of Artificial Sequence: Synthetic coding sequence
atgatccacttccaccccctgatcctgccccacgagagaagcttcctgggctacgccagcttcaaggtgggcgagctgctgaagagcaaggagcagctgctggtgctgagcctgagaaccagcgacggcggcaaggtggtgggcaccatcgaggtgagcgtggtgaagatgggcgagatcgaggacggcgaggccgaccacatcaccaccgacgtgcagggccagaagtgcgccctggtgtgcgagtgcaccgcccccgagagcgtgagcggcaaggacaacctgcccttcctgaacagcgtgctgaagaaccccgtgtgcaagctgtacagattccccaccagcgacaacaagtggatgagaatcagagagcagatgagcgagagcatcctgagcttccacatccccaaggagctgatcagcctgcacatcaaggaggacctgtgcagaaaccaggagatcaaggagctgggcgagctgagcccccactgggacaacctgagaaagaacgtgctgacccactgcgaccagatggtgaacatgtaccaggacatcctgaccgagctgagcaaggagaccggcagcagcttcaagagcagcagcagcaagggcgagaagaccctggagttcgtgcccatcaacctgcacctgcagagaatgcaggtgcacagcccccacctgaaggacgccctgtacgacgtgatcaccgtgggcgcccccgccgcccacttccagggcttcaagaacggcggcctgagaaagctgctgcacagattcgagaccgagagaagaaacaccggctaccagttcatctactacagccccgagaacaccgccaaggccaaggaggtgctgagcaacatcaaccagctgcagcccctgatcgccacccacgccgacctgctgctgaacagcgccagccagcacagccccgacagcctgaagaacagcctgaagatgctgagcgagaagaccgagctgttcgtgcacgccttcaaggaccagctggtgagaagcgccctgctggccctgtacaccgccagacccggcggcatcctgaagaagccccccagccccaagagcagcaccgaggagagcagcccccaggaccagccccccgtgatgagaggccaggacagcatcccccaccacagcgactacgacgaggaggagtgggacagagtgtgggccaacgtgggcaagagcctgaactgcatcatcgccatggtggacaagctgatcgagagagacggcggcagcgagggcagcggcggcaacaacgacggcgagaaggagcccagcctgaccgacgccatccccagccaccccagagaggactggtacgagcagctgtaccccctgatcctgaccctgaaggactgcatgggcgaggtggtgaacagagccaagcagagcctgaccttcgtgctgctgcaggagctggcctacagcctgccccagtgcctgatgctgaccctgagaagagacatcgtgttcagccaggccctggccggcctggtgtgcggcttcatcatcaagctgcagaccagcctgtacgaccccggcttcctgcagcagctgcacaccgtgggcctgatcgtgcagtacgagggcctgctgagcacctacagcgacgagatcggcatgctggaggacatggccgtgggcatcagcgacctgaagaaggtggccttcaagatcatcgaggccaagagcaacgacgtgctgcccgtgatcaccggcagaagagagcactacgtggtggaggtgaagctgcccgccagaatgttcgagagcctgcccctgcagatcaaggagggccagctgctgcacgtgtaccccgtgctgttcaacgtgggcatcaacgagcagcagaccctggccgagagattcggcgacgtgagcctgcaggagagcatcaaccaggagaacttcgagctgctgcaggagtactacaagatcttcatggagaagatgccccccgactacatcagccacttccaggagcagaacgacctgaaggccctgctggagaacctgctgcagaacatccagagctag

SEQ ID NO: 21803 - DNA, 3399 bp, Artificial Sequence
  Description of Artificial Sequence: Synthetic coding sequence
atggagctgttccaggccaaggaccactacatcctgcagcagggcgagagagccctgtggtgcagcagaagagacggcggcctgcagctgagacccgccaccgacctgctgctggcctggaaccccatctgcctgggcctggtggagggcgtgatcggcaagatccagctgcacagcgacctgccctggtggctgatcctgatcagacagaaggccctggtgggcaagctgcccggcgaccacgaggtgtgcaaggtgaccaagatcgccgtgctgagcctgagcgagatggagccccaggacctggagctggagctgtgcaagaagcaccacttcggcatcaacaagcccgagaagatcatccccagccccgacgacagcaagttcctgctgaagaccttcacccacatcaagagcaacgtgagcgcccccaacaagaagaaggtgaaggagagcaaggagaaggagaagctggagagaagactgctggaggagctgctgaagatgttcatggacagcgagagcttctactacagcctgacctacgacctgaccaacagcgtgcagagacagagcaccggcgagagagacggcagacccctgtggcagaaggtggacgacagattcttctggaacaagtacatgatccaggacctgaccgagatcggcacccccgacgtggacttctggatcatccccatgatccagggcttcgtgcagatcgaggagctggtggtgaactacaccgagagcagcgacgacgagaagagcagccccgagacccccccccaggagagcacctgcgtggacgacatccaccccagattcctggtggccctgatcagcagaagaagcagacacagagccggcatgagatacaagagaagaggcgtggacaagaacggcaacgtggccaactacgtggagaccgagcagctgatccacgtgcacaaccacaccctgagcttcgtgcagaccagaggcagcgtgcccgtgttctggagccaggtgggctacagatacaaccccagacccagactggacagaagcgagaaggagaccgtggcctacttctgcgcccacttcgaggagcagctgaacatctacaagaagcaggtgatcatcaacctggtggaccaggccggcagagagaagatcatcggcgacgcctacctgaagcaggtgctgctgttcaacaacagccacctgacctacgtgagcttcgacttccacgagcactgcagaggcatgaagttcgagaacgtgcagaccctgaccgacgccatctacgacatcatcctggacatgaagtggtgctgggtggacgaggccggcgtgatctgcaagcaggagggcatcttcagagtgaactgcatggactgcctggacagaaccaacgtggtgcaggccgccatcgccagagtggtgatggagcagcagctgaagaagctgggcgtgatgccccccgagcagcccctgcccgtgaagtgcaacagaatctaccagatcatgtgggccaacaacggcgacagcatcagcagacagtacgccggcaccgccgccctgaagggcgacttcaccagaaccggcgagagaaagctggccggcgtgatgaaggacggcgtgaacagcgccaacagatactacctgaacagattcaaggacgcctacagacaggccgtgatcgacctgatgcagggcatccccgtgaccgaggacctgtacagcatcttcaccaaggagaaggagcacgaggccctgcacaaggagaaccagagaagccaccaggagctgatcagccagctgctgcagagctacatgaagctgctgctgcccgacgacgagaagttccacggcggctgggccctgatcgactgcgaccccagcctgatcgacgccacccacagagacgtggacgtgctgctgctgctgagcaacagcgcctactacgtggcctactacgacgacgaggtggacaaggtgaaccagtaccagagactgagcctggagaacctggagaagatcgagatcggccccgagcccaccctgttcggcaagcccaagttcagctgcatgagactgcactacagatacaaggaggccagcggctacttccacaccctgagagccgtgatgagaaaccccgaggaggacggcaaggacaccctgcagtgcatcgccgagatgctgcagatcaccaagcaggccatgggcagcgacctgcccatcatcgagaagaagctggagagaaagagcagcaagccccacgaggacatcatcggcatcagaagccagaaccagggcagcctggcccagggcaagaacttcctgatgagcaagttcagcagcctgaaccagaaggtgaagcagaccaagagcaacgtgaacatcggcaacctgagaaagctgggcaacttcaccaagcccgagatgaaggtgaacttcctgaagcccaacctgaaggtgaacctgtggaagagcgacagcagcctggagaccatggagaacaccggcgtgatggacaaggtgcaggccgagagcgacggcgacatgagcagcgacaacgacagctaccacagcgacgagttcctgaccaacagcaagagcgacgaggacagacagctggccaacagcctggagagcgtgggccccatcgactacgtgctgcccagctgcggcatcatcgccagcgcccccagactgggcagcagaagccagagcctgagcagcaccgacagcagcgtgcacgcccccagcgagatcaccgtggcccacggcagcggcctgggcaagggccaggagagccccctgaagaagagccccagcgccggcgacgtgcacatcctgaccggcttcgccaagcccatggacatctactgccacagattcgtgcaggacgcccagaacaaggtgacccacctgagcgagaccagaagcgtgagccagcaggccagccaggagagaaaccagatgaccaaccaggtgagcaacgagacccagagcgagagcaccgagcagacccccagcagacccagccagctggacgtgagcctgagcgccaccggcccccagttcctgagcgtggagcccgcccacagcgtggccagccagaagacccccaccagcgccagcagcatgctggagctggagaccggcctgcacgtgacccccagccccagcgagagcagcagcagcagagccgtgagccccttcgccaagatcagaagcagcatggtgcaggtggccagcatcacccaggccggcctgacccacggcatcaacttcgccgtgagcaaggtgcagaagagcccccccgagcccgagatcatcaaccaggtgcagcagaacgagctgaagaagatgttcatccagtgccagaccagaatcatccagatctag

SEQ ID NO: 21804 - DNA, 1569 bp, Artificial Sequence
  Description of Artificial Sequence: Synthetic coding sequence
atgtgccacgacgtgatcttcatggcctggctgaagcagcagttcagcgagtgcaccctgatcgacgccacccacagagacgtggacgtgctgctgctgctgagcaacagcgcctactacgtggcctactacgacgacgaggtggacaaggtgaaccagtaccagagactgagcctggagaacctggagaagatcgagatcggccccgagcccaccctgttcggcaagcccaagttcagctgcatgagactgcactacagatacaaggaggccagcggctacttccacaccctgagagccgtgatgagaaaccccgaggaggacggcaaggacaccctgcagtgcatcgccgagatgctgcagatcaccaagcaggccatgggcagcgacctgcccatcatcgagaagaagctggagagaaagagcagcaagccccacgaggacatcatcggcatcagaagccagaaccagggcagcctggcccagggcaagaacttcctgatgagcaagttcagcagcctgaaccagaaggtgaagcagaccaagagcaacgtgaacatcggcaacctgagaaagctgggcaacttcaccaagcccgagatgaaggtgaacttcctgaagcccaacctgaaggtgaacctgtggaagagcgacagcagcctggagaccatggagaacaccggcgtgatggacaaggtgcaggccgagagcgacggcgacatgagcagcgacaacgacagctaccacagcgacgagttcctgaccaacagcaagagcgacgaggacagacagctggccaacagcctggagagcgtgggccccatcgactacgtgctgcccagctgcggcatcatcgccagcgcccccagactgggcagcagaagccagagcctgagcagcaccgacagcagcgtgcacgcccccagcgagatcaccgtggcccacggcagcggcctgggcaagggccaggagagccccctgaagaagagccccagcgccggcgacgtgcacatcctgaccggcttcgccaagcccatggacatctactgccacagattcgtgcaggacgcccagaacaaggtgacccacctgagcgagaccagaagcgtgagccagcaggccagccaggagagaaaccagatgaccaaccaggtgagcaacgagacccagagcgagagcaccgagcagacccccagcagacccagccagctggacgtgagcctgagcgccaccggcccccagttcctgagcgtggagcccgcccacagcgtggccagccagaagacccccaccagcgccagcagcatgctggagctggagaccggcctgcacgtgacccccagccccagcgagagcagcagcagcagagccgtgagccccttcgccaagatcagaagcagcatggtgcaggtggccagcatcacccaggccggcctgacccacggcatcaacttcgccgtgagcaaggtgcagaagagcccccccgagcccgagatcatcaaccaggtgcagcagaacgagctgaagaagatgttcatccagtgccagaccagaatcatccagatctag

SEQ ID NO: 21805 - DNA, 372 bp, Artificial Sequence
  Description of Artificial Sequence: Synthetic coding sequence
atggagccccaggacctggagctggagctgtgcaagaagcaccacttcggcatcaacaagcccgagaagatcatccccagccccgacgacagcaagttcctgctgaagaccttcacccacatcaagagcaacgtgagcgcccccaacaagaagaaggtgaaggagagcaaggagaaggagaagctggagagaagactgctggaggagctgctgaagatgttcatggacagcgagagcttctactacagcctgacctacgacctgaccaacagcgtgcagagacagagcaccggcgagagagacggcagacccctgtggcagaaggtgcccctgaccgccagaagagccggcttcgccctgggcaagaagtag

SEQ ID NO: 21806 - DNA, 1128 bp, Artificial Sequence
  Description of Artificial Sequence: Synthetic coding sequence
atggagctgttccaggccaaggaccactacatcctgcagcagggcgagagagccctgtggtgcagcagaagagacggcggcctgcagctgagacccgccaccgacctgctgctggcctggaaccccatctgcctgggcctggtggagggcgtgatcggcaagatccagctgcacagcgacctgccctggtggctgatcctgatcagacagaaggccctggtgggcaagctgcccggcgaccacgaggtgtgcaaggtgaccaagatcgccgtgctgagcctgagcgagatggagccccaggacctggagctggagctgtgcaagaagcaccacttcggcatcaacaagcccgagaagatcatccccagccccgacgacagcaagttcctgctgaagaccttcacccacatcaagagcaacgtgagcgcccccaacaagaagaaggtgaaggagagcaaggagaaggagaagctggagagaagactgctggaggagctgctgaagatgttcatggacagcgagagcttctactacagcctgacctacgacctgaccaacagcgtgcagagacagagcaccggcgagagagacggcagacccctgtggcagaaggtggacgacagattcttctggaacaagtacatgatccaggacctgaccgagatcggcacccccgacgtggacttctggatcatccccatgatccagggcttcgtgcagatcgaggagctggtggtgaactacaccgagagcagcgacgacgagaagagcagccccgagacccccccccaggagagcacctgcgtggacgacatccaccccagattcctggtggccctgatcagcagaagaagcagacacagagccggcatgagatacaagagaagaggcgtggacaagaacggcaacgtggccaactacgtggagaccgagcagctgatccacgtgcacaaccacaccctgagcttcgtgcagaccagaggcagcgtgcccgtgttctggagccaggtgggctacagatacaaccccagacccagactggacagaagcgagaaggagaccgtggcctacttctgcgcccacttcgaggagcagctgaacatctacaagaagcagcagcagaagtag

SEQ ID NO: 21807 - DNA, 507 bp, Artificial Sequence
  Description of Artificial Sequence: Synthetic coding sequence
atgagcaagagaaagtggagaggcttcagaggcgcccagcaggagagagcccagccccccgccgccagcccccagccctgccccgccccccacgccggcctgcccggcggcagcagaagaagagcccccgcccccgccggccagcagcagatgagagccgagagcagaagcggcgcccagagaagaagaggcagcgccagaagaggcgcccacagagaggccggcggctgcgtgagaggcagaaccagaagcagcggcagcgagagaagcaacgccctgtggcaggccgtggacgccgccgaggccctggccctgagcagccccctgagaagaccctgggaccaggcccagcacttcaccaaccccgcccccttcagcaagggcccccagagcgccccccccagcccccccgccggcagaagaagaagaggcgccgacctggccctgacccccctggccggcgagggccacaccagatggagacagcccggcagacccggcaagtag

SEQ ID NO: 21808 - DNA, 3129 bp, Artificial Sequence
  Description of Artificial Sequence: Synthetic coding sequence
atggagctgcagaagggcaagggcgccgccgccgccgccgccgccagcggcgccgccggcggcggcggcggcggcgccggcgccggcgcccccggcggcggcagactgctgctgagcaccagcctggacgccaaggacgagctggaggagagactggagagatgcatgagcatcgtgaccagcatgaccgccggcgtgagcgagagagaggccaacgacgccctgaacgcctacgtgtgcaagggcctgccccagcacgaggagatctgcctgggcctgttcaccctgatcctgaccgagcccgcccaggcccagaagtgctacagagacctggccctggtgagcagagacggcatgaacatcgtgctgaacaagatcaaccagatcctgatggagaagtacctgaagctgcaggacacctgcagaacccagctggtgtggctggtgagagagctggtgaagagcggcgtgctgggcgccgacggcgtgtgcatgaccttcatgaagcagatcgccggcggcgacgtgaccgccaagaacatctggctggccgagagcgtgctggacatcctgaccgagcagagagagtgggtgctgaagagcagcatcctgatcgccatggccgtgtacacctacctgagactgatcgtggaccaccacggcaccgcccagctgcaggccctgagacagaaggaggtggacttctgcatcagcctgctgagagagagattcatggagtgcctgatgatcggcagagacctggtgagactgctgcagaacgtggccagaatccccgagttcgagctgctgtggaaggacatcatccacaacccccaggccctgagcccccagttcaccggcatcctgcagctgctgcagagcagaaccagcagaaagttcctggcctgcagactgacccccgacatggagaccaagctgctgttcatgaccagcagagtgagattcggccagcagaagagataccaggactggttccagagacagtacctgagcacccccgacagccagagcctgagatgcgacctgatcagatacatctgcggcgtggtgcaccccagcaacgaggtgctgagcagcgacatcctgcccagatgggccatcatcggctggctgctgaccacctgcaccagcaacgtggccgccagcaacgccaagctggccctgttctacgactggctgttcttcagccccgacaaggacagcatcatgaacatcgagcccgccatcctggtgatgcaccacagcatgaagccccaccccgccatcaccgccaccctgctggacttcatgtgcagaatcatccccaacttctacccccccctggagggccacgtgagacagggcgtgttcagcagcctgaaccacatcgtggagaagagagtgctggcccacctggcccccctgttcgacaaccccaagctggacaaggagctgagagccatgctgagagagaagttccccgagttctgcagcagccccagcccccccgtggaggtgaagatcgaggagcccgtgagcatggagatggacaaccacatgagcgacaaggacgagagctgctacgacaacgccgaggccgccttcagcgacgacgaggaggacctgaacagcaagggcaagaagagagagttcagattccaccccatcaaggagaccgtggtggaggagcccgtggacatcaccccctacctggaccagctggacgagagcctgagagacaaggtgctgcagctgcagaagggcagcgacaccgaggcccagtgcgaggtgatgcaggagatcgtggaccaggtgctggaggaggacttcgacagcgagcagctgagcgtgctggccagctgcctgcaggagctgttcaaggcccacttcagaggcgaggtgctgcccgaggagatcaccgaggagagcctggaggagagcgtgggcaagcccctgtacctgatcttcagaaacctgtgccagatgcaggaggacaacagcagcttcagcctgctgctggacctgctgagcgagctgtaccagaagcagcccaagatcggctaccacctgctgtactacctgagagccagcaaggccgccgccggcaagatgaacctgtacgagagcttcgcccaggccacccagctgggcgacctgcacacctgcctgatgatggacatgaaggcctgccaggaggacgacgtgagactgctgtgccacctgacccccagcatctacaccgagttccccgacgagaccctgagaagcggcgagctgctgaacatgatcgtggccgtgatcgacagcgcccagctgcaggagctggtgtgccacgtgatgatgggcaacctggtgatgttcagaaaggacagcgtgctgaacatcctgatccagagcctggactgggagaccttcgagcagtactgcgcctggcagctgttcctggcccacaacatccccctggagaccatcatccccatcctgcagcacctgaagtacaaggagcaccccgaggccctgagctgcctgctgctgcagctgagaagagagaagcccagcgaggagatggtgaagatggtgctgagcagaccctgccaccccgacgaccagttcaccaccagcatcctgagacactggtgcatgaagcacgacgagctgctggccgagcacatcaagagcctgctgatcaagaacaacagcctgcccagaaagagacagagcctgagaagcagcagcagcaagctggcccagctgaccctggagcagatcctggagcacctggacaacctgagactgaacctgaccaacaccaagcagaacttcttcagccagacccccatcctgcaggccctgcagcacgtgcaggccagctgcgacgaggcccacaagatgaagttcagcgacctgttcagcctggccgaggagtacgaggacagcagcaccaagccccccaagagcagaagaaaggccgccctgagcagccccagaagcagaaagaacgccacccagccccccaacgccgaggaggagagcggcagcagcagcgccagcgaggaggaggacaccaagcccaagcccaccaagagaaagagaaagggcagcagcgccgtgggcagcgacagcgactag

SEQ ID NO: 21809 - DNA, 1224 bp, Artificial Sequence
  Description of Artificial Sequence: Synthetic coding sequence
atggagagcgccatcaccctgtggcagttcctgctgcagctgctgctggaccagaagcacgagcacctgatctgctggaccagcaacgacggcgagttcaagctgctgaaggccgaggaggtggccaagctgtggggcctgagaaagaacaagaccaacatgaactacgacaagctgagcagagccctgagatactactacgacaagaacatcatcaagaaggtgatcggccagaagttcgtgtacaagttcgtgagcttccccgagatcctgaagatggacccccacgccgtggagatcagcagagagagcctgctgctgcaggacagcgactgcaaggccagccccgagggcagagaggcccacaagcacggcctggccgccctgagaagcaccagcagaaacgagtacatccacagcggcctgtacagcagcttcaccatcaacagcctgcagaacccccccgacgccttcaaggccatcaagaccgagaagctggaggagccccccgaggacagcccccccgtggaggaggtgagaaccgtgatcagattcgtgaccaacaagaccgacaagcacgtgaccagacccgtggtgagcctgcccagcaccagcgaggccgccgccgccagcgccttcctggccagcagcgtgagcgccaagatcagcagcctgatgctgcccaacgccgccagcatcagcagcgccagccccttcagcagcagaagccccagcctgagccccaacagccccctgcccagcgagcacagaagcctgttcctggaggccgcctgccacgacagcgacagcctggagcccctgaacctgagcagcggcagcaagaccaagagccccagcctgccccccaaggccaagaagcccaagggcctggagatcagcgccccccccctggtgctgagcggcaccgacatcggcagcatcgccctgaacagccccgccctgcccagcggcagcctgacccccgccttcttcaccgcccagacccccaacggcctgctgctgacccccagccccctgctgagcagcatccacttctggagcagcctgagccccgtggcccccctgagccccgccagactgcagggccccagcaccctgttccagttccccaccctgctgaacggccacatgcccgtgcccatccccagcctggacagagccgccagccccgtgctgctgagcagcaacagccagaagagctag

SEQ ID NO: 21810 - DNA, 813 bp, Artificial Sequence
  Description of Artificial Sequence: Synthetic coding sequence
atgctggagggccaggtggacagcctgagcgtgaccctgggccccctgggcctgcccgagctgatggtgagccagcccggctgcgcctacgccatcctgctgtgcacctggaagaaggacaccggcagcccccccgccagcgagggccccaccgacggcagcagagagacccccgccgccagagacgtggtgctgcaccagaccagcggcagaatccacaacaagaacgtgagcacccacctgatcggcaacatcaagcagggccacggcaccgagagcagcggcagcggcctgttcgccctgtgcaccctggacggcaccctgaagctgatggaggagatggaggaggccgacaagctgctgtggagcgtgcaggtggaccaccagctgttcgccctggagaagctggacgtgaccggcaacggccacgaggaggtggtggcctgcgcctgggacggccagacctacatcatcgaccacaacagaaccgtggtgagattccaggtggacgagaacatcagagccttctgcgccggcctgtacgcctgcaaggagggcagaaacagcccctgcctggtgtacgtgaccttcaaccagaagatctacgtgtactgggaggtgcagctggagagaatggagagcaccaacctggtgaagctgctggagaccaagcccgagtaccacagcctgctgcaggagctgggcgtggaccccgacgacctgcccgtgaccagagccctgctgcaccagaccctgtaccaccccgaccagcccccccagtgcgcccccagcagcctgcaggaccccacctag

SEQ ID NO: 21811 - DNA, 1008 bp, Artificial Sequence
  Description of Artificial Sequence: Synthetic coding sequence
atgcccaccttcgccggcagccaggagagcagaagccagtggatcctggagcacatccccagagactgggacggcgacggctgcagagagctggtggtgggctacaccgacagagtggtgagagccttcagatgggaggagctgggcgagggccccgagcacctgaccggccagctggtgagcctgaagaagtggatgctggagggccaggtggacagcctgagcgtgaccctgggccccctgggcctgcccgagctgatggtgagccagcccggctgcgcctacgccatcctgctgtgcacctggaagaaggacaccggcagcccccccgccagcgagggccccaccgacggcagcagagagacccccgccgccagagacgtggtgctgcaccagaccagcggcagaatccacaacaagaacgtgagcacccacctgatcggcaacatcaagcagggccacggcaccgagagcagcggcagcggcctgttcgccctgtgcaccctggacggcaccctgaagctgatggaggagatggaggaggccgacaagctgctgtggagcgtgcaggtggaccaccagctgttcgccctggagaagctggacgtgaccggcaacggccacgaggaggtggtggcctgcgcctgggacggccagacctacatcatcgaccacaacagaaccgtggtgagattccaggtggacgagaacatcagagccttctgcgccggcctgtacgcctgcaaggagggcagaaacagcccctgcctggtgtacgtgaccttcaaccagaagatctacgtgtactgggaggtgcagctggagagaatggagagcaccaacctggtgaagctgctggagaccaagcccgagtaccacagcctgctgcaggagctgggcgtggaccccgacgacctgcccgtgaccagagccctgctgcaccagaccctgtaccaccccgaccagcccccccagtgcgcccccagcagcctgcaggaccccacctag

SEQ ID NO: 21812 - DNA, 693 bp, Artificial Sequence
  Description of Artificial Sequence: Synthetic coding sequence
atgaagctgatcgtgggcatcggcggcatgaccaacggcggcaagaccaccctgaccaacagcctgctgagagccctgcccaactgctgcgtgatccaccaggacgacttcttcaagccccaggaccagatcgccgtgggcgaggacggcttcaagcagtgggacgtgctggagagcctggacatggaggccatgctggacaccgtgcaggcctggctgagcagcccccagaagttcgccagagcccacggcgtgagcgtgcagcccgaggccagcgacacccacatcctgctgctggagggcttcctgctgtacagctacaagcccctggtggacctgtacagcagaagatacttcctgaccgtgccctacgaggagtgcaagtggagaagaagcaccagaaactacaccgtgcccgacccccccggcctgttcgacggccacgtgtggcccatgtaccagaagtacagacaggagatggaggccaacggcgtggaggtggtgtacctggacggcatgaagagcagagaggagctgttcagagaggtgctggaggacatccagaacagcctgctgaacagaagccaggagagcgcccccagccccgccagacccgccagaacccagggccccggcagaggctgcggccacagaaccgccagacccgccgccagccagcaggacagcatgtag

SEQ ID NO: 21813 - DNA, 561 bp, Artificial Sequence
  Description of Artificial Sequence: Synthetic coding sequence
atgaagctgatcgtgggcatcggcggcatgaccaacggcggcaagaccaccctgaccaacagcctgctgagagccctgcccaactgctgcgtgatccaccaggacgacttcttcaagccccaggaccagatcgccgtgggcgaggacggcttcaagcagtgggacgtgctggagagcctggacatggaggccatgctggacaccgtgcaggcctggctgagcagcccccagaagttcgccagagcccacggcgtgagcgtgcagcccgaggccagcgacacccacatcctgctgctggagggcttcctgctgtacagctacaagtaccagaagtacagacaggagatggaggccaacggcgtggaggtggtgtacctggacggcatgaagagcagagaggagctgttcagagaggtgctggaggacatccagaacagcctgctgaacagaagccaggagagcgcccccagccccgccagacccgccagaacccagggccccggcagaggctgcggccacagaaccgccagacccgccgccagccagcaggacagcatgtag

SEQ ID NO: 21814 - DNA, 1425 bp, Artificial Sequence
  Description of Artificial Sequence: Synthetic coding sequence
atgagcgaggagagcgacggcaagctgatcgaggacagcctgatccagctgagatgccacttcacctggaagctgctgatcgaggcccccgagatccccgacctggagaacagaatctgggaggagatccagttcctggacaccaagtacaacgtgggcatccacaacctgctggcctacgtgaagcacctgaagggccagaacgaggaggccctggtgagcctgaagaaggccgaggacctgatccagaaggagcacgccaaccaggccgacatcagaagcctggtgacctggggcaacttcgcctgggtgtactaccacatgggcagactggccgaggcccagacctacctggacaaggtggagaacacctgcaagaagttcgccaaccccagcagatacagaatggagtgccccgaggtggactgcgaggagggctgggccctggccaagtgcggcggcaagaactacgagagagccaagacctgcttcgagaaggccctggagggcaaccccgagaaccccgagttcaacaccggctacgccatcaccgtgtacagactggacaagttcaacaccgccagcggcagaaacaaggccttcagcctgcacgtgctgaagagagccgtgagactgaaccccgacgacgtgtacatcagagtgctgctggccctgaagctgcaggacgagggccaggaggccgagggcgagaagtacatcgaggaggccctgaccagcatcagcagccaggcctacgtgttccagtacgccgccaagttctacagaagaaagggcagcgtggacaaggccctggagctgctgaagatggccctggagaccacccccaccagcgccttcctgcaccaccagatgggcctgtgctacagagcccagatgatccagatcaaggaggccaccaactggcagcccagaggccaggacagagagaccgtggacagactggtgcagctggccatctgcaagttcgagaagaccatcatgctgaagagaaccttcgagatggcctacgtggacctggccgagacctacgccgagatcggccaccacagaaaggccgaggagcacttccagaagggcctgagaatgaagatcttcgaggaccagctgaagcaggagatccactaccactacggcagattccaggagcaccacggcaagagccaggacaaggccatcacccactacctgaagggcctgaagatcgagaagatgagccacagcagagagaagctgctgaacgccctggagaagctggccaagagatgcatccaccagaacgtgagagtggtggagagcgtgagcctgctgggcctgatccacaagctgaagggcgaggtgagcgacgccctgctgtgctacgagagagccctgagactggccgccgacctgaaccccatcttctag

SEQ ID NO: 21815 - DNA, 1449 bp, Artificial Sequence
  Description of Artificial Sequence: Synthetic coding sequence
atgagcgagatcagaaaggacaccctgaaggccatcctgctggagctggagtgccacttcacctggaacctgctgaaggaggacatcgacctgttcgaggtggaggacaccatcggccagcagctggagttcctgaccaccaagagcagactggccctgtacaacctgctggcctacgtgaagcacctgaagggccagaacaaggacgccctggagtgcctggagcaggccgaggagatcatccagcaggagcacagcgacaaggaggaggtgagaagcctggtgacctggggcaactacgcctgggtgtactaccacatggaccagctggaggaggcccagaagtacaccggcaagatcggcaacgtgtgcaagaagctgagcagccccagcaactacaagctggagtgccccgagaccgactgcgagaagggctgggccctgctgaagttcggcggcaagtactaccagaaggccaaggccgccttcgagaaggccctggaggtggagcccgacaaccccgagttcaacatcggctacgccatcaccgtgtacagactggacgacagcgacagagagggcagcgtgaagagcttcagcctgggccccctgagaaaggccgtgaccctgaaccccgacaacagctacatcaaggtgttcctggccctgaagctgcaggacgtgcacgccgaggccgagggcgagaagtacatcgaggagatcctggaccagatcagcagccagccctacgtgctgagatacgccgccaagttctacagaagaaagaacagctggaacaaggccctggagctgctgaagaaggccctggaggtgacccccaccagcagcttcctgcaccaccagatgggcctgtgctacagagcccagatgatccagatcaagaaggccacccacaacagacccaagggcaaggacaagctgaaggtggacgagctgatcagcagcgccatcttccacttcaaggccgccatggagagagacagcatgttcgccttcgcctacaccgacctggccaacatgtacgccgagggcggccagtacagcaacgccgaggacatcttcagaaaggccctgagactggagaacatcaccgacgaccacaagcaccagatccactaccactacggcagattccaggagttccacagaaagagcgagaacaccgccatccaccactacctggaggccctgaaggtgaaggacagaagccccctgagaaccaagctgaccagcgccctgaagaagctgagcaccaagagactgtgccacaacgccctggacgtgcagagcctgagcgccctgggcttcgtgtacaagctggagggcgagaagagacaggccgccgagtactacgagaaggcccagaagatcgaccccgagaacgccgagttcctgaccgccctgtgcgagctgagactgagcatctag

SEQ ID NO: 21816 - DNA, 1305 bp, Artificial Sequence
  Description of Artificial Sequence: Synthetic coding sequence
atgagcgagatcagaaaggacaccctgaaggccatcctgctggagctggagtgccacttcacctggaacctgctgaaggaggacatcgacctgttcgaggtggaggacaccatcggccagcagctggagttcctgaccaccaagagcagactggccctgtacaacctgctggcctacgtgaagcacctgaagggccagaacaaggacgccctggagtgcctggagcaggccgaggagatcatccagcaggagcacagcgacaaggaggaggtgagaagcctggtgacctggggcaactacgcctgggtgtactaccacatggaccagctggaggaggcccagaagtacaccggcaagatcggcaacgtgtgcaagaagctgagcagccccagcaactacaagctggagtgccccgagaccgactgcgagaagggctgggccctgctgaagttcggcggcaagtactaccagaaggccgtgaccctgaaccccgacaacagctacatcaaggtgttcctggccctgaagctgcaggacgtgcacgccgaggccgagggcgagaagtacatcgaggagatcctggaccagatcagcagccagccctacgtgctgagatacgccgccaagttctacagaagaaagaacagctggaacaaggccctggagctgctgaagaaggccctggaggtgacccccaccagcagcttcctgcaccaccagatgggcctgtgctacagagcccagatgatccagatcaagaaggccacccacaacagacccaagggcaaggacaagctgaaggtggacgagctgatcagcagcgccatcttccacttcaaggccgccatggagagagacagcatgttcgccttcgcctacaccgacctggccaacatgtacgccgagggcggccagtacagcaacgccgaggacatcttcagaaaggccctgagactggagaacatcaccgacgaccacaagcaccagatccactaccactacggcagattccaggagttccacagaaagagcgagaacaccgccatccaccactacctggaggccctgaaggtgaaggacagaagccccctgagaaccaagctgaccagcgccctgaagaagctgagcaccaagagactgtgccacaacgccctggacgtgcagagcctgagcgccctgggcttcgtgtacaagctggagggcgagaagagacaggccgccgagtactacgagaaggcccagaagatcgaccccgagaacgccgagttcctgaccgccctgtgcgagctgagactgagcatctag

SEQ ID NO: 21817 - DNA, 2061 bp, Artificial Sequence
  Description of Artificial Sequence: Synthetic coding sequence
atgaagccccccttcctgctggccctggtggtgtgcagcgtggtgagcaccaacctgaagatggtgagcaagagaaacagcgtggacggctgcatcgactggagcgtggacctgaagacctacatggccctggccggcgagcccgtgagagtgaagtgcgccctgttctacagctacatcagaaccaactacagcaccgcccagagcaccggcctgagactgatgtggtacaagaacaagggcgacctggaggagcccatcatcttcagcgaggtgagaatgagcaaggaggaggacagcatctggttccacagcgccgaggcccaggacagcggcttctacacctgcgtgctgagaaacagcacctactgcatgaaggtgagcatgagcctgaccgtggccgagaacgagagcggcctgtgctacaacagcagaatcagatacctggagaagagcgaggtgaccaagagaaaggagatcagctgccccgacatggacgacttcaagaagagcgaccaggagcccgacgtggtgtggtacaaggagtgcaagcccaagatgtggagaagcatcatcatccagaagggcaacgccctgctgatccaggaggtgcaggaggaggacggcggcaactacacctgcgagctgaagtacgagggcaagctggtgagaagaaccaccgagctgaaggtgaccgccctgctgaccgacaagccccccaagcccctgttccccatggagaaccagcccagcgtgatcgacgtgcagctgggcaagcccctgaacatcccctgcaaggccttcttcggcttcagcggcgagagcggccccatgatctactggatgaagggcgagaagttcatcgaggagctggccggccacatcagagagggcgagatcagactgctgaaggagcacctgggcgagaaggaggtggagctggccctgatcttcgacagcgtggtggaggccgacctggccaactacacctgccacgtggagaacagaaacggcagaaagcacgccagcgtgctgctgagaaagaaggacctgatctacaagatcgagctggccggcggcctgggcgccatcttcctgctgctggtgctgctggtggtgatctacaagtgctacaacatcgagctgatgctgttctacagacagcacttcggcgccgacgagaccaacgacgacaacaaggagtacgacgcctacctgagctacaccaaggtggaccaggacaccctggactgcgacaaccccgaggaggagcagttcgccctggaggtgctgcccgacgtgctggagaagcactacggctacaagctgttcatccccgagagagacctgatccccagcggcacctacatggaggacctgaccagatacgtggagcagagcagaagactgatcatcgtgctgacccccgactacatcctgagaagaggctggagcatcttcgagctggagagcagactgcacaacatgctggtgagcggcgagatcaaggtgatcctgatcgagtgcaccgagctgaagggcaaggtgaactgccaggaggtggagagcctgaagagaagcatcaagctgctgagcctgatcaagtggaagggcagcaagagcagcaagctgaacagcaagttctggaagcacctggtgtacgagatgcccatcaagaagaaggagatgctgcccagatgccacgtgctggacagcgccgagcagggcctgttcggcgagctgcagcccatccccagcatcgccatgaccagcaccagcgccaccctggtgagcagccaggccgacctgcccgagttccaccccagcgacagcatgcagatcagacactgctgcagaggctacaagcacgagatccccgccaccaccctgcccgtgcccagcctgggcaaccaccacacctactgcaacctgcccctgaccctgctgaacggccagctgcccctgaacaacaccctgaaggacacccaggagttccacagaaacagcagcctgctgcccctgagcagcaaggagctgagcttcaccagcgacatctggtag

SEQ ID NO: 21818 - DNA, 1143 bp, Artificial Sequence
  Description of Artificial Sequence: Synthetic coding sequence
atggccttcgtgtgcctggccatcggctgcctgtacaccttcctgatcagcaccaccttcggctgcaccagcagcagcgacaccgagatcaaggtgaaccccccccaggacttcgagatcgtggaccccggctacctgggctacctgtacctgcagtggcagccccccctgagcctggaccacttcaaggagtgcaccgtggagtacgagctgaagtacagaaacatcggcagcgagacctggaagaccatcatcaccaagaacctgcactacaaggacggcttcgacctgaacaagggcatcgaggccaagatccacaccctgctgccctggcagtgcaccaacggcagcgaggtgcagagcagctgggccgagaccacctactggatcagcccccagggcatccccgagaccaaggtgcaggacatggactgcgtgtactacaactggcagtacctgctgtgcagctggaagcccggcatcggcgtgctgctggacaccaactacaacctgttctactggtacgagggcctggaccacgccctgcagtgcgtggactacatcaaggccgacggccagaacatcggctgcagattcccctacctggaggccagcgactacaaggacttctacatctgcgtgaacggcagcagcgagaacaagcccatcagaagcagctacttcaccttccagctgcagaacatcgtgaagcccctgccccccgtgtacctgaccttcaccagagagagcagctgcgagatcaagctgaagtggagcatccccctgggccccatccccgccagatgcttcgactacgagatcgagatcagagaggacgacaccaccctggtgaccgccaccgtggagaacgagacctacaccctgaagaccaccaacgagaccagacagctgtgcttcgtggtgagaagcaaggtgaacatctactgcagcgacgacggcatctggagcgagtggagcgacaagcagtgctgggagggcgaggacctgagcaagaagaccctgctgagattctggctgcccttcggcttcatcctgatcctggtgatcttcgtgaccggcctgctgctgagaaagcccaacacctaccccaagatgatccccgagttcttctgcgacacctag

SEQ ID NO: 21819 - DNA, 1011 bp, Artificial Sequence
  Description of Artificial Sequence: Synthetic coding sequence
atgagcagaagcgtgctggaggccctgaccagcagcaccgccatgcagtgcgtgcccagcgacggctgcgccatgctgctgagagtgagagccagcatcaccctgcacgagagactgagaggcctggaggcctgcgccatgagcctggacacccaggagacccagtgccagagcgtgtgggtggccagagccagccacagacagcagggcggccagcagctgcaggtgcacttcggctgcttcgccgtgagcgtggcccagcacctgtacgtgaccctgagaaccatcccccacttctgcggcgtgcagctggaccagagacacctggtggaggccggcaagctgagctactgggtggacagaagaagaaaggccatcctggtgcaggtgcccagagccagcggcagccccgactactacctgagactgtgcctgaagagattcacctgcgaggacgccggcgcccccgtgagagtgaccgccaacagcgtgagccaggccgtgttcctgccctacagccaggagctgccctgcctgtgcctggagggctggagcgccacccccgacgccgtgagaatccagatctgccccttcgagaacgacaccgaggccctggaggtgctgtgggacaccgtgtactaccaccccgagagccagaccctgagctgggagcccgcctgccccgtgagcggccacgtgagcctgtgctggagacccggccccggcgccggctgcagaaagctgcagcagagcagccagctggtgcacagaagagtgcagtaccccctggtggacacccagccccagctgtgcctgaagttcagcaccagctggggcagctgggtgagatgccccttcgagcagagaagattccccaccccccccaccagcagatgcacctgcgtgaccggcggcagccacagcagcctgcccgccaacgcccacagcagacccgccagaagcctgcagccccaggtgacctggcagccccccctgctgctgcccagctag

SEQ ID NO: 21820 - DNA, 1011 bp, Artificial Sequence; identical to SEQ ID NO: 21819
  Description of Artificial Sequence: Synthetic coding sequence

SEQ ID NO: 21821 - DNA, 471 bp, Artificial Sequence
  Description of Artificial Sequence: Synthetic coding sequence
atgagaggcggcggcggcgtgcccctgatccacttcagcctgcccgtgtgcagccccttcctgtacctgagcctgcccgagccccaggccaagcaccagagaagacccggcagcgagcagggcgcccacgtggccagcgtggaccacccccccgcctgcaccgccctgggcggccccagaaacgccagacccagcgccggcggcagcctgttcaccagcctgcagcccagcgaggacaccagcgagtggggcgccgagcccgccgacggcgagaacaagaacgacgacaccctgtacacccccgacgacctgagcatccccggccacttcgtgcccaccgtgtgccccgccgagaccctgggctgcagcagactggagctgagcgtgatcggcttcgaggagggccccagcatgggcaccgccgtgttccagctgcagtacctgctggacctgctgggcagcagactgtag

SEQ ID NO: 21822 - DNA, 1386 bp, Artificial Sequence
  Description of Artificial Sequence: Synthetic coding sequence
atggccctggccttcggctgcccccccggcggcggcggcggcggctgccccggcggcggcggcggcggcggcggcgccggccccggccccagccccgtgaccgccgccctgagagacgacctgggcagcaacatccacctgctgaagggcctgaacgtgagattcagatgcttcctggccaaggtgcacgagctggagagaagaaacagactgctggagaagcagctggagcagcagcagagcgagagagagagaagactgagatacaagaccttcagcagagagcaggccgtgcagaccggccccgagctgctgagaccccccgcccccggcggcggccacggcctgagcagcggcgccgccgccggcgccaacgccaacgccgtggccctgggcggcctgccccccggcggcggcagccacccccagcactacggcagactgcccggcaccatctggagctacacccaggtgagaagaaccggcggcggcggcgtggagaccgtgcagggccccggcgtgagctgggtgcaccccgacggcgtgggcgtgcagatcgacaccatcacccccgagatcagagccctgtacaacgtgctggccaaggtgaagagagagagagacgagtacaagagaagatgggaggaggagctggccaagagaatgaacctgcagaccatggtggacaccctgcaggaggccgcccaggaggccgacgccatccaggaggagatgaacgagaagatcgagagactgaaggccgagctggtggtgttcaagggcctgatgagcgacgtggtgcccaagaagaaggagagaaaggtggccagcgacgacgacatcagcgagcaggacggcgaggtgaacagattcagcgacgacgaggtgggcagcatgaacatcaccgacgagatgaagagaatgttcaaccagctgagagagaccttcgacttcgacgacgactgcgacagcctgacctgggaggagaacgaggacaccctgctgctgtgggaggacttcaccaactgcaaccccaccatcgacctgcagggcgagcaggaggagaacctgggcaacctgatccacgagaccgagagcttcttcaagaccagagacaaggagtaccaggagaccatcggccagatcgagctggagctggccaccgccaagagcgacatgaacagacacctgcacgagtacatggagatgtgcagcatgaagagaggcctggacgtgcagatggagacctgcagaagactgatcaagggcagcgccgacagaaacagccccagccccagcagcgtggccagcagcgacagcggcagcaccgacgagatccaggacgagttcgagagagaggccgacgtggagcccatggtgagctag

SEQ ID NO: 21823 - DNA, 1554 bp, Artificial Sequence
  Description of Artificial Sequence: Synthetic coding sequence
atggtgaacagcctgctgttcggcgagatggccctggccttcggctgcccccccggcggcggcggcggcggctgccccggcggcggcggcggcggcggcggcgccggccccggccccagccccgtgaccgccgccctgagagacgacctgggcagcaacatccacctgctgaagggcctgaacgtgagattcagatgcttcctggccaaggtgcacgagctggagagaagaaacagactgctggagaagcagctggagcagcagcagagcgagagagagagaagactgagatacaagaccttcagcagagagcaggccgtgcagaccggccccgagctgctgagaccccccgcccccggcggcggccacggcctgagcagcggcgccgccgccggcgccaacgccaacgccgtggccctgggcggcctgccccccggcggcggcagccacccccagcactacggcagactgcccggcaccatctggagctacacccaggtgagaagaaccggcggcggcggcgtggagaccgtgcagggccccggcgtgagctgggtgcaccccgacggcgtgggcgtgcagatcgacaccatcacccccgagatcagagccctgtacaacgtgctggccaaggtgaagagagagagagacgagtacaagagaagatgggaggaggagctggccaagagaatgaacctgcagaccatggtggacaccctgcaggaggccgcccaggaggccgacgccatccaggaggagatgaacgagaagatcgagagactgaaggccgagctggtggtgttcaagggcctgatgagcgaccccatgaccgacctggacaccaagatccaggagaaggccatgaaggtggacatggacatctgcagaagaatcgacatcaccgccaagctgtgcgacgtggcccagcagagaaacagcgaggacgtgagcaagatcttccaggtggtgcccaagaagaaggagagaaaggtggccagcgacgacgacatcagcgagcaggacggcgaggtgaacagattcagcgacgacgaggtgggcagcatgaacatcaccgacgagatgaagagaatgttcaaccagctgagagagaccttcgacttcgacgacgactgcgacagcctgacctgggaggagaacgaggacaccctgctgctgtgggaggacttcaccaactgcaaccccaccatcgacctgcagggcgagcaggaggagaacctgggcaacctgatccacgagaccgagagcttcttcaagaccagagacaaggagtaccaggagaccatcggccagatcgagctggagctggccaccgccaagagcgacatgaacagacacctgcacgagtacatggagatgtgcagcatgaagagaggcctggacgtgcagatggagacctgcagaagactgatcaagggcagcgccgacagaaacagccccagccccagcagcgtggccagcagcgacagcggcagcaccgacgagatccaggacgagttcgagagagaggccgacgtggagcccatggtgagctag

SEQ ID NO: 21824 - DNA, 1971 bp, Artificial Sequence
  Description of Artificial Sequence: Synthetic coding sequence
atggccagaatgtgcgtgaagacccagagactggacgtggccaaggtgtgcctgggcaacatgggccacgccagaggcgccagagccctgagagaggccgagcaggagcccgagctggaggccagagtggccgtgctggccacccagctgggcatgctggaggacgccgagcagctgtacagaaagtgcaagagacacgacctgctgaacaagttctaccaggccgccggcagatggcaggaggccctgcaggtggccgagcaccacgacagagtgcacctgagaagcacctaccacagatacgccggccacctggaggccagcgccgactgcagcagagccctgagctactacgagaagagcgacacccacagattcgaggtgcccagaatgctgagcgaggacctgcccagcctggagctgtacgtgaacaagatgaaggacaagaccctgtggagatggtgggcccagtacctggagagccagggcgagatggacgccgccctgcactactacgagctggccagagaccacttcagcctggtgagaatccactgcttccagggcaacgtgcagaaggccgcccagatcgccaacgagaccggcaacctggccgccagctaccacctggccagacagtacgagagccaggaggaggtgggccaggccgtgcacttctacaccagagcccaggccttcaagaacgccatcagactgtgcaaggagaacggcctggacgaccagctgatgaacctggccctgctgagcagccccgaggacatgatcgaggccgccagatactacgaggagaagggcgtgcagatggacagagccgtgatgctgtaccacaaggccggccacttcagcaaggccctggagctggccttcgccacccagcagttcgtggccctgcagctgatcgccgaggacctggacgagaccagcgaccccgccctgctggccagatgcagcgacttcttcatcgagcacagccagtacgagagagccgtggagctgctgctggccgccagaaagtaccaggaggccctgcagctgtgcctgggccagaacatgagcatcaccgaggagatggccgagaagatgaccgtggccaaggacagcagcgacctgcccgaggagagcagaagagagctgctggagcagatcgccgactgctgcatgagacagggcagctaccacctggccaccaagaagtacacccaggccggcaacaagctgaaggccatgagagccctgctgaagagcggcgacaccgagaagatcaccttcttcgccagcgtgagcagacagaaggagatctacatcatggccgccaactacctgcagagcctggactggagaaaggagcccgagatcatgaagaacatcatcggcttctacaccaagggcagagccctggacctgctggccggcttctacgacgcctgcgcccaggtggagatcgacgagtaccagaactacgacaaggcccacggcgccctgaccgaggcctacaagtgcctggccaaggccaaggccaagagccccctggaccaggagaccagactggcccagctgcagagcagaatggccctggtgaagagattcatccaggccagaagaacctacaccgaggaccccaaggagagcatcaagcagtgcgagctgctgctggaggagcccgacctggacagcaccatcagaatcggcgacgtgtacggcttcctggtggagcactacgtgagaaaggaggagtaccagaccgcctacagattcctggaggagatgagaagaagactgcccctggccaacatgagctactacgtgagcccccaggccgtggacgccgtgcacagaggcctgggcctgcccctgcccagaaccgtgcccgagcaggtgagacacaacagcatggaggacgccagagagctggacgaggaggtggtggaggaggccgacgacgacccctag

SEQ ID NO: 21825 - DNA, 4389 bp, Artificial Sequence
  Description of Artificial Sequence: Synthetic coding sequence
atggccctgtactacgaccaccagatcgaggcccccgacgccgccggcagccccagcttcatcagctggcaccccgtgcaccccttcctggccgtggcctacatcagcaccaccagcaccggcagcgtggacatctacctggagcagggcgagtgcgtgcccgacacccacgtggagagacccttcagagtggccagcctgtgctggcaccccaccagactggtgctggccgtgggctgggagaccggcgaggtgaccgtgttcaacaagcaggacaaggagcagcacaccatgcccctgacccacaccgccgacatcaccgtgctgagatggagccccagcggcaactgcctgctgagcggcgacagactgggcgtgctgctgctgtggagactggaccagagaggcagagtgcagggcacccccctgctgaagcacgagtacggcaagcacctgacccactgcatcttcagactgcccccccccggcgaggacctggtgcagctggccaaggccgccgtgagcggcgacgagaaggccctggacatgttcaactggaagaagagcagcagcggcagcctgctgaagatgggcagccacgagggcctgctgttcttcgtgagcctgatggacggcaccgtgcactacgtggacgagaagggcaagaccacccaggtggtgagcgccgacagcaccatccagatgctgttctacatggagaagagagaggccctggtggtggtgaccgagaacctgagactgagcctgtacaccgtgccccccgagggcaaggccgaggaggtgatgaaggtgaagctgagcggcaagaccggcagaagagccgacatcgccctgatcgagggcagcctgctggtgatggccgtgggcgaggccgccctgagattctgggacatcgagagaggcgagaactacatcctgagccccgacgagaagttcggcttcgagaagggcgagaacatgaactgcgtgtgctactgcaaggtgaagggcctgctggccgccggcaccgacagaggcagagtggccatgtggagaaaggtgcccgacttcctgggcagccccggcgccgagggcaaggacagatgggccctgcagacccccaccgagctgcagggcaacatcacccagatccagtggggcagcagaaagaacctgctggccgtgaacagcgtgatcagcgtggccatcctgagcgagagagccatgagcagccacttccaccagcaggtggccgccatgcaggtgagccccagcctgctgaacgtgtgcttcctgagcaccggcgtggcccacagcctgagaaccgacatgcacatcagcggcgtgttcgccaccaaggacgccgtggccgtgtggaacggcagacaggtggccatcttcgagctgagcggcgccgccatcagaagcgccggcaccttcctgtgcgagacccccgtgctggccatgcacgaggagaacgtgtacaccgtggagagcaacagagtgcaggtgagaacctggcagggcaccgtgaagcagctgctgctgttcagcgagaccgagggcaacccctgcttcctggacatctgcggcaacttcctggtggtgggcaccgacctggcccacttcaagagcttcgacctgagcagaagagaggccaaggcccactgcagctgcagaagcctggccgagctggtgcccggcgtgggcggcatcgccagcctgagatgcagcagcagcggcagcaccatcagcatcctgcccagcaaggccgacaacagccccgacagcaagatctgcttctacgacgtggagatggacaccgtgaccgtgttcgacttcaagaccggccagatcgacagaagagagaccctgagcttcaacgagcaggagaccaacaagagccacctgttcgtggacgagggcctgaagaactacgtgcccgtgaaccacttctgggaccagagcgagcccagactgttcgtgtgcgaggccgtgcaggagacccccagaagccagccccagagcgccaacggccagccccaggacggcagagccggccccgccgccgacgtgctgatcctgagcttcttcatcagcgaggagcacggcttcctgctgcacgagagcttccccagacccgccaccagccacagcctgctgggcatggaggtgccctactactacttcaccagaaagcccgaggaggccgacagagaggacgaggtggagcccggctgccaccacatcccccagatggtgagcagaagacccctgagagacttcgtgggcctggaggactgcgacaaggccaccagagacgccatgctgcacttcagcttcttcgtgaccatcggcgacatggacgaggccttcaagagcatcaagctgatcaagagcgaggccgtgtgggagaacatggccagaatgtgcgtgaagacccagagactggacgtggccaaggtgtgcctgggcaacatgggccacgccagaggcgccagagccctgagagaggccgagcaggagcccgagctggaggccagagtggccgtgctggccacccagctgggcatgctggaggacgccgagcagctgtacagaaagtgcaagagacacgacctgctgaacaagttctaccaggccgccggcagatggcaggaggccctgcaggtggccgagcaccacgacagagtgcacctgagaagcacctaccacagatacgccggccacctggaggccagcgccgactgcagcagagccctgagctactacgagaagagcgacacccacagattcgaggtgcccagaatgctgagcgaggacctgcccagcctggagctgtacgtgaacaagatgaaggacaagaccctgtggagatggtgggcccagtacctggagagccagggcgagatggacgccgccctgcactactacgagctggccagagaccacttcagcctggtgagaatccactgcttccagggcaacgtgcagaaggccgcccagatcgccaacgagaccggcaacctggccgccagctaccacctggccagacagtacgagagccaggaggaggtgggccaggccgtgcacttctacaccagagcccaggccttcaagaacgccatcagactgtgcaaggagaacggcctggacgaccagctgatgaacctggccctgctgagcagccccgaggacatgatcgaggccgccagatactacgaggagaagggcgtgcagatggacagagccgtgatgctgtaccacaaggccggccacttcagcaaggccctggagctggccttcgccacccagcagttcgtggccctgcagctgatcgccgaggacctggacgagaccagcgaccccgccctgctggccagatgcagcgacttcttcatcgagcacagccagtacgagagagccgtggagctgctgctggccgccagaaagtaccaggaggccctgcagctgtgcctgggccagaacatgagcatcaccgaggagatggccgagaagatgaccgtggccaaggacagcagcgacctgcccgaggagagcagaagagagctgctggagcagatcgccgactgctgcatgagacagggcagctaccacctggccaccaagaagtacacccaggccggcaacaagctgaaggccatgagagccctgctgaagagcggcgacaccgagaagatcaccttcttcgccagcgtgagcagacagaaggagatctacatcatggccgccaactacctgcagagcctggactggagaaaggagcccgagatcatgaagaacatcatcggcttctacaccaagggcagagccctggacctgctggccggcttctacgacgcctgcgcccaggtggagatcgacgagtaccagaactacgacaaggcccacggcgccctgaccgaggcctacaagtgcctggccaaggccaaggccaagagccccctggaccaggagaccagactggcccagctgcagagcagaatggccctggtgaagagattcatccaggccagaagaacctacaccgaggaccccaaggagagcatcaagcagtgcgagctgctgctggaggagcccgacctggacagcaccatcagaatcggcgacgtgtacggcttcctggtggagcactacgtgagaaaggaggagtaccagaccgcctacagattcctggaggagatgagaagaagactgcccctggccaacatgagctactacgtgagcccccaggccgtggacgccgtgcacagaggcctgggcctgcccctgcccagaaccgtgcccgagcaggtgagacacaacagcatggaggacgccagagagctggacgaggaggtggtggaggaggccgacgacgacccctag

SEQ ID NO: 21826 - DNA, 4389 bp, Artificial Sequence; identical to SEQ ID NO: 21825
  Description of Artificial Sequence: Synthetic coding sequence

SEQ ID NO: 21827 - DNA, 2406 bp, Artificial Sequence
  Description of Artificial Sequence: Synthetic coding sequence
atggccctgtactacgaccaccagatcgaggcccccgacgccgccggcagccccagcttcatcagctggcaccccgtgcaccccttcctggccgtggcctacatcagcaccaccagcaccggcagcgtggacatctacctggagcagggcgagtgcgtgcccgacacccacgtggagagacccttcagagtggccagcctgtgctggcaccccaccagactggtgctggccgtgggctgggagaccggcgaggtgaccgtgttcaacaagcaggacaaggagcagcacaccatgcccctgacccacaccgccgacatcaccgtgctgagatggagccccagcggcaactgcctgctgagcggcgacagactgggcgtgctgctgctgtggagactggaccagagaggcagagtgcagggcacccccctgctgaagcacgagtacggcaagcacctgacccactgcatcttcagactgcccccccccggcgaggacctggtgcagctggccaaggccgccgtgagcggcgacgagaaggccctggacatgttcaactggaagaagagcagcagcggcagcctgctgaagatgggcagccacgagggcctgctgttcttcgtgagcctgatggacggcaccgtgcactacgtggacgagaagggcaagaccacccaggtggtgagcgccgacagcaccatccagatgctgttctacatggagaagagagaggccctggtggtggtgaccgagaacctgagactgagcctgtacaccgtgccccccgagggcaaggccgaggaggtgatgaaggtgaagctgagcggcaagaccggcagaagagccgacatcgccctgatcgagggcagcctgctggtgatggccgtgggcgaggccgccctgagattctgggacatcgagagaggcgagaactacatcctgagccccgacgagaagttcggcttcgagaagggcgagaacatgaactgcgtgtgctactgcaaggtgaagggcctgctggccgccggcaccgacagaggcagagtggccatgtggagaaaggtgcccgacttcctgggcagccccggcgccgagggcaaggacagatgggccctgcagacccccaccgagctgcagggcaacatcacccagatccagtggggcagcagaaagaacctgctggccgtgaacagcgtgatcagcgtggccatcctgagcgagagagccatgagcagccacttccaccagcaggtggccgccatgcaggtgagccccagcctgctgaacgtgtgcttcctgagcaccggcgtggcccacagcctgagaaccgacatgcacatcagcggcgtgttcgccaccaaggacgccgtggccgtgtggaacggcagacaggtggccatcttcgagctgagcggcgccgccatcagaagcgccggcaccttcctgtgcgagacccccgtgctggccatgcacgaggagaacgtgtacaccgtggagagcaacagagtgcaggtgagaacctggcagggcaccgtgaagcagctgctgctgttcagcgagaccgagggcaacccctgcttcctggacatctgcggcaacttcctggtggtgggcaccgacctggcccacttcaagagcttcgacctgagcagaagagaggccaaggcccactgcagctgcagaagcctggccgagctggtgcccggcgtgggcggcatcgccagcctgagatgcagcagcagcggcagcaccatcagcatcctgcccagcaaggccgacaacagccccgacagcaagatctgcttctacgacgtggagatggacaccgtgaccgtgttcgacttcaagaccggccagatcgacagaagagagaccctgagcttcaacgagcaggagaccaacaagagccacctgttcgtggacgagggcctgaagaactacgtgcccgtgaaccacttctgggaccagagcgagcccagactgttcgtgtgcgaggccgtgcaggagacccccagaagccagccccagagcgccaacggccagccccaggacggcagagccggccccgccgccgacgtgctgatcctgagcttcttcatcagcgaggagcacggcttcctgctgcacgagagcttccccagacccgccaccagccacagcctgctgggcatggaggtgccctactactacttcaccagaaagcccgaggaggccgacagagaggacgaggtggagcccggctgccaccacatcccccagatggtgagcagaagacccctgagagacttcgtgggcctggaggactgcgacaaggccaccagagacgccatgctgcacttcagcttcttcgtgaccatcggcgacatggacgaggccttcaagagcatcaagctgatcaagagagcctag

SEQ ID NO: 21828 - DNA, 399 bp, Artificial Sequence
  Description of Artificial Sequence: Synthetic coding sequence
atggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggccatcggcgccagaaacctgctgaagagcatcgccaagcagagagaggcccagcagcagcagctgcaggccctgatcgccgagaagaagatgcagctggagagatacagagtggagtacgaggccctgtgcaaggtggaggccgagcagaacgagttcatcgaccagttcatcttccagaagtag

SEQ ID NO: 21829 - DNA, 477 bp, Artificial Sequence
  Description of Artificial Sequence: Synthetic coding sequence
atgacccacctgctgctgaccgccaccgtgacccccagcgagcagaacagcagcagagagcccggctgggagaccgccatggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggccatcggcgccagaaacctgctgaagagcatcgccaagcagagagaggcccagcagcagcagctgcaggccctgatcgccgagaagaagatgcagctggagagatacagagtggagtacgaggccctgtgcaaggtggaggccgagcagaacgagttcatcgaccagttcatcttccagaagtag

SEQ ID NO: 21830 - DNA, 345 bp, Artificial Sequence
  Description of Artificial Sequence: Synthetic coding sequence
atggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggccatcggcgccagaaacctgctgaagagcatcgccaagcagagagaggcccagcagcagcagctgcaggccctgatcgccgagaagaagatgcagctggagagaaacgagctgaagatcagcctgctgtag

SEQ ID NO: 21831 - DNA, 399 bp, Artificial Sequence; identical to SEQ ID NO: 21828
  Description of Artificial Sequence: Synthetic coding sequence

SEQ ID NO: 21832 - DNA, 216 bp, Artificial Sequence
  Description of Artificial Sequence: Synthetic coding sequence
gacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggtgagcggctag

SEQ ID NO: 21833 - DNA, 558 bp, Artificial Sequence
  Description of Artificial Sequence: Synthetic coding sequence
atggtgaagctggccgccaagtgcatcctggccgaccccgccgtgggcaagaccgccctggcccagatcttcagaagcgacggcgcccacttccagaagagctacaccctgaccaccggcatggacctggtggtgaagaccgtgcccgtgcccgacaccggcgacagcgtggagctgttcatcttcgacagcgccggcaaggagctgttcagcgagatgctggacaagctgtgggagagccccaacgtgctgtgcctggtgtacgacgtgaccaacgaggagagcttcaacaactgcagcaagtggctggagaaggccagaagccaggcccccggcatcagcctgcccggcgtgctggtgggcaacaagaccgacctggccggcagaagagccgtggacagcgccgaggccagagcctgggccctgggccagggcctggagtgcttcgagaccagcgtgaaggagatggagaacttcgaggcccccttccactgcctggccaagcagttccaccagctgtacagagagaaggtggaggtgttcagagccctggcctag

SEQ ID NO: 21834 - DNA, 390 bp, Artificial Sequence
  Description of Artificial Sequence: Synthetic coding sequence
tgaagcgacggcgcccacttccagaagagctacaccctgaccaccggcatggacctggtggtgaagaccgtgcccgtgcccgacaccggcgacagcgtggagctgttcatcttcgacagcgccggcaaggagctgttcagcgagatgctggacaagctgtgggagagccccaacgtgctgtgcctggtgtacgacgtgaccaacgaggagagcttcaacaactgcagcaagtggctggagaaggccagaagccaggcccccggcatcagcctgcccggcgtgctggtgggcaacaagaccgacctggccggcagaagagccgtggacagcgccgaggccagagcctgggccctgggccagggcctggagtgcttcgagaccagcgtgtag

SEQ ID NO: 21835 - DNA, 552 bp, Artificial Sequence
  Description of Artificial Sequence: Synthetic coding sequence
atggtgaagctggccgccaagtgcatcctggccgtgcccgtggacaagagactgagcagagccgaggtgtgcagcggctgctgcgaggtgtgcagaagcgtgagctggacctgcgccctgcccgccgccagcgagcaggtgcccgtgagaggcgaccccgccgtgggcaagaccgccctggcccagatcttcagaagcgacggcgcccacttccagaagagctacaccctgaccaccggcatggacctggtggtgaagaccgtgcccgtgcccgacaccggcgacagcgtggagctgttcatcttcgacagcgccggcaaggagctgttcagcgagatgctggacaagctgtgggagagccccaacgtgctgtgcctggtgtacgacgtgaccaacgaggagagcttcaacaactgcagcaagtggctggagaaggccagaagccaggcccccggcatcagcctgcccggcgtgctggtgggcaacaagaccgacctggccggcagaagagccgtggacagcgccgaggccagagcctgggccctgggctag

SEQ ID NO: 21836 - DNA, 351 bp, Artificial Sequence
  Description of Artificial Sequence: Synthetic coding sequence
atggtgaagctggccgccaagtgcatcctggccgaccccgccgtgggcaagaccgccctggcccagatcttcagaagcgacggcgcccacttccagaagagctacaccctgaccaccggcatggacctggtggtgaagaccgtgcccgtgcccgacaccggcgacagcgtggagctgttcatcttcgacagcgccggcaaggagctgttcagcgagatgctggacaagctgtgggagagccccaacgtgctgtgcctggtgtacgacgtgaccaacgaggagagcttcaacaactgcagcaagtggctggagaaggccagaagccaggcccccggcatcagcctgccctag

SEQ ID NO: 21837 - DNA, 561 bp, Artificial Sequence
  Description of Artificial Sequence: Synthetic coding sequence
atggtgaagctggccgccaagtgcatcctggccggcgaccccgccgtgggcaagaccgccctggcccagatcttcagaagcgacggcgcccacttccagaagagctacaccctgaccaccggcatggacctggtggtgaagaccgtgcccgtgcccgacaccggcgacagcgtggagctgttcatcttcgacagcgccggcaaggagctgttcagcgagatgctggacaagctgtgggagagccccaacgtgctgtgcctggtgtacgacgtgaccaacgaggagagcttcaacaactgcagcaagtggctggagaaggccagaagccaggcccccggcatcagcctgcccggcgtgctggtgggcaacaagaccgacctggccggcagaagagccgtggacagcgccgaggccagagcctgggccctgggccagggcctggagtgcttcgagaccagcgtgaaggagatggagaacttcgaggcccccttccactgcctggccaagcagttccaccagctgtacagagagaaggtggaggtgttcagagccctggcctag

SEQ ID NO: 21838 - DNA, 156 bp, Artificial Sequence
  Description of Artificial Sequence: Synthetic coding sequence
atggacctggtggtgaagaccgtgcccgtgcccgacaccggcgacagcgtggagctgttcatcttcgacagcgccggcaaggagctgttcagcgagatgctggacaagctgtgggagagccccaacgtgctgtgcctggtgtacgacgtgacctag

SEQ ID NO: 21839 - DNA, 438 bp, Artificial Sequence
  Description of Artificial Sequence: Synthetic coding sequence
atggacctggtggtgaagaccgtgcccgtgcccgacaccggcgacagcgtggagctgttcatcttcgacagcgccggcaaggagctgttcagcgagatgctggacaagctgtgggagagccccaacgtgctgtgcctggtgtacgacgtgaccaacgaggagagcttcaacaactgcagcaagtggctggagaaggccagaagccaggcccccggcatcagcctgcccggcgtgctggtgggcaacaagaccgacctggccggcagaagagccgtggacagcgccgaggccagagcctgggccctgggccagggcctggagtgcttcgagaccagcgtgaaggagatggagaacttcgaggcccccttccactgcctggccaagcagttccaccagctgtacagagagaaggtggaggtgttcagagccctggcctag

SEQ ID NO: 21840 - DNA, 1314 bp, Artificial Sequence
  Description of Artificial Sequence: Synthetic coding sequence
atggagaaggagctgagaagcaccatcctgttcaacgcctacaagaaggagatcttcaccaccaacaacggctacaagagcatgcagaagaagctgagaagcaactggaagatccagagcctgaaggacgagatcaccagcgagaagctgaacggcgtgaagctgtggatcaccgccggccccagagagaagttcaccgccgccgagttcgagatcctgaagaagtacctggacaccggcggcgacgtgttcgtgatgctgggcgagggcggcgagagcagattcgacaccaacatcaacttcctgctggaggagtacggcatcatggtgaacaacgacgccgtggtgagaaacgtgtaccacaagtacttccaccccaaggaggccctggtgagcagcggcgtgctgaacagagagatcagcagagccgccggcaaggccgtgcccggcatcatcgacgaggagagcagcggcaacaacgcccaggccctgaccttcgtgtaccccttcggcgccaccctgagcgtgatgaagcccgccgtggccgtgctgagcaccggcagcgtgtgcttccccctgaacagacccatcctggccttctaccacagcaagaaccagggcggcaagctggccgtgctgggcagctgccacatgttcagcgaccagtacctggacaaggaggagaacagcaagatcatggacgtggtgttccagtggctgaccaccggcgacatccacctgaaccagatcgacgccgaggaccccgagatcagcgactacatgatgctgccctacaccgccaccctgagcaagagaaacagagagtgcctgcaggagagcgacgagatccccagagacttcaccaccctgttcgacctgagcatcttccagctggacaccaccagcttccacagcgtgatcgaggcccacgagcagctgaacgtgaagcacgagcccctgcagctgatccagccccagttcgagacccccctgcccaccctgcagcccgccgtgttcccccccagcttcagagagctgccccccccccccctggagctgttcgacctggacgagaccttcagcagcgagaaggccagactggcccagatcaccaacaagtgcaccgaggaggacctggagttctacgtgagaaagtgcggcgacatcctgggcgtgaccagcaagctgcccaaggaccagcaggacgccaagcacatcctggagcacgtgttcttccaggtggtggagttcaagaagctgaaccaggagcacgacatcgacaccagcgagaccgccttccagaacaacttctag

SEQ ID NO: 21841 - DNA, 1314 bp, Artificial Sequence; identical to SEQ ID NO: 21840
  Description of Artificial Sequence: Synthetic coding sequence

SEQ ID NO: 21842 - DNA, 1401 bp, Artificial Sequence
  Description of Artificial Sequence: Synthetic coding sequence
atggagcccgagctgctggtgagaaaggtgagcgccctgcaggcctgcgtgagaggcttcctggtgagaagacagttccagagcctgagagccgagtacgaggccatcgtgagagaggtggagggcgacctgggcaccctgcagtggaccgagggcagaatccccagacccagattcctgcccgagaaggccaagagccaccagacctggaaggccggcgacagagtggccaaccccgagcagggcctgtggaaccacttcccctgcgaggagagcgagggcgaggccacctgggaggagatggtgctgaagaagagcggcgagagcagcgccaaccagggcagcctgtgcagagaccacagcagctggctgcagatgaagcagaacagaaagcccagccaggagaagaccagagacaccaccagaatggagaaccccgaggccaccgaccagagactgccccacagccagccccagctgcaggagctgcagtaccacagaagccacctggccatggagctgctgtggctgcagcaggccatcaacagcagaaaggagtacctgctgctgaagcagaccctgagaagccccgaggccggccccatcagagaggagcccagagtgttcctggagcacggcgagcaggcctgcgagagagaccagagccagcccagcgcccccctggaggaccagagctacagagacagaaccaccggcgagctggagcaggaggacgacagctgccacagagtgaagagcccccacagaagccccggcagcctggccaccacccagaagaacatcgccggcgccaagtgcagagagccctgctacagcaagagcggcccccccagcagcatccccagcaacagccaggccctgggcgacagactgaccaagggccccgacgacggcagacagaccttcggcggcacctgcctgctgcagatgaagatcctggaggaccagacccccagaggcctgaagcccagaaaccactgccccagaaagagcagaacccagctgagcgccctgtacgaggacagcaacatcaaggagatgagccccagaaagctggaccacaaggagcccgactgcagaaccgtgagaacccaggagctgggcctgagcgaggaccacatcatctgggacggcaccctgggcggccccgagcacagcgtgctggacctgtggagaaccaagccccccaagggccaggcccccaccgacagaagcagcagagacggcaccagcaacgagcccagccacgagggccagaagaagcagagaaccatcccctggagaagcaagagccccgagatcctgagcagcaccaaggccggctgcaccggcgaggagcagtggagaggcagaccctggaagaccgagccccccggctag

SEQ ID NO: 21843 - DNA, 1641 bp, Artificial Sequence
  Description of Artificial Sequence: Synthetic coding sequence
atggagcccgagctgctggtgagaaaggtgagcgccctgcaggtgagaggcagagccagaggcagccaggacttcagcttcagagagatcatgggcagcagaacctggaccagccagagagacgccaccaccttcagccccctgaccgccagacagcccctggagatccccgccgtgcccaacagagccgaggagagctgggaccccagaaccccctgccccgccagaccccacagccaccacaccctggcccccgaccagggcaacggcaagagcctgaaggcctgcgtgagaggcttcctggtgagaagacagttccagagcctgagagccgagtacgaggccatcgtgagagaggtggagggcgacctgggcaccctgcagtggaccgagggcagaatccccagacccagattcctgcccgagaaggccaagagccaccagacctggaaggccggcgacagagtggccaaccccgagcagggcctgtggaaccacttcccctgcgaggagagcgagggcgaggccacctgggaggagatggtgctgaagaagagcggcgagagcagcgccaaccagggcagcctgtgcagagaccacagcagctggctgcagatgaagcagaacagaaagcccagccaggagaagaccagagacaccaccagaatggagaaccccgaggccaccgaccagagactgccccacagccagccccagctgcaggagctgcagtaccacagaagccacctggccatggagctgctgtggctgcagcaggccatcaacagcagaaaggagtacctgctgctgaagcagaccctgagaagccccgaggccggccccatcagagaggagcccagagtgttcctggagcacggcgagcaggcctgcgagagagaccagagccagcccagcgcccccctggaggaccagagctacagagacagaaccaccggcgagctggagcaggaggacgacagctgccacagagtgaagagcccccacagaagccccggcagcctggccaccacccagaagaacatcgccggcgccaagtgcagagagccctgctacagcaagagcggcccccccagcagcatccccagcaacagccaggccctgggcgacagactgaccaagggccccgacgacggcagacagaccttcggcggcacctgcctgctgcagatgaagatcctggaggaccagacccccagaggcctgaagcccagaaaccactgccccagaaagagcagaacccagctgagcgccctgtacgaggacagcaacatcaaggagatgagccccagaaagctggaccacaaggagcccgactgcagaaccgtgagaacccaggagctgggcctgagcgaggaccacatcatctgggacggcaccctgggcggccccgagcacagcgtgctggacctgtggagaaccaagccccccaagggccaggcccccaccgacagaagcagcagagacggcaccagcaacgagcccagccacgagggccagaagaagcagagaaccatcccctggagaagcaagagccccgagatcctgagcagcaccaaggccggctgcaccggcgaggagcagtggagaggcagaccctggaagaccgagccccccggctag

SEQ ID NO: 21844 - DNA, 1044 bp, Artificial Sequence
  Description of Artificial Sequence: Synthetic coding sequence
atggccctggacatcctggccatggcccccctgtaccaggcccccgccatcaacagaatcggccccaagaccgaccccagcaagagacccgccgaccccctgaagcccctggtgctgagcagaaccaagctgaccaccatcgaggccaagagaatcatgagcatcctggacgaggccatctacaaggtggagctggtgaccctgctgagctacgtggccagcaacagagaggacatggagggcatgctgggcgaggacgtgatgagagccgtgagagagcacgaggacctgtgccaggtgctgctggagaacgtgagatgcctgaaggagaaggagagacagctgcaggagcagaaggaggccgaggaggagggctggctgagagacagactgctgagcatcgagctgcagaagagcagcctgagccccctgatgcagcagatcaaggacagcaccaagaacgtgctgagactgctgctgagcaacccccaggccgccagactgctgcagatgcagacccagggcagaagcgccgaggcccagaacttcatcgacagcctgatcgagctgagaggcttcctgttcgagaagctgctgaccagccccatggaggccagagacaaggcccagttcctgcaggacatcagcagacagaacagcaacaaccagcagatcatcgacaccctggagaaggagctggccgagagaatgaagaacagaaacgccgaggaggagctggaggacctggacgccgtgcacagagaggagaagatcagcctggaggagctgagaagaagacacaaggtgctggtgggcgagttcgcccagatcagagaggagagagagatcaacagcaagaagagaatggaggccgagcaggagatggtgagaatggtgagagccgccaccctgatccaggccctgtggaagggctacctggtgagaagcctgctgagaagcaagaagaagagaggcaagggcaaggccaaggacaaggagaagggcaagcagaagggcaaggagaagggcaagggcaagaagtag

SEQ ID NO: 21845 - DNA, 1110 bp, Artificial Sequence
  Description of Artificial Sequence: Synthetic coding sequence
atggccctggacatcctggccatggcccccctgtaccaggcccccgccatcaacagaatcggccccaagaccgaccccagcaagagacccgccgaccccctgaagcccctggtgctgagcagaaccaagctgaccaccatcgaggccaagagaatcatgagcatcctggacgaggccatctacaaggtggagctggtgaccctgctgagctacgtggccagcaacagagaggacatggagggcatgctgggcgaggacgtgatgagagccgtgagagagcacgaggacctgtgccaggtgctgctggagaacgtgagatgcctgaaggagaaggagagacagctgcaggagcagaaggaggccgaggaggagggctggctgagagacagactgctgagcatcgagctgcagaagagcagcctgagccccctgatgcagcagatcaaggacagcaccaagaacgtgctgagactgctgctgagcaacccccaggccgccagactgctgcagatgcagacccagggcagaagcgccgaggcccagaacttcatcgacagcctgatcgagctgagaggcttcctgttcgagaagctgctgaccagccccatggaggccagagacaaggcccagttcctgcaggacatcagcagacagaacagcaacaaccagcagatcatcgacaccctggagaaggagctggccgagagaatgaagaacagaaacgccgaggtgctgttccacagcatcgccgagatcaccgaggaggccacccagatcttctgctggctgggcttcagcagcatgatcgacttcttcttcaagatggagagcagaagcgtggtgcagaccagagtgcagtggtgcaacctggacagcctgcagcccctgccccccagattcaagagattcagccaccacagcctgcccagcagctgggactacagaagaatgccccccagacccgccaacttctgcatcttcagcagagacagagtgacccccttcagctgcctgagcctgcccagcagctgggactacagatgcccccccctgtacagcagcctggccgccgagcaggaccccgtgagcaagaagaagggcaagcagtag

SEQ ID NO: 21846 - DNA, 1350 bp, Artificial Sequence
  Description of Artificial Sequence: Synthetic coding sequence
atggccctggacatcctggccatggcccccctgtaccaggcccccgccatcaacagaatcggccccaagaccgaccccagcaagagacccgccgaccccctgaagcccctggtgctgagcagaaccaagctgaccaccatcgaggccaagagaatcatgagcatcctggacgaggccatctacaaggtggagctggtgaccctgctgagctacgtggccagcaacagagaggacatggagggcatgctgggcgaggacgtgatgagagccgtgagagagcacgaggacctgtgccaggtgctgctggagaacgtgagatgcctgaaggagaaggagagacagctgcaggagcagaaggaggccgaggaggagggctggctgagagacagactgctgagcatcgagctgcagaagagcagcctgagccccctgatgcagcagatcaaggacagcaccaagaacgtgctgagactgctgctgagcaacccccaggccgccagactgctgcagatgcagacccagggcagaagcgccgaggcccagaacttcatcgacagcctgatcgagctgagaggcttcctgttcgagaagctgctgaccagccccatggaggccagagacaaggcccagttcctgcaggacatcagcagacagaacagcaacaaccagcagatcatcgacaccctggagaaggagctggccgagagaatgaagaacagaaacgccgaggtggagaaggagaacttcgtgatccaggagctgaagaaccacctgcaccaggtgctgaagttcagcgagaacagcctggtgagaaccaagcaggaggccgagaagcagcagaaggccgacttcagagccagccaggccagagtggccaagatccagcaggagatcctgcagctgcagagccagttctacaacctggtgatggagaacagagaggccgagcaggccctgagaaagaagaagtacaaggtggagaccgagatcgagaactggatccagaagtacgacaccgagatgggcgagaagcaggaggagctggaggacctggacgccgtgcacagagaggagaagatcagcctggaggagctgagaagaagacacaaggtgctggtgggcgagttcgcccagatcagagaggagagagagatcaacagcaagaagagaatggaggccgagcaggagatggtgagaatggtgagagccgccaccctgatccaggccctgtggaagggctacctggtgagaagcctgctgagaagcaagaagaagagaggcaagggcaaggccaaggacaaggagaagggcaagcagaagggcaaggagaagggcaagggcaagaagtag

SEQ ID NO: 21847 - DNA, 618 bp, Artificial Sequence
  Description of Artificial Sequence: Synthetic coding sequence
atggaggagaagcagccccagaagaccaaggagcccagcaaggaggacgagccccagcagaaggagatgcccacccacctgagcctgggcgccgagagcaaggccgaggccaagacccccgtgctggtggagacccagaccgtggacaacgccaacgagaagagcgagaagccccccgagaaccagaagaagctgagcgacaaggacaccgtggccaccaagatccaggcctggtggagaggcaccctggtgagaagagccctgctgcacgccgccctgagcgcctgcatcatccagtgctggtggagactgatcctgagcaagatcctgaagaagagaagacaggccgccctggaggccttcagcagaaaggagtgggccgccgtgaccctgcagagccaggccagaatgtggagaatcagaagaagatactgccaggtgctgaacgccgtgagaatcatccaggcctactggagatgcagaagctgcgccagcagaggcttcatcaagggccagtacagagtgaccgccaaccagctgcacctgcagctggagatcctgctggacagcggcccctgcatcgtgaccgagtgcatccccttcagcatcaaggagtag

SEQ ID NO: 21848 - DNA, 249 bp, Artificial Sequence
  Description of Artificial Sequence: Synthetic coding sequence
atggaggagaagcagccccagaagaccaaggagcccagcaaggaggacgagccccagcagaaggagatgcccacccacctgagcctgggcgccgagagcaaggccgaggccaagacccccgtgctggtggagacccagaccgtggacaacgccaacgagaagagcgagaagagagtgtgccagtggaacatggtgatcgtgagcatggactggaagagcctggagagcgaggacctgagaaacctgtag

SEQ ID NO: 21849 - DNA, 495 bp, Artificial Sequence
  Description of Artificial Sequence: Synthetic coding sequence
atgagagtgagattctgcaccaagggcaacctgatcctggtgatcatcgaggacgtggaggagagcatcgagtggaagaccctgcagaagaagaagcagcagaagatcaaggagaagctgagaatcagaaccaaggccgccgtgaagatccaggcctggtggagaggcaccctggtgagaagaaccctgctgcacgccgccctgagagcctggatcatccagtgctggtggagaatgaccctgagcagagtgctggagaagaagagacaggccgccctgatcgcctacgccaccagagagagagccgtgatcaagctgcagagcctggtgagaatgtggagagtgagatggagatactgccaggtgctgaacgccatctacatcatccagggccactggcagtgccacaactgccagacctgcgccctgctgcagggccactgcgtggtgaccgccacccacctgcagttccacatcgagatcatcaacagctag

SEQ ID NO: 21850 - DNA, 465 bp, Artificial Sequence
  Description of Artificial Sequence: Synthetic coding sequence
atgggcagcaagtgctgcaagggcggccccgacgaggacgccgtggagagacagagaagacagaagctgctgctggcccagctgcaccacagaaagagagtgaaggccgccggccagatccaggcctggtggagaggcgtgctggtgagaagaaccctgctggtggccgccctgagagcctggatgatccagtgctggtggagaaccctggtgcagagaagaatcagacagagaagacaggccctgctgagagtgtacgtgatccaggagcaggccaccgtgaagctgcagagctgcatcagaatgtggcagtgcagacagtgctacagacagatgtgcaacgccctgtgcctgttccaggtgcccgagagcagcctggccttccagaccgacggcttcctgcaggtgcagtacgccatccccagcaagcagcccgagttccacatcgagatcctgagcatctag

SEQ ID NO: 21851 - DNA, 465 bp, Artificial Sequence; identical to SEQ ID NO: 21850
  Description of Artificial Sequence: Synthetic coding sequence

SEQ ID NO: 21852 - DNA, 465 bp, Artificial Sequence; identical to SEQ ID NO: 21850
  Description of Artificial Sequence: Synthetic coding sequence

SEQ ID NO: 21853 - DNA, 465 bp, Artificial Sequence; identical to SEQ ID NO: 21850
  Description of Artificial Sequence: Synthetic coding sequence

SEQ ID NO: 21854 - DNA, 366 bp, Artificial Sequence
  Description of Artificial Sequence: Synthetic coding sequence
accaagaagaagaagaagaagaagaagagaaaggagaagaagctgagagagagaagcgccgccgtgttcatccaggcctggtggagaggcatgctggtgagaagaaccctgctgcacgccgccctgagagcctggatcatccagtgctggtggagacaggtgctggagaagctgctggccaagagaagaagaatggtgctggagttctacgtgcagcaggagtgggccgccgtgagactgcagagctgggtgagaatgtggtgcgtgagacagagatactgcagactgctgaacgccgtgagaatcatccaggtgtactggagatggcacagctgccacagcagagtgttcatcgagggccactag

SEQ ID NO: 21855 - DNA, 447 bp, Artificial Sequence
  Description of Artificial Sequence: Synthetic coding sequence
atgggccccgaggagaagaccatcatgaccgagagaagcgccgccgtgttcatccaggcctggtggagaggcatgctggtgagaagaaccctgctgcacgccgccctgagagcctggatcatccagtgctggtggagacaggtgctggagaagctgctggccaagagaagaagaatggtgctggagttctacgtgcagcaggagtgggccgccgtgagactgcagagctgggtgagaatgtggtgcgtgagacagagatactgcagactgctgaacgccgtgagaatcatccaggtgtactggagatggcacagctgccacagcagagtgttcatcgagggccactacgagctgaaggagaaccagctgaacatccagctggagatcagcctgggcctgcaggcctgcaaggtgcagcagtgcatccccctgcccctgaaggagtag

SEQ ID NO: 21856 - DNA, 324 bp, Artificial Sequence
  Description of Artificial Sequence: Synthetic coding sequence
atggtgagaagaaccctgctgcaggccgccctgagagcctgggtgatccagtgctggtggagaagcatgcaggccaagatgctggagcagagaagaagactggccctgagactgtacacctgccaggagtgggccgtggtgaaggtgcaggcccaggtgagaatgtggcaggccagaagaagattcctgcaggccagacaggccgcctgcatcatccagagccactggagatggcacgccagccagaccagaggcctgatcagaggccactacgaggtgagagccagcagactggagctggacatcgagatcctgatgacctag

SEQ ID NO: 21857 - DNA, 570 bp, Artificial Sequence
  Description of Artificial Sequence: Synthetic coding sequence
atggccgcccccagacagatccccagccacatcgtgagactgaagcccagctgcagcaccgacagcagcttcaccagaacccccgtgcccaccgtgagcctggccagcagagagctgcccgtgagcagctggcaggtgaccgagcccagcagcaagaacctgtgggagcagatctgcaaggagtacgaggccgagcagccccccttccccgagggctacaaggtgaagcaggagcccgtgatcaccgtggcccccgtggaggagatgctgttccacggcttcagcgccgagcactacttccccgtgagccacttcaccatgatcagcagaaccccctgcccccaggacaagagcgagaccatcaaccccaagacctgcagccccaaggagtacctggagaccttcatcttccccgtgctgctgcccggcatggccagcctgctgcaccaggccaagaaggagaagtgcttcgagcccaccgccgccaaccccaccctggcccccgccgacagaagaggcagcagccccctgcacagcatcctgctggagagcctgtgcggcagcctgtag

SEQ ID NO: 21858 - DNA, 864 bp, Artificial Sequence
  Description of Artificial Sequence: Synthetic coding sequence
atggccgcccccagacagatccccagccacatcgtgagactgaagcccagctgcagcaccgacagcagcttcaccagaacccccgtgcccaccgtgagcctggccagcagagagctgcccgtgagcagctggcaggtgaccgagcccagcagcaagaacctgtgggagcagatctgcaaggagtacgaggccgagcagccccccttccccgagggctacaaggtgaagcaggagcccgtgatcaccgtggcccccgtggaggagatgctgttccacggcttcagcgccgagcactacttccccgtgagccacttcaccatgatcagcagaaccccctgcccccaggacaagagcgagaccatcaaccccaagacctgcagccccaaggagtacctggagaccttcatcttccccgtgctgctgcccggcatggccagcctgctgcaccaggccaagaaggagaagtgcttcgagagaaagagaaccaagttcatcgcctgcgacttcctgaccgagtggctgtacaaccagaaccccaagagagccggcgagcccttcaccgagttcttcagcatccccttcgtggaggagagactgaagcagcaccccagaccccccatccccctgagcctgctgctgaccgaggaggaggccgccctgtacatccagagcttctggagagcctgcgtggtgagatgcgaccccgagatccaggagctgagacagtggcagaagaagctgagagaggccaagcacatccaccagcaggtgaagatcttctgggccaagcaggagcagaaggtgaagtgcaagatggaggacgacgccgtgcccgccgccaagatgaagatccccagcagctag

SEQ ID NO: 21859 - DNA, 600 bp, Artificial Sequence
  Description of Artificial Sequence: Synthetic coding sequence
atgctgttccacggcttcagcgccgagcactacttccccgtgagccacttcaccatgatcagcagaaccccctgcccccaggacaagagcgagaccatcaaccccaagacctgcagccccaaggagtacctggagaccttcatcttccccgtgctgctgcccggcatggccagcctgctgcaccaggccaagaaggagaagtgcttcgagagaaagagaaccaagttcatcgcctgcgacttcctgaccgagtggctgtacaaccagaaccccaagagagccggcgagcccttcaccgagttcttcagcatccccttcgtggaggagagactgaagcagcaccccagaccccccatccccctgagcctgctgctgaccgaggaggaggccgccctgtacatccagagcttctggagagcctgcgtggtgagatgcgaccccgagatccaggagctgagacagtggcagaagaagctgagagaggccaagcacatccaccagcaggtgaagatcttctgggccaagcaggagcagaaggtgaagtgcaagatggaggacgacgccgtgcccgccgccaagatgaagatccccagcagctag

SEQ ID NO: 21860 - DNA, 720 bp, Artificial Sequence
  Description of Artificial Sequence: Synthetic coding sequence
atggccgcccccagacagatccccagccacatcgtgagactgaagcccagctgcagcaccgacagcagcttcaccagaacccccgtgcccaccgtgagcctggccagcagagagctgcccgtgagcagctggcaggtgaccgagcccagcagcaagaacctgtgggagcagatctgcaaggagtacgaggccgagcagccccccttccccgagggctacaaggtgaagcaggagcccgtgatcaccgtggcccccgtggaggagatgctgttccacggcttcagcgccgagcactacttccccgtgagccacttcaccatgatcagcagaaccccctgcccccaggacaagagcgagaccatcaaccccaagacctgcagccccaaggagtacctggagaccttcatcttccccgtgctgctgcccggcatggccagcctgctgcaccaggccaagaaggagaagtgcttcgagagaaagagaaccaagttcatcgcctgcgacttcctgaccgagtggctgtacaaccagaaccccaagagagccggcgagcccttcaccgagttcttcagcatccccttcgtggaggagagactgaagcagcagttcgccgtgatcctgagattcaagaactgcgtgagcggcagaagaaacttcgccagacccagcaccttcaccagcaagagcaagttcagcggccccagcaagaacaagaagtag

SEQ ID NO: 21861 - DNA, 2460 bp, Artificial Sequence
  Description of Artificial Sequence: Synthetic coding sequence
atgtacaacaagatgtggcaccagacccaggaggccctgggcgccctgctggacaaggagccccagaagatgatcgagccccagagaaaccaggtgttcatcttccagaccctggccaccttctacgtgaagtacgtgcagatcttcagaaacctggagaacgtgtacgaccagttcgtgcacccccagaagagaatcctgatcagaaaggtgctggacggcgtgatgggcagaatcctggagctgaagaacgagatggtggagctggagctgaccgagttccactacttcgacgacatcctgcaggacctgaagctggccccccagcagctggacatccccatccccaagtacttcctgaaggagaagctggaggtgatcaagggcagagagaagatcctggcccagatcctggccgacagcggcatcgacaccagcgacatgaagtaccccgtgaagagcatccccttcgacgaggccgtgaagctgatccagatcgccgagagagccagacagggcagactgagagccctgttcatgaagcagatctacctgcaggagtacagagccaagcagagcaagatgctgggcaagaaggtgaccgacacctgggccgccgccctgagaatccagaaggtgtggagaagattccaccagagaaaggagaccgagaagctgagagaggaggagatgatcttcctgggcatgaaccccccccccctgttcaacgaggtgagcgccaccgtgatccaggccgagaaggtggacagactgagaaacgaggtgcagatcaagcacgaggaggactacagagaggccctggtgaccatcaagaacgacctgaagctgatcgagggcgtggacatcaaggagaacctgcaggaccagatcagacactggttcatcgagtgcagaaacctgaccggcaccttccccgactaccccgacgtggaggagggcggcagcgccatcatcttcagcgacaagaccatccagcaggtgatcgaggacatcatcgccaaccaggaggaggaggagaagaacaagaagaagaagaagaagaaggagaagcagcccaagaaggccaagaagcagaagaagggcaccaaggagaagaacaaggaggaggacgagaagtggaagatgagccccagcctgttcctgcccgccatgaaggagggctgcaacgcctacaaggagatctggatgaagaaggacgagagctggaacttcagccaggactacgaccccgagctgatcaaggaggagaagagaaaggagctgcagagcgagatcagaatccaggtggacgagctgatgagacaggagctgaagaacctgaagctggccgtggacagagagagagagagacccgtgaaggccggcaagaagaaggacaagaagaagggcaagaagggcaagaagaaggagaagaaggccaagaaggacaaggacctgaccgccgacagaaccatcgagagcctgtacaaggagctggtggaggagggcctgctgatccaggccctgaaggtgaacctgagcgactacatcggcgagtacagctacctgggcaccaccctgagacaggtgagcatcgagcccatgcccagcctgctggacgtgagacagctgatcaccctgtacggcatctggcccctgggcagcgccgccgtgcacgagaaggcccccctggtgaagagcctgctgctggccggccccagcggcgtgggcaagaagatgctggtgcacgccatctgcaccgagaccggcgccaacctgttcaacctgagcagcagcaacatcgccggcaagtaccccggcaagaacggcctgcagatgatgctgcacgccgtgttcaaggtggccagacagctgcagcccagcgtggtgtggatcgaggacaccgagaagaccttctacaagaaggtgcccaacgccgagaagatgaacgagcccaagagactgaagaagcacctgccccagatcctgaagctgctgaagcccgacgacagaatcctgatcgtgggcaccaccagaagacccttcgacgccgagctgcagagcttctgcaaggtgtaccagaagatcatcctggtgcccagacccgactacgccagcagatacgtgctgtggaagcagatcatcgagagaaacggcggcgtgctgaccagcgccctgaacgtgagctgcctggccaaggtgaccgacggcttcacccagggccacatcgtggaggtggtgaagggcgtgctgaccgaccagagaatcagaagacagatccacaagcccctgaccgccgtggagttcatcaccgccatcaccagcatgaaccccgtgtacaaggaggaggaggagagcttcaagaactggtacgccaagacccccctgggcaagaagagagccctggccatcaccggcggcagcaccgagaaggccaaggacaagggcaagagaaagtag

SEQ ID NO: 21862 - DNA, 2469 bp, Artificial Sequence
  Description of Artificial Sequence: Synthetic coding sequence
atgagcaacgccatgtacaacaagatgtggcaccagacccaggaggccctgggcgccctgctggacaaggagccccagaagatgatcgagccccagagaaaccaggtgttcatcttccagaccctggccaccttctacgtgaagtacgtgcagatcttcagaaacctggagaacgtgtacgaccagttcgtgcacccccagaagagaatcctgatcagaaaggtgctggacggcgtgatgggcagaatcctggagctgaagaacgagatggtggagctggagctgaccgagttccactacttcgacgacatcctgcaggacctgaagctggccccccagcagctggacatccccatccccaagtacttcctgaaggagaagctggaggtgatcaagggcagagagaagatcctggcccagatcctggccgacagcggcatcgacaccagcgacatgaagtaccccgtgaagagcatccccttcgacgaggccgtgaagctgatccagatcgccgagagagccagacagggcagactgagagccctgttcatgaagcagatctacctgcaggagtacagagccaagcagagcaagatgctgggcaagaaggtgaccgacacctgggccgccgccctgagaatccagaaggtgtggagaagattccaccagagaaaggagaccgagaagctgagagaggaggagatgatcttcctgggcatgaaccccccccccctgttcaacgaggtgagcgccaccgtgatccaggccgagaaggtggacagactgagaaacgaggtgcagatcaagcacgaggaggactacagagaggccctggtgaccatcaagaacgacctgaagctgatcgagggcgtggacatcaaggagaacctgcaggaccagatcagacactggttcatcgagtgcagaaacctgaccggcaccttccccgactaccccgacgtggaggagggcggcagcgccatcatcttcagcgacaagaccatccagcaggtgatcgaggacatcatcgccaaccaggaggaggaggagaagaacaagaagaagaagaagaagaaggagaagcagcccaagaaggccaagaagcagaagaagggcaccaaggagaagaacaaggaggaggacgagaagtggaagatgagccccagcctgttcctgcccgccatgaaggagggctgcaacgcctacaaggagatctggatgaagaaggacgagagctggaacttcagccaggactacgaccccgagctgatcaaggaggagaagagaaaggagctgcagagcgagatcagaatccaggtggacgagctgatgagacaggagctgaagaacctgaagctggccgtggacagagagagagagagacccgtgaaggccggcaagaagaaggacaagaagggcaagaagggcaagaagaaggagaagaaggccaagaaggacaaggacctgaccgccgacagaaccatcgagagcctgtacaaggagctggtggaggagggcctgctgatccaggccctgaaggtgaacctgagcgactacatcggcgagtacagctacctgggcaccaccctgagacaggtgagcatcgagcccatgcccagcctgctggacgtgagacagctgatcaccctgtacggcatctggcccctgggcagcgccgccgtgcacgagaaggcccccctggtgaagagcctgctgctggccggccccagcggcgtgggcaagaagatgctggtgcacgccatctgcaccgagaccggcgccaacctgttcaacctgagcagcagcaacatcgccggcaagtaccccggcaagaacggcctgcagatgatgctgcacgccgtgttcaaggtggccagacagctgcagcccagcgtggtgtggatcgaggacaccgagaagaccttctacaagaaggtgcccaacgccgagaagatgaacgagcccaagagactgaagaagcacctgccccagatcctgaagctgctgaagcccgacgacagaatcctgatcgtgggcaccaccagaagacccttcgacgccgagctgcagagcttctgcaaggtgtaccagaagatcatcctggtgcccagacccgactacgccagcagatacgtgctgtggaagcagatcatcgagagaaacggcggcgtgctgaccagcgccctgaacgtgagctgcctggccaaggtgaccgacggcttcacccagggccacatcgtggaggtggtgaagggcgtgctgaccgaccagagaatcagaagacagatccacaagcccctgaccgccgtggagttcatcaccgccatcaccagcatgaaccccgtgtacaaggaggaggaggagagcttcaagaactggtacgccaagacccccctgggcaagaagagagccctggccatcaccggcggcagcaccgagaaggccaaggacaagggcaagagaaagtag

SEQ ID NO: 21863 - DNA, 2013 bp, Artificial Sequence
  Description of Artificial Sequence: Synthetic coding sequence
atgtacaacaagatgtggcaccagacccaggaggccctgggcgccctgctggacaaggagccccagaagatgatcgagccccagagaaaccaggtgttcatcttccagaccctggccaccttctacgtgaagtacgtgcagatcttcagaaacctggagaacgtgtacgaccagttcgtgcacccccagaagagaatcctgatcagaaaggtgctggacggcgtgatgggcagaatcctggagctgaagaacgagatggtggagctggagctgaccgagttccactacttcgacgacatcctgcaggacctgaagctggccccccagcagctggacatccccatccccaagtacttcctgaaggagaagctggaggtgatcaagggcagagagaagatcctggcccagatcctggccgacagcggcatcgacaccagcgacatgaagtaccccgtgaagagcatccccttcgacgaggccgtgaagctgatccagatcgccgagagagccagacagggcagactgagagccctgttcatgaagcagatctacctgcaggagtacagagccaagcagagcaagatgctgggcaagaaggtgaccgacacctgggccgccgccctgagaatccagaaggtgtggagaagattccaccagagaaaggagaccgagaagctgagagaggaggagatgatcttcctgggcatgaaccccccccccctgttcaacgaggtgagcgccaccgtgatccaggccgagaaggtggacagactgagaaacgaggtgcagatcaagcacgaggaggactacagagaggccctggtgaccatcaagaacgacctgaagctgatcgagggcgtggacatcaaggagaacctgcaggaccagatcagacactggttcatcgagtgcagaaacctgaccggcaccttccccgactaccccgacgtggaggagggcggcagcgccatcatcttcagcgacaagaccatccagcaggtgatcgaggacatcatcgccaaccaggaggaggaggagaagaacaagaagaagaagaagaagaaggagaagcagcccaagaaggccaagaagcagaagaagggcaccaaggagaagaacaaggaggaggacgagaagtggaagatgagccccagcctgttcctgcccgccatgaaggagggctgcaacgcctacaaggagatctggatgaagaaggacgagagctggaacttcagccaggactacgaccccgagctgatcaaggaggagaagagaaaggagctgcagagcgagatcagaatccaggtggacgagctgatgagacaggagctgaagaacctgaagctggccgtggacagagagagagagagacccgtgaaggccggcaagaagaaggacaagaagaagggcaagaagggcaagaagaaggagaagaaggccaagaaggacaaggacctgaccgccgacagaaccatcgagagcctgtacaaggagctggtggaggagggcctgctgatccaggccctgaaggtgaacctgagcgactacatcggcgagtacagctacctgggcaccaccctgagacaggtgagcatcgagcccatgcccagcctgctggacgtgagacagctgatcaccctgtacggcatctggcccctgggcagcgccgccgtgcacgagaaggcccccctggtgaagagcctgctgctggccggccccagcggcgtgggcaagaagatgctggtgcacgccatctgcaccgagaccggcgccaacctgttcaacctgagcagcagcaacatcgccggcaagtaccccggcaagaacggcctgcagatgatgctgcacgccgtgttcaaggtggccagacagctgcagcccagcgtggtgtggatcgaggacaccgagaagaccttctacaagaaggtgcccaacgccgagaagatgttcacccccagcgccggcgaggtggccgccctgcagaagaacctgaagagaagcaccagcagatag

SEQ ID NO: 21864 - DNA, 2346 bp, Artificial Sequence
  Description of Artificial Sequence: Synthetic coding sequence
atgagcaacgccatgtacaacaagatgtggcaccagacccaggaggccctgggcgccctgctggacaaggagccccagaagatgatcgagccccagagaaaccaggtgttcatcttccagaccctggccaccttctacgtgaagtacgtgcagatcttcagaaacctggagaacgtgtacgaccagttcgtgcacccccagaagagaatcctgatcagaaaggtgctggacggcgtgatgggcagaatcctggagctgaagaacgagatggtggagctggagctgaccgagttccactacttcgacgacatcctgcaggacctgaagctggccccccagcagctggacatccccatccccaagtacttcctgaaggagaagctggaggtgatcaagggcagagagaagatcctggcccagatcctggccgacagcggcatcgacaccagcgacatgaagtaccccgtgaagagcatccccttcgacgaggccgtgaagctgatccagatcgccgagagagccagacagggcagactgagagccctgttcatgaagcagatctacctgcaggagtacagagccaagcagagcaagatgctgggcaagaaggtgaccgacacctgggccgccgccctgagaatccagaaggtgtggagaagattccaccagagaaaggagaccgagaagctgagagaggaggagatgatcttcctgggcatgaaccccccccccctgttcaacgaggtgagcgccaccgtgatccaggccgagaaggtggacagactgagaaacgaggtgcagatcaagcacgaggaggactacagagaggccctggtgaccatcaagaacgacctgaagctgatcgagggcgtggacatcaaggagaacctgcaggaccagatcagacactggttcatcgagtgcagaaacctgaccggcaccttccccgactaccccgacgtggaggagggcggcagcgccatcatcttcagcgacaagaccatccagcaggaggaggacgagaagtggaagatgagccccagcctgttcctgcccgccatgaaggagggctgcaacgcctacaaggagatctggatgaagaaggacgagagctggaacttcagccaggactacgaccccgagctgatcaaggaggagaagagaaaggagctgcagagcgagatcagaatccaggtggacgagctgatgagacaggagctgaagaacctgaagctggccgtggacagagagagagagagacccgtgaaggccggcaagaagaaggacaagaagggcaagaagggcaagaagaaggagaagaaggccaagaaggacaaggacctgaccgccgacagaaccatcgagagcctgtacaaggagctggtggaggagggcctgctgatccaggccctgaaggtgaacctgagcgactacatcggcgagtacagctacctgggcaccaccctgagacaggtgagcatcgagcccatgcccagcctgctggacgtgagacagctgatcaccctgtacggcatctggcccctgggcagcgccgccgtgcacgagaaggcccccctggtgaagagcctgctgctggccggccccagcggcgtgggcaagaagatgctggtgcacgccatctgcaccgagaccggcgccaacctgttcaacctgagcagcagcaacatcgccggcaagtaccccggcaagaacggcctgcagatgatgctgcacgccgtgttcaaggtggccagacagctgcagcccagcgtggtgtggatcgaggacaccgagaagaccttctacaagaaggtgcccaacgccgagaagatgaacgagcccaagagactgaagaagcacctgccccagatcctgaagctgctgaagcccgacgacagaatcctgatcgtgggcaccaccagaagacccttcgacgccgagctgcagagcttctgcaaggtgtaccagaagatcatcctggtgcccagacccgactacgccagcagatacgtgctgtggaagcagatcatcgagagaaacggcggcgtgctgaccagcgccctgaacgtgagctgcctggccaaggtgaccgacggcttcacccagggccacatcgtggaggtggtgaagggcgtgctgaccgaccagagaatcagaagacagatccacaagcccctgaccgccgtggagttcatcaccgccatcaccagcatgaaccccgtgtacaaggaggaggaggagagcttcaagaactggtacgccaagacccccctgggcaagaagagagccctggccatcaccggcggcagcaccgagaaggccaaggacaagggcaagagaaagtag

SEQ ID NO: 21865 - DNA, 2493 bp, Artificial Sequence
  Description of Artificial Sequence: Synthetic coding sequence
atgacccccagcctgagcgccgaggagaacagaatgtacaacaagatgtggcaccagacccaggaggccctgggcgccctgctggacaaggagccccagaagatgatcgagccccagagaaaccaggtgttcatcttccagaccctggccaccttctacgtgaagtacgtgcagatcttcagaaacctggagaacgtgtacgaccagttcgtgcacccccagaagagaatcctgatcagaaaggtgctggacggcgtgatgggcagaatcctggagctgaagaacgagatggtggagctggagctgaccgagttccactacttcgacgacatcctgcaggacctgaagctggccccccagcagctggacatccccatccccaagtacttcctgaaggagaagctggaggtgatcaagggcagagagaagatcctggcccagatcctggccgacagcggcatcgacaccagcgacatgaagtaccccgtgaagagcatccccttcgacgaggccgtgaagctgatccagatcgccgagagagccagacagggcagactgagagccctgttcatgaagcagatctacctgcaggagtacagagccaagcagagcaagatgctgggcaagaaggtgaccgacacctgggccgccgccctgagaatccagaaggtgtggagaagattccaccagagaaaggagaccgagaagctgagagaggaggagatgatcttcctgggcatgaaccccccccccctgttcaacgaggtgagcgccaccgtgatccaggccgagaaggtggacagactgagaaacgaggtgcagatcaagcacgaggaggactacagagaggccctggtgaccatcaagaacgacctgaagctgatcgagggcgtggacatcaaggagaacctgcaggaccagatcagacactggttcatcgagtgcagaaacctgaccggcaccttccccgactaccccgacgtggaggagggcggcagcgccatcatcttcagcgacaagaccatccagcaggtgatcgaggacatcatcgccaaccaggaggaggaggagaagaacaagaagaagaagaagaagaaggagaagcagcccaagaaggccaagaagcagaagaagggcaccaaggagaagaacaaggaggaggacgagaagtggaagatgagccccagcctgttcctgcccgccatgaaggagggctgcaacgcctacaaggagatctggatgaagaaggacgagagctggaacttcagccaggactacgaccccgagctgatcaaggaggagaagagaaaggagctgcagagcgagatcagaatccaggtggacgagctgatgagacaggagctgaagaacctgaagctggccgtggacagagagagagagagacccgtgaaggccggcaagaagaaggacaagaagaagggcaagaagggcaagaagaaggagaagaaggccaagaaggacaaggacctgaccgccgacagaaccatcgagagcctgtacaaggagctggtggaggagggcctgctgatccaggccctgaaggtgaacctgagcgactacatcggcgagtacagctacctgggcaccaccctgagacaggtgagcatcgagcccatgcccagcctgctggacgtgagacagctgatcaccctgtacggcatctggcccctgggcagcgccgccgtgcacgagaaggcccccctggtgaagagcctgctgctggccggccccagcggcgtgggcaagaagatgctggtgcacgccatctgcaccgagaccggcgccaacctgttcaacctgagcagcagcaacatcgccggcaagtaccccggcaagaacggcctgcagatgatgctgcacgccgtgttcaaggtggccagacagctgcagcccagcgtggtgtggatcgaggacaccgagaagaccttctacaagaaggtgcccaacgccgagaagatgaacgagcccaagagactgaagaagcacctgccccagatcctgaagctgctgaagcccgacgacagaatcctgatcgtgggcaccaccagaagacccttcgacgccgagctgcagagcttctgcaaggtgtaccagaagatcatcctggtgcccagacccgactacgccagcagatacgtgctgtggaagcagatcatcgagagaaacggcggcgtgctgaccagcgccctgaacgtgagctgcctggccaaggtgaccgacggcttcacccagggccacatcgtggaggtggtgaagggcgtgctgaccgaccagagaatcagaagacagatccacaagcccctgaccgccgtggagttcatcaccgccatcaccagcatgaaccccgtgtacaaggaggaggaggagagcttcaagaactggtacgccaagacccccctgggcaagaagagagccctggccatcaccggcggcagcaccgagaaggccaaggacaagggcaagagaaagtag

SEQ ID NO: 21866 - DNA, 1449 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagacgccacccaggccggcaagatgatggacgccaccggcaaggccctgtgcagcagcgccaagcagagactggccctgtgcacccccctgagcagactgaagcaggaggtggccaccttcagccagagagccgtgagcgacaccctgatgaccatcaacagaatggagcaggccagaaccgagtacagaggcgccctgctgtggatgaaggacgtgagccaggagctggaccccgacaccctgaagcagatggagaagttcagaaaggtgcagatgcaggtgagaaacagcaaggccagcttcgacaagctgaagatggacgtgtgccagaaggtggacctgctgggcgccagcagatgcaacatgctgagccacagcctgaccacctaccagagaaccctgctgggcttctggaagaagaccgccagaatgatgagccagatccacgaggcctgcatcggcttccacccctacgacttcgtggccctgaagcagctgcaggacacccccagcaagatcagcgaggacaacaaggacgagcagatcggcggcttcctgaccgagcagctgaacaagctggtgctgagcgacgaggaggccagcttcgagagcgagcaggccaacaaggaccacaacgagaagcacagccagatgagagagttcggcgccccccagttcagcaacagcgagaacgtggccaaggacctgcccgtggacagcctggagggcgaggacttcgagaaggagttcagcttcctgaacaacctgctgagcagcggcagcagcagcaccagcgagttcacccaggagtgccagaccgccttcggcagccccagcgccagcctgaccagccaggagcccagcatgggcagcgagcccctggcccacagcagcagattcctgcccagccagctgttcgacctgggcttccacgtggccggcgccttcaacaactgggtgagccaggaggagagcgagctgtgcctgagccacaccgacaaccagcccgtgcccagccagagccccaagaagctgaccagaagccccaacaacggcaaccaggacatgagcgcctggttcaacctgttcgccgacctggaccccctgagcaaccccgacgccatcggccacagcgacgacgagctgctgaacgcctag

SEQ ID NO: 21867 - DNA, 1449 bp, Artificial Sequence; identical to SEQ ID NO: 21866
  Description of Artificial Sequence: Synthetic coding sequence

SEQ ID NO: 21868 - DNA, 237 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaactag

SEQ ID NO: 21869 - DNA, 360 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagacgccacccaggccggcaagatgatggacgccaccggcaaggccctgtgcagcagcgccaagcagtag

SEQ ID NO: 21870 - DNA, 297 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagactag

SEQ ID NO: 21871 - DNA, 375 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagacgccacccaggccggcaagatgatggacgccaccggcaaggccctgtgcagcagcgccaagcagagactggccctgtgctag

SEQ ID NO: 21872 - DNA, 129 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctgtag

SEQ ID NO: 21873 - DNA, 300 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagacgcctag

SEQ ID NO: 21874 - DNA, 405 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagacgccacccaggccggcaagatgatggacgccaccggcaaggccctgtgcagcagcgccaagcagagactggccctgtgcacccccctgagcagactgaagcaggaggtgtag

SEQ ID NO: 21875 - DNA, 360 bp, Artificial Sequence; identical to SEQ ID NO: 21869
  Description of Artificial Sequence: Synthetic coding sequence

SEQ ID NO: 21876 - DNA, 456 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagacgccacccaggccggcaagatgatggacgccaccggcaaggccctgtgcagcagcgccaagcagagactggccctgtgcacccccctgagcagactgaagcaggaggtggccaccttcagccagagagccgtgagcgacaccctgatgaccatcaacagatag

SEQ ID NO: 21877 - DNA, 294 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagatag

SEQ ID NO: 21878 - DNA, 303 bp, Artificial Sequence
  Description of Artificial Sequence: Synthetic coding sequence
atggacagcttcggccagcccagacccgaggacaaccagagcgtggtgagaagaatgcagaagaagtactggaagaccaagcaggtgttcatcaaggccaccggcaagaaggaggacgagcacctggtggccagcgacgccgagctggacgccaagctggaggtgttccacagcgtgcaggagacctgcaccgagctgctgaagatcatcgagaagtaccagctgagactgaacgtgatcagcgaggaggagaacgagctgggcctgttcctgaagttccaggccgagagagacgccacctag

SEQ ID NO: 21879 - DNA, 408 bp, Artificial Sequence
  Description of Artificial Sequence: Synthetic coding sequence
atggtgcagtacctgaagagcgtggacatccccgagaacagagtgatcctgatcacccccacccccctgtgcgagaccgcctgggaggagcagtgcatcatccagggctgcaagctgaacagactgaacagcgtggtgggcgagtacgccaacgcctgcctgcaggtggcccaggactgcggcaccgacgtgctggacctgtggaccctgatgcaggacagccaggacttcagcagctacctgagcgacggcctgcacctgagccccaagggcaacgagttcctgttcagccacctgtggcccctgatcgagaagaaggtgagcagcctgcccctgctgctgccctactggagagacgtggccgaggccaagcccgagctgagcctgctgggcgacggcgaccactag

SEQ ID NO: 21880 - DNA, 747 bp, Artificial Sequence
  Description of Artificial Sequence: Synthetic coding sequence
atggccctgtgcgaggccgccggctgcggcagcgccctgctgtggcccagactgctgctgttcggcgacagcatcacccagttcagcttccagcagggcggctggggcgccagcctggccgacagactggtgagaaagtgcgacgtgctgaacagaggcttcagcggctacaacaccagatgggccaagatcatcctgcccagactgatcagaaagggcaacagcctggacatccccgtggccgtgaccatcttcttcggcgccaacgacagcgccctgaaggacgagaaccccaagcagcacatccccctggaggagtacgccgccaacctgaagagcatggtgcagtacctgaagagcgtggacatccccgagaacagagtgatcctgatcacccccacccccctgtgcgagaccgcctgggaggagcagtgcatcatccagggctgcaagctgaacagactgaacagcgtggtgggcgagtacgccaacgcctgcctgcaggtggcccaggactgcggcaccgacgtgctggacctgtggaccctgatgcaggacagccaggacttcagcagctacctgagcgacggcctgcacctgagccccaagggcaacgagttcctgttcagccacctgtggcccctgatcgagaagaaggtgagcagcctgcccctgctgctgccctactggagagacgtggccgaggccaagcccgagctgagcctgctgggcgacggcgaccactag

SEQ ID NO: 21881 - DNA, 408 bp, Artificial Sequence; identical to SEQ ID NO: 21879
  Description of Artificial Sequence: Synthetic coding sequence

SEQ ID NO: 21882 - DNA, 1356 bp, Artificial Sequence
  Description of Artificial Sequence: Synthetic coding sequence
atggaggccggcccccccggcagcgccagacccgccgagcccggcccctgcctgagcggccagagaggcgccgaccacaccgccagcgccagcctgcagagcgtggccggcaccgagcccggcagacacccccaggccgtggccgccgtgctgcccgccggcggctgcggcgagagaatgggcgtgcccacccccaagcagttctgccccatcctggagagacccctgatcagctacaccctgcaggccctggagagagtgtgctggatcaaggacatcgtggtggccgtgaccggcgagaacatggaggtgatgaagagcatcatccagaagtaccagcacaagagaatcagcctggtggaggccggcgtgaccagacacagaagcatcttcaacggcctgaaggccctggccgaggaccagatcaacagcaagctgagcaagcccgaggtggtgatcatccacgacgccgtgagacccttcgtggaggagggcgtgctgctgaaggtggtgaccgccgccaaggagcacggcgccgccggcgccatcagacccctggtgagcaccgtggtgagccccagcgccgacggctgcctggactacagcctggagagagccagacacagagccagcgagatgccccaggccttcctgttcgacgtgatctacgaggcctaccagcagtgcagcgactacgacctggagttcggcaccgagtgcctgcagctggccctgaagtactgctgcaccaaggccaagctggtggagggcagccccgacctgtggaaggtgacctacaagagagacctgtacgccgccgagagcatcatcaaggagagaatcagccaggagatctgcgtggtgatggacaccgaggaggacaacaagcacgtgggccacctgctggaggaggtgctgaagagcgagctgaaccacgtgaaggtgaccagcgaggccctgggccacgccggcagacacctgcagcagatcatcctggaccagtgctacaacttcgtgtgcgtgaacgtgaccaccagcgacttccaggagacccagaagctgctgagcatgctggaggagagcagcctgtgcatcctgtaccccgtggtggtggtgagcgtgcacttcctggacttcaagctggtgccccccagccagaagatggagaacctgatgcagatcagagagttcgccaaggaggtgaaggagagaaacatcctgctgtacggcctgctgatcagctacccccaggacgaccagaagctgcaggagagcctgagacagggcgccatcatcatcgccagcctgatcaaggagagaaacagcggcctgatcggccagctgctgatcgcctag

SEQ ID NO: 21883 - DNA, 996 bp, Artificial Sequence
  Description of Artificial Sequence: Synthetic coding sequence
atggccagaaacgccgagaaggccatgaccgccctggccagattcagacaggcccagctggaggagggcaaggtgaaggagagaagacccttcctggccagcgagtgcaccgagctgcccaaggccgagaagtggagaagacagatcatcggcgagatcagcaagaaggtggcccagatccagaacgccggcctgggcgagttcagaatcagagacctgaacgacgagatcaacaagctgctgagagagaagggccactgggaggtgagaatcaaggagctgggcggccccgactacggcaaggtgggccccaagatgctggaccacgagggcaaggaggtgcccggcaacagaggctacaagtacttcggcgccgccaaggacctgcccggcgtgagagagctgttcgagaaggagcccctgcccccccccagaaagaccagagccgagctgatgaaggccatcgacttcgagtactacggctacctggacgaggacgacggcgtgatcgtgcccctggagcaggagtacgagaagaagctgagagccgagctggtggagaagtggaaggccgagagagaggccagactggccagaggcgagaaggaggaggaggaggaggaggaggaggagatcaacatctacgccgtgaccgaggaggagagcgacgaggagggcagccaggagaagggcggcgacgacagccagcagaagttcatcgcccacgtgcccgtgcccagccagcaggagatcgaggaggccctggtgagaagaaagaagatggagctgctgcagaagtacgccagcgagaccctgcaggcccagagcgaggaggccagaagactgctgggctgcagaagcggcaccagacccgccagaagcggcagcgcccccagccccagagccaccaccgccgtgcccatgggccccagcctgcccaccaccagccccagaggcgcccccagctgcagatgcctgaccggcctgagaatgtag

SEQ ID NO: 21884 - DNA, 1671 bp, Artificial Sequence
  Description of Artificial Sequence: Synthetic coding sequence
atggccagcaagcccgccgccggcaagagcagaggcgagaagagaaagagagtggtgctgaccctgaaggagaagatcgacatctgcaccagactggagaagggcgagagcagaaaggccctgatgcaggagtacaacgtgggcatgagcaccctgtacgacatcagagcccacaaggcccagctgctgagattcttcgccagcagcgacagcaacaaggccctggagcagagaagaaccctgcacacccccaagctggagcacctggacagagtgctgtacgagtggttcctgggcaagagaagcgagggcgtgcccgtgagcggccccatgctgatcgagaaggccaaggacttctacgagcagatgcagctgaccgagccctgcgtgttcagcggcggctggctgtggagattcaaggccagacacggcatcaagaagctggacgccagcagcgagaagcagagcgccgaccaccaggccgccgagcagttctgcgccttcttcagaagcctggccgccgagcacggcctgagcgccgagcaggtgtacaacgccgacgagaccggcctgttctggagatgcctgcccaaccccacccccgagggcggcgccgtgcccggccccaagcagggcaaggacagactgaccgtgctgatgtgcgccaacgccaccggcagccacagactgaagcccctggccatcggcaagtgcagcggccccagagccttcaagggcatccagcacctgcccgtggcctacaaggcccagggcaacgcctgggtggacaaggagatcttcagcgactggttccaccacatcttcgtgcccagcgtgagagagcacttcagaaccatcggcctgcccgaggacagcaaggccgtgctgctgctggacagcagcagagcccacccccaggaggccgagctggtgagcagcaacgtgttcaccatcttcctgcccgccagcgtggccagcctggtgcagcccatggagcagggcatcagaagagacttcatgagaaacttcatcaacccccccgtgcccctgcagggcccccacgccagatacaacatgaacgacgccatcttcagcgtggcctgcgcctggaacgccgtgcccagccacgtgttcagaagagcctggagaaagctgtggcccagcgtggccttcgccgagggcagcagcagcgaggaggagctggaggccgagtgcttccccgtgaagccccacaacaagagcttcgcccacatcctggagctggtgaaggagggcagcagctgccccggccagctgagacagagacaggccgccagctggggcgtggccggcagagaggccgagggcggcagaccccccgccgccaccagccccgccgaggtggtgtggagcagcgagaagacccccaaggccgaccaggacggcagaggcgaccccggcgagggcgaggaggtggcctgggagcaggccgccgtggccttcgacgccgtgctgagattcgccgagagacagccctgcttcagcgcccaggaggtgggccagctgagagccctgagagccgtgttcagaagccagcagcaggagaccgtgggcctggaggacgtggtggtgaccagccccgaggagctggccatccccaagtgctgcctggaggccagcaccgagacctag

SEQ ID NO: 21885 - DNA, 1707 bp, Artificial Sequence
  Description of Artificial Sequence: Synthetic coding sequence
atggccagcaagcccgccgccggcaagagcagaggcgagaagagaaagagagtggtgctgaccctgaaggagaagatcgacatctgcaccagactggagaagggcgagagcagaaaggccctgatgcaggagtacaacgtgggcatgagcaccctgtacgacatcagagcccacaaggcccagctgctgagattcttcgccagcagcgacagcaacaaggccctggagcagagaagaaccctgcacacccccaagctggagcacctggacagagtgctgtacgagtggttcctgggcaagagaagcgagggcgtgcccgtgagcggccccatgctgatcgagaaggccaaggacttctacgagcagatgcagctgaccgagccctgcgtgttcagcggcggctggctgtggagattcaaggccagacacggcatcaagaagctggacgccagcagcgagaagcagagcgccgaccaccaggccgccgagcagttctgcgccttcttcagaagcctggccgccgagcacggcctgagcgccgagcaggtgtacaacgccgacgagaccggcctgttctggagatgcctgcccaaccccacccccgagggcggcgccgtgcccggccccaagcagggcaaggacagactgaccgtgctgatgtgcgccaacgccaccggcagccacagactgaagcccctggccatcggcaagtgcagcggccccagagccttcaagggcatccagcacctgcccgtggcctacaaggcccagggcaacgcctgggtggacaaggagatcttcagcgactggttccaccacatcttcgtgcccagcgtgagagagcacttcagaaccatcggcctgcccgaggacagcaaggccgtgctgctgctggacagcagcagagcccacccccaggaggccgagctggtgagcagcaacgtgttcaccatcttcctgcccgccagcgtggccagcctggtgcagcccatggagcagggcatcagaagagacttcatgagaaacttcatcaacccccccgtgcccctgcagggcccccacgccagatacaacatgaacgacgccatcttcagcgtggcctgcgcctggaacgccgtgcccagccacgtgttcagaagagcctggagaaagctgtggcccagcgtggccttcgccgagggcagcagcagcgaggaggagctggaggccgagtgcttccccgtgaagccccacaacaagagcttcgcccacatcctggagctggtgaaggagggcagcagctgccccggccagctgagacagagacaggccgccagctggggcgtggccggcagagaggccgagggcggcagaccccccgccgccaccagccccgccgaggtggtgtggagcagcgagaagacccccaaggccgaccaggacggcagaggcgaccccggcgagggcgaggaggtggcctgggagcaggccgccgtggccttcgacgccgtgctgagattcgccgagagacagccctgcttcagcgcccaggaggtgggccagctgagagccctgagagccgtgttcagaagccagcagcaggtgagaagaagaagaggcgccctgggcgccgtggtgaaggtggaggccctgcaggagggccccggcggctgcggcgccaccgcccagagccccctgccctgcagcagcaccgccggcgacaactag

SEQ ID NO: 21886 - DNA, 960 bp, Artificial Sequence
  Description of Artificial Sequence: Synthetic coding sequence
atgaagggcgagatccagcagagcctgggcgcctgggtgctgctgacctgcctgggcctgtactgcggcaagaccctgctgttcaagaacggcagcaccgagatctacggcgagtgcggcgtgtgccccagaggccagagaaccaacgcccagaagtactgccagccctgcaccgagagccccgagctgtacgactggctgtacctgggcttcatggccatgctgcccctggtgctgcactggttcttcatcgagtggtacagcggcaagaagagcagcagcgccctgttccagcacatcaccgccctgttcgagtgcagcatggccgccatcatcaccctgctggtgagcgaccccgtgggcgtgctgtacatcagaagctgcagagtgctgatgctgagcgactggtacaccatgctgtacaaccccagccccgactacgtgaccaccgtgcactgcacccacgaggccgtgtaccccctgtacaccatcgtgttcatctactacgccttctgcctggtgctgatgatgctgctgagacccctgctggtgaagaagatcgcctgcggcctgggcaagagcgacagattcaagagcatctacgccgccctgtacttcttccccatcctgaccgtgctgcaggccgtgggcggcggcctgctgtactacgccttcccctacatcatcctggtgctgagcctggtgaccctggccgtgtacatgagcgccagcgagatcgagaactgctacgacctgctggtgagaaagaagagactgatcgtgctgttcagccactggctgctgcacgcctacggcatcatcagcatcagcagagtggacaagctggagcaggacctgcccctgctggccctggtgcccacccccgccctgttctacctgttcaccgccaagttcaccgagcccagcagaatcctgagcgagggcgccaacggccactag

SEQ ID NO: 21887 - DNA, 936 bp, Artificial Sequence
  Description of Artificial Sequence: Synthetic coding sequence
atggccgtggacatccagcccgcctgcctgggcctgtactgcggcaagaccctgctgttcaagaacggcagcaccgagatctacggcgagtgcggcgtgtgccccagaggccagagaaccaacgcccagaagtactgccagccctgcaccgagagccccgagctgtacgactggctgtacctgggcttcatggccatgctgcccctggtgctgcactggttcttcatcgagtggtacagcggcaagaagagcagcagcgccctgttccagcacatcaccgccctgttcgagtgcagcatggccgccatcatcaccctgctggtgagcgaccccgtgggcgtgctgtacatcagaagctgcagagtgctgatgctgagcgactggtacaccatgctgtacaaccccagccccgactacgtgaccaccgtgcactgcacccacgaggccgtgtaccccctgtacaccatcgtgttcatctactacgccttctgcctggtgctgatgatgctgctgagacccctgctggtgaagaagatcgcctgcggcctgggcaagagcgacagattcaagagcatctacgccgccctgtacttcttccccatcctgaccgtgctgcaggccgtgggcggcggcctgctgtactacgccttcccctacatcatcctggtgctgagcctggtgaccctggccgtgtacatgagcgccagcgagatcgagaactgctacgacctgctggtgagaaagaagagactgatcgtgctgttcagccactggctgctgcacgcctacggcatcatcagcatcagcagagtggacaagctggagcaggacctgcccctgctggccctggtgcccacccccgccctgttctacctgttcaccgccaagttcaccgagcccagcagaatcctgagcgagggcgccaacggccactag

SEQ ID NO: 21888 - DNA, 918 bp, Artificial Sequence
  Description of Artificial Sequence: Synthetic coding sequence
atggcctgcctgggcctgtactgcggcaagaccctgctgttcaagaacggcagcaccgagatctacggcgagtgcggcgtgtgccccagaggccagagaaccaacgcccagaagtactgccagccctgcaccgagagccccgagctgtacgactggctgtacctgggcttcatggccatgctgcccctggtgctgcactggttcttcatcgagtggtacagcggcaagaagagcagcagcgccctgttccagcacatcaccgccctgttcgagtgcagcatggccgccatcatcaccctgctggtgagcgaccccgtgggcgtgctgtacatcagaagctgcagagtgctgatgctgagcgactggtacaccatgctgtacaaccccagccccgactacgtgaccaccgtgcactgcacccacgaggccgtgtaccccctgtacaccatcgtgttcatctactacgccttctgcctggtgctgatgatgctgctgagacccctgctggtgaagaagatcgcctgcggcctgggcaagagcgacagattcaagagcatctacgccgccctgtacttcttccccatcctgaccgtgctgcaggccgtgggcggcggcctgctgtactacgccttcccctacatcatcctggtgctgagcctggtgaccctggccgtgtacatgagcgccagcgagatcgagaactgctacgacctgctggtgagaaagaagagactgatcgtgctgttcagccactggctgctgcacgcctacggcatcatcagcatcagcagagtggacaagctggagcaggacctgcccctgctggccctggtgcccacccccgccctgttctacctgttcaccgccaagttcaccgagcccagcagaatcctgagcgagggcgccaacggccactag

SEQ ID NO: 21889 - DNA, 1518 bp, Artificial Sequence
  Description of Artificial Sequence: Synthetic coding sequence
atgagcagaagctacaacgacgagctgcagttcctggagaagatcaacaagaactgctggagaatcaagaagggcttcgtgcccaacatgcaggtggagggcgtgttctacgtgaacgacgccctggagaagctgatgttcgaggagctgagaaacgcctgcagaggcggcggcgtgggcggcttcctgcccgccatgaagcagatcggcaacgtggccgccctgcccggcatcgtgcacagaagcatcggcctgcccgacgtgcacagcggctacggcttcgccatcggcaacatggccgccttcgacatgaacgaccccgaggccgtggtgagccccggcggcgtgggcttcgacatcaactgcggcgtgagactgctgagaaccaacctggacgagagcgacgtgcagcccgtgaaggagcagctggcccaggccatgttcgaccacatccccgtgggcgtgggcagcaagggcgtgatccccatgaacgccaaggacctggaggaggccctggagatgggcgtggactggagcctgagagagggctacgcctgggccgaggacaaggagcactgcgaggagtacggcagaatgctgcaggccgaccccaacaaggtgagcgccagagccaagaagagaggcctgccccagctgggcaccctgggcgccggcaaccactacgccgagatccaggtggtggacgagatcttcaacgagtacgccgccaagaagatgggcatcgaccacaagggccaggtgtgcgtgatgatccacagcggcagcagaggcctgggccaccaggtggccaccgacgccctggtggccatggagaaggccatgaagagagacaagatcatcgtgaacgacagacagctggcctgcgccagaatcgccagccccgagggccaggactacctgaagggcatggccgccgccggcaactacgcctgggtgaacagaagcagcatgaccttcctgaccagacaggccttcgccaaggtgttcaacaccacccccgacgacctggacctgcacgtgatctacgacgtgagccacaacatcgccaaggtggagcagcacgtggtggacggcaaggagagaaccctgctggtgcacagaaagggcagcaccagagccttccccccccaccaccccctgatcgccgtggactaccagctgaccggccagcccgtgctgatcggcggcaccatgggcacctgcagctacgtgctgaccggcaccgagcagggcatgaccgagaccttcggcaccacctgccacggcgccggcagagccctgagcagagccaagagcagaagaaacctggacttccaggacgtgctggacaagctggccgacatgggcatcgccatcagagtggccagccccaagctggtgatggaggaggcccccgagagctacaagaacgtgaccgacgtggtgaacacctgccacgacgccggcatcagcaagaaggccatcaagctgagacccatcgccgtgatcaagggctag

SEQ ID NO: 21890 - DNA, 315 bp, Artificial Sequence
  Description of Artificial Sequence: Synthetic coding sequence
atgagctgcgtgccctggaagggcgacaaggccaagagcgagagcctggagctgccccaggccgcccccccccagatctaccacgagaagcagagaagagagctgtgcgccctgcacgccctgaacaacgtgttccaggacagcaacgccttcaccagagacaccctgcaggagatcttccagagactgagccccaacaccatggtgaccccccacaagaagagcatgctgggcaacggcaactacgacgtgaacgtgatcatggccgccctgcagaccaagggctacgaggccgtgtggtgggacaagagatag

SEQ ID NO: 21891 - DNA, 189 bp, Artificial Sequence
  Description of Artificial Sequence: Synthetic coding sequence
atgagctgcgtgccctggaagggcgacaaggccaagagcgagagcctggagctgccccaggccgcccccccccagatctaccacgagaagcagagaagagagctgtgcgccctgcacgccctgaacaacgtgttccaggacagcaacgccttcaccagagacaccctgcaggagatcttccagagatag

SEQ ID NO: 21892 - DNA, 186 bp, Artificial Sequence
  Description of Artificial Sequence: Synthetic coding sequence
atgagctgcgtgccctggaagggcgacaaggccaagagcgagagcctggagctgccccaggccgcccccccccagatctaccacgagaagcagagaagagagctgtgcgccctgcacgccctgaacaacgtgttccaggacagcaacgccttcaccagagacaccctgcaggagatcttccagtag

SEQ ID NO: 21893 - DNA, 627 bp, Artificial Sequence
  Description of Artificial Sequence: Synthetic coding sequence
ggcgacgccgagacccccggcagcgtggagagaagaggcagaagaggcgccgaggacggcatgagccaggcccccggcgcccagcccagcccccccaccgtgtaccacgagagacagagactggagctgtgcgccgtgcacgccctgaacaacgtgctgcagcagcagctgttcagccaggaggccgccgacgagatctgcaagagactggcccccgacagcagactgaacccccacagaagcctgctgggcaccggcaactacgacgtgaacgtgatcatggccgccctgcagggcctgggcctggccgccgtgtggtgggacagaagaagacccctgagccagctggccctgccccaggtgctgggcctgatcctgaacctgcccagccccgtgagcctgggcctgctgagcctgcccctgagaagaagacactgggtggccctgagacaggtggacggcgtgtactacaacctggacagcaagctgagagcccccgaggccctgggcgacgaggacggcgtgagagccttcctggccgccgccctggcccagggcctgtgcgaggtgctgctggtggtgaccaaggaggtggaggagaagggcagctggctgagaaccgactag

SEQ ID NO: 21894 - DNA, 567 bp, Artificial Sequence
  Description of Artificial Sequence: Synthetic coding sequence
atgagccaggcccccggcgcccagcccagcccccccaccgtgtaccacgagagacagagactggagctgtgcgccgtgcacgccctgaacaacgtgctgcagcagcagctgttcagccaggaggccgccgacgagatctgcaagagactggcccccgacagcagactgaacccccacagaagcctgctgggcaccggcaactacgacgtgaacgtgatcatggccgccctgcagggcctgggcctggccgccgtgtggtgggacagaagaagacccctgagccagctggccctgccccaggtgctgggcctgatcctgaacctgcccagccccgtgagcctgggcctgctgagcctgcccctgagaagaagacactgggtggccctgagacaggtggacggcgtgtactacaacctggacagcaagctgagagcccccgaggccctgggcgacgaggacggcgtgagagccttcctggccgccgccctggcccagggcctgtgcgaggtgctgctggtggtgaccaaggaggtggaggagaagggcagctggctgagaaccgactag

SEQ ID NO: 21895 - DNA, 441 bp, Artificial Sequence
  Description of Artificial Sequence: Synthetic coding sequence
atgagccaggcccccggcgcccagcccagcccccccaccgtgtaccacgagagacagagactggagctgtgcgccgtgcacgccctgaacaacgtgctgcagcagcagctgttcagccaggaggccgccgacgagatctgcaagagacccctgagccagctggccctgccccaggtgctgggcctgatcctgaacctgcccagccccgtgagcctgggcctgctgagcctgcccctgagaagaagacactgggtggccctgagacaggtggacggcgtgtactacaacctggacagcaagctgagagcccccgaggccctgggcgacgaggacggcgtgagagccttcctggccgccgccctggcccagggcctgtgcgaggtgctgctggtggtgaccaaggaggtggaggagaagggcagctggctgagaaccgactag

SEQ ID NO: 21896 - DNA, 567 bp, Artificial Sequence; identical to SEQ ID NO: 21894
  Description of Artificial Sequence: Synthetic coding sequence

SEQ ID NO: 21897 - DNA, 1392 bp, Artificial Sequence
  Description of Artificial Sequence: Synthetic coding sequence
atgagagccggccccgagccccaggccctggccggccagaagagaggcgccctgagactgctggtgcccagactggtgctgaccgtgagcgcccccgccgaggtgagaagaagagtgctgagacccgtgctgagctggatggacagagagaccagagccctggccgacagccacttcagaggcctgggcgtggacgtgcccggcgtgggccaggcccccggcagagtggccttcgtgagcgagcccggcgccttcagctacgccgacttcgtgagaggcttcctgctgcccaacctgccctgcgtgttcagcagcgccttcacccagggctggggcagcagaagaagatgggtgacccccgccggcagacccgacttcgaccacctgctgagaacctacggcgacgtggtggtgcccgtggccaactgcggcgtgcaggagtacaacagcaaccccaaggagcacatgaccctgagagactacatcacctactggaaggagtacatccaggccggctacagcagccccagaggctgcctgtacctgaaggactggcacctgtgcagagacttccccgtggaggacgtgttcaccctgcccgtgtacttcagcagcgactggctgaacgagttctgggacgccctggacgtggacgactacagattcgtgtacgccggccccgccggcagctggagccccttccacgccgacatcttcagaagcttcagctggagcgtgaacgtgtgcggcagaaagaagtggctgctgttcccccccggccaggaggaggccctgagagacagacacggcaacctgccctacgacgtgaccagccccgccctgtgcgacacccacctgcaccccagaaaccagctggccggcccccccctggagatcacccaggaggccggcgagatggtgttcgtgcccagcggctggcaccaccaggtgcacaacctggacgacaccatcagcatcaaccacaactgggtgaacggcttcaacctggccaacatgtggagattcctgcagcaggagctgtgcgccgtgcaggaggaggtgagcgagtggagagacagcatgcccgactggcaccaccactgccaggtgatcatgagaagctgcagcggcatcaacttcgaggagttctaccacttcctgaaggtgatcgccgagaagagactgctggtgctgagagaggccgccgccgaggacggcgccggcctgggcttcgagcaggccgccttcgacgtgggcagaatcaccgaggtgctggccagcctggtggcccaccccgacttccagagagtggacaccagcgccttcagcccccagcccaaggagctgctgcagcagctgagagaggccgtggacgccgccgccgccccctag

SEQ ID NO: 21898 - DNA, 1323 bp, Artificial Sequence
  Description of Artificial Sequence: Synthetic coding sequence
tgagccctggccggccagaagagaggcgccctgagactgctggtgcccagactggtgctgaccgtgagcgcccccgccgaggtgagaagaagagtgctgagacccgtgctgagctggatggacagagagaccagagccctggccgacagccacttcagaggcctgggcgtggacgtgcccggcgtgggccaggcccccggcagagtggccttcgtgagcgagcccggcgccttcagctacgccgacttcgtgagaggcttcctgctgcccaacctgccctgcgtgttcagcagcgccttcacccagggctggggcagcagaagaagatgggtgacccccgccggcagacccgacttcgaccacctgctgagaacctacggcgacgtggtggtgcccgtggccaactgcggcgtgcaggagtacaacagcaaccccaaggagcacatgaccctgagagactacatcacctactggaaggagtacatccaggccggctacagcagccccagaggctgcctgtacctgaaggactggcacctgtgcagagacttccccgtggaggacgtgttcaccctgcccgtgtacttcagcagcgactggctgaacgagttctgggacgccctggacgtggacgactacagattcgtgtacgccggccccgccggcagctggagccccttccacgccgacatcttcagaagcttcagctggagcgtgaacgtgtgcggcagaaagaagtggctgctgttcccccccggccaggaggaggccctgagagacagacacggcaacctgccctacgacgtgaccagccccgccctgtgcgacacccacctgcaccccagaaaccagctggccggcccccccctggagatcacccaggaggccggcgagatggtgttcgtgcccagcggctggcaccaccaggtgcacaacctggacgacaccatcagcatcaaccacaactgggtgaacggcttcaacctggccaacatgtggagattcctgcagcaggagctgtgcgccgtgcaggaggaggtgatcatgagaagctgcagcggcatcaacttcgaggagttctaccacttcctgaaggtgatcgccgagaagagactgctggtgctgagagaggccgccgccgaggacggcgccggcctgggcttcgagcaggccgccttcgacgtgggcagaatcaccgaggtgctggccagcctggtggcccaccccgacttccagagagtggacaccagcgccttcagcccccagcccaaggagctgctgcagcagctgagagaggccgtggacgccgccgccgccccctag

SEQ ID NO: 21899 - DNA, 951 bp, Artificial Sequence
  Description of Artificial Sequence: Synthetic coding sequence
atggccgaggccgccctggaggccgtgagaagcgagctgagagagttccccgccgccgccagagagctgtgcgtgcccctggccgtgccctacctggacaagccccccacccccctgcacttctacagagactgggtgtgccccaacagaccctgcatcatcagaaacgccctgcagcactggcccgccctgcagaagtggagcctgccctacttcagagccaccgtgggcagcaccgaggtgagcgtggccgtgacccccgacggctacgccgacgccgtgagaggcgacagattcatgatgcccgccgagagaagactgcccctgagcttcgtgctggacgtgctggagggcagagcccagcaccccggcgtgctgtacgtgcagaagcagtgcagcaacctgcccagcgagctgccccagctgctgcccgacctggagagccacgtgccctgggccagcgaggccctgggcaagatgcccgacgccgtgaacttctggctgggcgaggccgccgccgtgaccagcctgcacaaggaccactacgagaacctgtactgcgtggtgagcggcgagaagcacttcctgttccacccccccagcgacagacccttcatcccctacgagctgtacacccccgccacctaccagctgaccgaggagggcaccttcaaggtggtggacgaggaggccatggagaaggtgccctggatccccctggaccccctggcccccgacctggccagataccccagctacagccaggcccaggccctgagatgcaccgtgagagccggcgagatgctgtacctgcccgccctgtggttccaccacgtgcagcagagccagggctgcatcgccgtgaacttctggtacgacatggagtacgacctgaagtacagctacttccagctgctggacagcctgaccaaggccagcggcctggactag

SEQ ID NO: 21900 - DNA, 1005 bp, Artificial Sequence
  Description of Artificial Sequence: Synthetic coding sequence
atggtgaccggcggcgcccacagcagaagcagaggcggcctgcccagcgccagcagaagaggcctgttcagaggcggccccaaggaggtgaccagcggcgtgagacccggcagcagacccctgcccagaagaagaagctgcagacccatggccggcggctgggcccagggcagcagaagagccgccagactgcccgagggcggcagactgatggcccccgccagcagactgctggccctgtgggccctggccgccgtggccctgcccggcagcggcgccgagggcgacggcggctggagacccggcggccccggcgccgtggccgaggaggagagatgcaccgtggagagaagagccgacctgacctacgccgagttcgtgcagcagtacgccttcgtgagacccgtgatcctgcagggcctgaccgacaacagcagattcagagccctgtgcagcagagacagactgctggccagcttcggcgacagagtggtgagactgagcaccgccaacacctacagctaccacaaggtggacctgcccttccaggagtacgtggagcagctgctgcacccccaggaccccaccagcctgggcaacgacaccctgtacttcttcggcgacaacaacttcaccgagtgggccagcctgttcagacactacagccccccccccttcggcctgctgggcaccgcccccgcctacagcttcggcatcgccggcgccggcagcggcgtgcccttccactggcacggccccggctacagcgaggtgatctacggcagaaagagatggttcctgtacccccccgagaagacccccgagttccaccccaacaagaccaccctggcctggctgagagacacctaccccgccctgccccccagcgccagacccctggagtgcaccatcagagccggcgaggtgctgtacttccccgacagatggtggcacgccaccctgaacctggacaccagcgtgttcatcagcaccttcctgggctag

SEQ ID NO: 21901 - DNA, 858 bp, Artificial Sequence
  Description of Artificial Sequence: Synthetic coding sequence
atggccggcggctgggcccagggcagcagaagagccgccagactgcccgagggcggcagactgatggcccccgccagcagactgctggccctgtgggccctggccgccgtggccctgcccggcagcggcgccgagggcgacggcggctggagacccggcggccccggcgccgtggccgaggaggagagatgcaccgtggagagaagagccgacctgacctacgccgagttcgtgcagcagtacgccttcgtgagacccgtgatcctgcagggcctgaccgacaacagcagattcagagccctgtgcagcagagacagactgctggccagcttcggcgacagagtggtgagactgagcaccgccaacacctacagctaccacaaggtggacctgcccttccaggagtacgtggagcagctgctgcacccccaggaccccaccagcctgggcaacgacaccctgtacttcttcggcgacaacaacttcaccgagtgggccagcctgttcagacactacagccccccccccttcggcctgctgggcaccgcccccgcctacagcttcggcatcgccggcgccggcagcggcgtgcccttccactggcacggccccggctacagcgaggtgatctacggcagaaagagatggttcctgtacccccccgagaagacccccgagttccaccccaacaagaccaccctggcctggctgagagacacctaccccgccctgccccccagcgccagacccctggagtgcaccatcagagccggcgaggtgctgtacttccccgacagatggtggcacgccaccctgaacctggacaccagcgtgttcatcagcaccttcctgggctag

SEQ ID NO: 21902 - DNA, 915 bp, Artificial Sequence
  Description of Artificial Sequence: Synthetic coding sequence
atggtgaccggcggcgcccacagcagaagcagaggcggcctgcccagcgccagcagaagaggcctgttcagaggcggccccaaggaggtgaccagcggcgtgagacccggcagcagacccctgcccagaagaagaagctgcagacccatggccggcggctgggcccagggcagcagaagagccgccagactgcccgagggcggcagactgatggcccccgccagcagactgctggccctgtgggccctggccgccgtggccctgcccggcagcggcgccgagggcgacggcggctggtacgccttcgtgagacccgtgatcctgcagggcctgaccgacaacagcagattcagagccctgtgcagcagagacagactgctggccagcttcggcgacagagtggtgagactgagcaccgccaacacctacagctaccacaaggtggacctgcccttccaggagtacgtggagcagctgctgcacccccaggaccccaccagcctgggcaacgacaccctgtacttcttcggcgacaacaacttcaccgagtgggccagcctgttcagacactacagccccccccccttcggcctgctgggcaccgcccccgcctacagcttcggcatcgccggcgccggcagcggcgtgcccttccactggcacggccccggctacagcgaggtgatctacggcagaaagagatggttcctgtacccccccgagaagacccccgagttccaccccaacaagaccaccctggcctggctgagagacacctaccccgccctgccccccagcgccagacccctggagtgcaccatcagagccggcgaggtgctgtacttccccgacagatggtggcacgccaccctgaacctggacaccagcgtgttcatcagcaccttcctgggctag

SEQ ID NO: 21903 - DNA, 2238 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagagaggccatgtgccccggcgtgagcggcgaggacagcagcctgctgctggccacccaggtggagggccaggccaccaacctgcagagactggccgagcccagccagctgctgaagagcgccatcgtgcacctgatcaactaccaggacgacgccgagctggccaccagagccctgcccgagctgaccaagctgctgaacgacgaggaccccgtggtggtgaccaaggccgccatgatcgtgaaccagctgagcaagaaggaggccagcagaagagccctgatgggcagcccccagctggtggccgccgtggtgagaaccatgcagaacaccagcgacctggacaccgccagatgcaccaccagcatcctgcacaacctgagccaccacagagagggcctgctggccatcttcaagagcggcggcatccccgccctggtgagaatgctgagcagccccgtggagagcgtgctgttctacgccatcaccaccctgcacaacctgctgctgtaccaggagggcgccaagatggccgtgagactggccgacggcctgcagaagatggtgcccctgctgaacaagaacaaccccaagttcctggccatcaccaccgactgcctgcagctgctggcctacggcaaccaggagagcaagctgatcatcctggccaacggcggcccccaggccctggtgcagatcatgagaaactacagctacgagaagctgctgtggaccaccagcagagtgctgaaggtgctgagcgtgtgccccagcaacaagcccgccatcgtggaggccggcggcatgcaggccctgggcaagcacctgaccagcaacagccccagactggtgcagaactgcctgtggaccctgagaaacctgagcgacgtggccaccaagcaggagggcctggagagcgtgctgaagatcctggtgaaccagctgagcgtggacgacgtgaacgtgctgacctgcgccaccggcaccctgagcaacctgacctgcaacaacagcaagaacaagaccctggtgacccagaacagcggcgtggaggccctgatccacgccatcctgagagccggcgacaaggacgacatcaccgagcccgccgtgtgcgccctgagacacctgaccagcagacaccccgaggccgagatggcccagaacagcgtgagactgaactacggcatccccgccatcgtgaagctgctgaaccagcccaaccagtggcccctggtgaaggccaccatcggcctgatcagaaacctggccctgtgccccgccaaccacgcccccctgcaggaggccgccgtgatccccagactggtgcagctgctggtgaaggcccaccaggacgcccagagacacgtggccgccggcacccagcagccctacaccgacggcgtgagaatggaggagatcgtggagggctgcaccggcgccctgcacatcctggccagagaccccatgaacagaatggagatcttcagactgaacaccatccccctgttcgtgcagctgctgtacagcagcgtggagaacatccagagagtggccgccggcgtgctgtgcgagctggcccaggacaaggaggccgccgacgccatcgacgccgagggcgccagcgcccccctgatggagctgctgcacagcagaaacgagggcaccgccacctacgccgccgccgtgctgttcagaatcagcgaggacaagaaccccgactacagaaagagagtgagcgtggagctgaccaacagcctgttcaagcacgaccccgccgcctgggaggccgcccagagcatgatccccatcaacgagccctacggcgacgacatggacgccacctacagacccatgtacagcagcgacgtgcccctggaccccctggagatgcacatggacatggacggcgactaccccatcgacacctacagcgacggcctgagacccccctaccccaccgccgaccacatgctggcctag

SEQ ID NO: 21904 - DNA, 2238 bp, Artificial Sequence; identical to SEQ ID NO: 21903
  Description of Artificial Sequence: Synthetic coding sequence

SEQ ID NO: 21905 - DNA, 1890 bp, Artificial Sequence
  Description of Artificial Sequence: Synthetic coding sequence
atgcacgtgcccggcggcaagttcgacttcgacgacggcggctgctacgtgggcggctgggaggccggcagagcccacggctacggcgtgtgcaccggccccggcgcccagggcgagtacagcggctgctgggcccacggcttcgagagcctgggcgtgttcaccggccccggcggccacagctaccagggccactggcagcagggcaagagagagggcctgggcgtggagagaaagagcagatggacctacagaggcgagtggctgggcggcctgaagggcagaagcggcgtgtgggagagcgtgagcggcctgagatacgccggcctgtggaaggacggcttccaggacggctacggcaccgagacctacagcgacggcggcacctaccagggccagtggcaggccggcaagagacacggctacggcgtgagacagagcgtgccctaccaccaggccgccctgctgagaagccccagaagaaccagcctggacagcggccacagcgacccccccaccccccccccccccctgcccctgcccggcgacgagggcggcagccccgccagcggcagcagaggcggcttcgtgctggccggccccggcgacgccgacggcgccagcagcagaaagagaacccccgccgccggcggcttcttcagaagaagcctgctgctgagcggcctgagagccggcggcagaagaagcagcctgggcagcaagagaggcagcctgagaagcgaggtgagcagcgaggtgggcagcaccggcccccccggcagcgaggccagcggcccccccgccgccgccccccccgccctgatcgagggcagcgccaccgaggtgtacgccggcgagtggagagccgacagaagaagcggcttcggcgtgagccagagaagcaacggcctgagatacgagggcgagtggctgggcaacagaagacacggctacggcagaaccaccagacccgacggcagcagagaggagggcaagtacaagagaaacagactggtgcacggcggcagagtgagaagcctgctgcccctggccctgagaagaggcaaggtgaaggagaaggtggacagagccgtggagggcgccagaagagccgtgagcgccgccagacagagacaggagatcgccgccgccagagccgccgacgccctgctgaaggccgtggccgccagcagcgtggccgagaaggccgtggaggccgccagaatggccaagctgatcgcccaggacctgcagcccatgctggaggcccccggcagaagacccagacaggacagcgagggcagcgacaccgagcccctggacgaggacagccccggcgtgtacgagaacggcctgacccccagcgagggcagccccgagctgcccagcagccccgccagcagcagacagccctggagaccccccgcctgcagaagccccctgccccccggcggcgaccagggccccttcagcagccccaaggcctggcccgaggagtggggcggcgccggcgcccaggccgaggagctggccggctacgaggccgaggacgaggccggcatgcagggccccggccccagagacggcagccccctgctgggcggctgcagcgacagcagcggcagcctgagagaggaggagggcgaggacgaggagcccctgccccccctgagagcccccgccggcaccgagcccgagcccatcgccatgctggtgctgagaggcagcagcagcagaggccccgacgccggctgcctgaccgaggagctgggcgagcccgccgccaccgagagacccgcccagcccggcgccgccaaccccctggtggtgggcgccgtggccctgctggacctgagcctggccttcctgttcagccagctgctgacctag

SEQ ID NO: 21906 - DNA, 1590 bp, Artificial Sequence
  Description of Artificial Sequence: Synthetic coding sequence
atgagcaccaacgagaacgccaacacccccgccgccagactgcacagattcaagaacaagggcaaggacagcaccgagatgagaagaagaagaatcgaggtgaacgtggagctgagaaaggccaagaaggacgaccagatgctgaagagaagaaacgtgagcagcttccccgacgacgccaccagccccctgcaggagaacagaaacaaccagggcaccgtgaactggagcgtggacgacatcgtgaagggcatcaacagcagcaacgtggagaaccagctgcaggccacccaggccgccagaaagctgctgagcagagagaagcagccccccatcgacaacatcatcagagccggcctgatccccaagttcgtgagcttcctgggcagaaccgactgcagccccatccagttcgagagcgcctgggccctgaccaacatcgccagcggcaccagcgagcagaccaaggccgtggtggacggcggcgccatccccgccttcatcagcctgctggccagcccccacgcccacatcagcgagcaggccgtgtgggccctgggcaacatcgccggcgacggcagcgtgttcagagacctggtgatcaagtacggcgccgtggaccccctgctggccctgctggccgtgcccgacatgagcagcctggcctgcggctacctgagaaacctgacctggaccctgagcaacctgtgcagaaacaagaaccccgccccccccatcgacgccgtggagcagatcctgcccaccctggtgagactgctgcaccacgacgaccccgaggtgctggccgacacctgctgggccatcagctacctgaccgacggccccaacgagagaatcggcatggtggtgaagaccggcgtggtgccccagctggtgaagctgctgggcgccagcgagctgcccatcgtgacccccgccctgagagccatcggcaacatcgtgaccggcaccgacgagcagacccaggtggtgatcgacgccggcgccctggccgtgttccccagcctgctgaccaaccccaagaccaacatccagaaggaggccacctggaccatgagcaacatcaccgccggcagacaggaccagatccagcaggtggtgaaccacggcctggtgcccttcctggtgagcgtgctgagcaaggccgacttcaagacccagaaggaggccgtgtgggccgtgaccaactacaccagcggcggcaccgtggagcagatcgtgtacctggtgcactgcggcatcatcgagcccctgatgaacctgctgaccgccaaggacaccaagatcatcctggtgatcctggacgccatcagcaacatcttccaggccgccgagaagctgggcgagaccgagaagctgagcatcatgatcgaggagtgcggcggcctggacaagatcgaggccctgcagaaccacgagaacgagagcgtgtacaaggccagcctgagcctgatcgagaagtacttcagcgtggaggaggaggaggaccagaacgtggtgcccgagaccaccagcgagggctacaccttccaggtgcaggacggcgcccccggcaccttcaacttctag

SEQ ID NO: 21907 - DNA, 459 bp, Artificial Sequence
  Description of Artificial Sequence: Synthetic coding sequence
atgagagagaagctgatcagactgcagagcctgtacatcgaccagttcaagagactgcagcacctgctgaaggagaagaagagaagatacctgcacaacagaaaggtggagcacgaggccctgggcagcagcctgctgaccggccccgagggcctgctggccaaggagagagagaacctgaagagactgaagtgcctgagaagatacagacagagatacggcgtggaggccctgctgcacagacagctgaaggagagaagaatgctggccaccgacggcgccgcccagcaggcccacaccaccagaagcagccagagatgcctggccttcgtggacgacgtgagatgcagcaaccagagcctgcccatgaccagacactgcctgacccagaaggacgccaccgccatcggcgacctgctgaccctgtactgcggcctgatggagaccgccctggactag

SEQ ID NO: 21908 - DNA, 1479 bp, Artificial Sequence
  Description of Artificial Sequence: Synthetic coding sequence
atgaacagaatcagaatccacgtgctgcccaccaacagaggcagaatcacccccgtgcccagaagccaggagcccctgagctgcgccttcacccacagaccctgcagccaccccagactggagggccaggagttctgcatcaagcacatcctggaggacaagaacgcccccttcaagcagtgcagctacatcagcaccaagaacggcaagagatgccccaacgccgcccccaagcccgagaagaaggacggcgtgagcttctgcgccgagcacgtgagaagaaacgccctggccctgcacgcccagatgaagaagaccaaccccggccccgtgggcgagaccctgctgtgccagctgagcagctacgccaagaccgagctgggcagccagacccccgagagcagcagaagcgaggccagcagaatcctggacgaggacagctggagcgacggcgagcaggagcccatcaccgtggaccagacctggagaggcgaccccgacagcgaggccgacagcatcgacagcgaccaggaggaccccctgaagcacgccggcgtgtacaccgccgaggaggtggccctgatcatgagagagaagctgatcagactgcagagcctgtacatcgaccagttcaagagactgcagcacctgctgaaggagaagaagagaagatacctgcacaacagaaaggtggagcacgaggccctgggcagcagcctgctgaccggccccgagggcctgctggccaaggagagagagaacctgaagagactgaagtgcctgagaagatacagacagagatacggcgtggaggccctgctgcacagacagctgaaggagagaagaatgctggccaccgacggcgccgcccagcaggcccacaccaccagaagcagccagagatgcctggccttcgtggacgacgtgagatgcagcaaccagagcctgcccatgaccagacactgcctgacccacatctgccaggacaccaaccaggtgctgttcaagtgctgccagggcagcgaggaggtgccctgcaacaagcccgtgcccgtgagcctgagcgaggacccctgctgccccctgcacttccagctgcccccccagatgtacaagcccgagcaggtgctgagcgtgcccgacgacctggaggccggccccatggacctgtacctgagcgccgccgagctgcagcccaccgagagcctgcccctggagttcagcgacgacctggacgtggtgggcgacggcatgcagtgcccccccagccccctgctgttcgaccccagcctgaccctggaggaccacctggtgaaggagatcgccgaggaccccgtggacatcctgggccagatgcagatggccggcgacggctgcagaagccagggcagcagaaacagcgagaaggccagcgcccccctgagccagagcggcctggccaccgccaacggcaagcccgagcccaccagcatcagctag

SEQ ID NO: 21909 - DNA, 210 bp, Artificial Sequence
  Description of Artificial Sequence: Synthetic coding sequence
atgaacagaatcagaatccacgtgctgcccaccaacagaggcagaatcacccccgtgcccagaagccaggagcccctgagctgcgccttcacccacagaccctgcagccaccccagactggagggccaggagttctgcatcaagcacatcctggaggacaagaacgcccccttcaagcagtgcagctacatcagcaccaagaacggctag

SEQ ID NO: 21910 - DNA, 2376 bp, Artificial Sequence
  Description of Artificial Sequence: Synthetic coding sequence
atgcccctgtacgacaaccagaaggccagaagcgtgatgaacgagtgcgagagacacgtgatcttcgccagaaccgacgccgacgccccccccccccccgaggactgggaggagcacgtgaacagaaccggctggaccatggcccagaacaagctgttcaacaagatcctgaaggccctgcagagcgacagactggccagactggccaacgagggcgcctgcaacgagcccgtgctgagaagagtggccgtggacaagtgcgccagaagagtgagacaggccctggccagcgtgagctgggacaccaagctgatccagtggctgcacaccaccctggtggagaccctgagcctgcccatgctggccgcctacctggacgccctgcagaccctgaagggcaagatccccaccctgatcgacagaatgctggtgagcagcaacaccaagaccggcgccgccggcgccgaggccctgagcctgctgctgaagagaccctgggaccccgccgtgggcgtgctgagccacaacaagcccagcaagctgcccggcagccccctgatcctgatcgccagcagcggccccagcagcagcgtgttccccaccagcagaagacacagattctggcagagccagctgagctgcctgggcaaggtgatccccgtggccacccacctgctgaacaacggcagcggcgtgggcgtgctgcagtgcctggagcacatgatcggcgccgtgagaagcaaggtgctggagatccacagccacttcccccacaagcccatcatcctgatcggctggaacaccggcgccctggtggcctgccacgtgagcgtgatggagtacgtgaccgccgtggtgtgcctgggcttccccctgctgaccgtggacggccccagaggcgacgtggacgaccccctgctggacatgaagacccccgtgctgttcgtgatcggccagaacagcctgcagtgccaccccgaggccatggaggacttcagagagaagatcagagccgagaacagcctggtggtggtgggcggcgccgacgacaacctgagaatcagcaaggccaagaagaagagcgagggcctgacccagagcatggtggacagatgcatccaggacgagatcgtggacttcctgaccggcgtgctgaccagagccgagggccacatgggcagcgagcccagagaccaggacgccgagaagaagaagaagcccagagacgtggccagaagagacctggccttcgaggtgcccgagagaggcagcagacccgccagccccgccgccaagctgcccgccagccccagcggcagcgaggacctgagcagcgtgagcagcagccccaccagcagccccaagaccaaggtgaccaccgtgaccagcgcccagaagagcagccagatcggcagcagccagctgctgaagagacacgtgcagagaaccgaggccgtgctgacccacaagcaggcccaggtgcccatcagcagcgagccccccgaggagggcgagaaggaggacctgagagtgcagctgaagagacaccaccccagcagccccctgcccggcagcaagaccagcaagagacccaagatcaaggtgagcctgatcagccagggcgacaccgccggcggcccctgcgcccccagccagggcagcgcccccgaggccgccggcggcaagcccatcaccatgaccctgggccaggccagcgccggcgccaaggagctgaccggcctgctgaccaccgccaagagcagcagcagcgagggcggcgtgagcgccagccccgtgcccagcgtggtgagcagcagcaccgcccccagcgccctgcacaccctgcagagcagactggtggccaccagccccggcagcagcctgcccggcgccaccagcgccagcagcctgctgcagggcctgagcttcagcctgcaggacatcagcagcaagaccagcggcctgcccgccaaccccagccccggccccgccccccaggccaccagcgtgaagctgcccacccccatgcagagcctgggcgccatcaccaccggcaccagcaccatcgtgagaaccatccccgtggccaccaccctgagcagcctgggcgccacccccggcggcaagcccaccgccatccaccagctgctgaccaacggcggcctggccaagctggccagcagcctgcccggcctggcccagatcagcaaccaggccagcggcctgaaggtgcccaccaccatcaccctgaccctgagaggccagcccagcagaatcaccaccctgagccccatgggcagcggcgccgcccccagcgaggagagcagcagccaggtgctgcccagcagcagccagagactgccccccgccccctag

SEQ ID NO: 21911 - DNA, 2637 bp, Artificial Sequence
  Description of Artificial Sequence: Synthetic coding sequence
atggcccacagaggcggcgagagagacttccagaccagcgccagaagaatgggcaccagcctgctgttccagctgagcgtgcacgagagagagctggacctggtgttcctggaccacagctacgccaagccctggagcgcccaccccgacgccagcagcgccagacccaccagaatgctgttcgtgacccccagaagacagcacgagagcaccatcgagagcgacgtgcccatcgacgtggagaccgtgaccagcacccccatgcccctgtacgacaaccagaaggccagaagcgtgatgaacgagtgcgagagacacgtgatcttcgccagaaccgacgccgacgccccccccccccccgaggactgggaggagcacgtgaacagaaccggctggaccatggcccagaacaagctgttcaacaagatcctgaaggccctgcagagcgacagactggccagactggccaacgagggcgcctgcaacgagcccgtgctgagaagagtggccgtggacaagtgcgccagaagagtgagacaggccctggccagcgtgagctgggacaccaagctgatccagtggctgcacaccaccctggtggagaccctgagcctgcccatgctggccgcctacctggacgccctgcagaccctgaagggcaagatccccaccctgatcgacagaatgctggtgagcagcaacaccaagaccggcgccgccggcgccgaggccctgagcctgctgctgaagagaccctgggaccccgccgtgggcgtgctgagccacaacaagcccagcaagctgcccggcagccccctgatcctgatcgccagcagcggccccagcagcagcgtgttccccaccagcagaagacacagattctggcagagccagctgagctgcctgggcaaggtgatccccgtggccacccacctgctgaacaacggcagcggcgtgggcgtgctgcagtgcctggagcacatgatcggcgccgtgagaagcaaggtgctggagatccacagccacttcccccacaagcccatcatcctgatcggctggaacaccggcgccctggtggcctgccacgtgagcgtgatggagtacgtgaccgccgtggtgtgcctgggcttccccctgctgaccgtggacggccccagaggcgacgtggacgaccccctgctggacatgaagacccccgtgctgttcgtgatcggccagaacagcctgcagtgccaccccgaggccatggaggacttcagagagaagatcagagccgagaacagcctggtggtggtgggcggcgccgacgacaacctgagaatcagcaaggccaagaagaagagcgagggcctgacccagagcatggtggacagatgcatccaggacgagatcgtggacttcctgaccggcgtgctgaccagagccgagggccacatgggcagcgagcccagagaccaggacgccgagaagaagaagaagcccagagacgtggccagaagagacctggccttcgaggtgcccgagagaggcagcagacccgccagccccgccgccaagctgcccgccagccccagcggcagcgaggacctgagcagcgtgagcagcagccccaccagcagccccaagaccaaggtgaccaccgtgaccagcgcccagaagagcagccagatcggcagcagccagctgctgaagagacacgtgcagagaaccgaggccgtgctgacccacaagcaggcccaggtgcccatcagcagcgagccccccgaggagggcgagaaggaggacctgagagtgcagctgaagagacaccaccccagcagccccctgcccggcagcaagaccagcaagagacccaagatcaaggtgagcctgatcagccagggcgacaccgccggcggcccctgcgcccccagccagggcagcgcccccgaggccgccggcggcaagcccatcaccatgaccctgggccaggccagcgccggcgccaaggagctgaccggcctgctgaccaccgccaagagcagcagcagcgagggcggcgtgagcgccagccccgtgcccagcgtggtgagcagcagcaccgcccccagcgccctgcacaccctgcagagcagactggtggccaccagccccggcagcagcctgcccggcgccaccagcgccagcagcctgctgcagggcctgagcttcagcctgcaggacatcagcagcaagaccagcggcctgcccgccaaccccagccccggccccgccccccaggccaccagcgtgaagctgcccacccccatgcagagcctgggcgccatcaccaccggcaccagcaccatcgtgagaaccatccccgtggccaccaccctgagcagcctgggcgccacccccggcggcaagcccaccgccatccaccagctgctgaccaacggcggcctggccaagctggccagcagcctgcccggcctggcccagatcagcaaccaggccagcggcctgaaggtgcccaccaccatcaccctgaccctgagaggccagcccagcagaatcaccaccctgagccccatgggcagcggcgccgcccccagcgaggagagcagcagccaggtgctgcccagcagcagccagagactgccccccgccccctag

SEQ ID NO: 21912 - DNA, 426 bp, Artificial Sequence
  Description of Artificial Sequence: Synthetic coding sequence
atgcccctgtacgacaaccagaaggccagaagcgtgatgaacgagtgcgagagacacgtgatcttcgccagaaccgacgccgacgccccccccccccccgaggactgggaggagcacgtgaacagaaccggctggaccatggcccagaacaagctgttcaacaagatcctgaaggccctgcagagcgacagactggccagactggccaacgagggcgcctgcaacgagcccgtgctgagaagagtggccgtggacaagtgcgccagaagagtgagacaggccctggccagcgtgagctgggacaccaagctgatccagtggctgcacaccaccctggtggagaccctgagcctgcccatgctggccgcctacctggacgccctgcagaccctgaagggcaaggtgatcctgaccttctgcggctag

SEQ ID NO: 21913 - DNA, 1593 bp, Artificial Sequence
  Description of Artificial Sequence: Synthetic coding sequence
atgcccctgtacgacaaccagaaggccagaagcgtgatgaacgagtgcgagagacacgtgatcttcgccagaaccgacgccgacgccccccccccccccgaggactgggaggagcacgtgaacagaaccggctggaccatggcccagaacaagctgttcaacaagatcctgaaggccctgcagagcgacagactggccagactggccaacgagggcgcctgcaacgagcccgtgctgagaagagtggccgtggacaagtgcgccagaagagtgagacaggccctggccagcgtgagctgggacaccaagctgatccagtggctgcacaccaccctggtggagaccctgagcctgcccatgctggccgcctacctggacgccctgcagaccctgaagggcaagatccccaccctgatcgacagaatgctggtgagcagcaacaccaagaccggcgccgccggcgccgaggccctgagcctgctgctgaagagaccctgggaccccgccgtgggcgtgctgagccacaacaagcccagcaagctgcccggcagccccctgatcctgatcgccagcagcggccccagcagcagcgtgttccccaccagcagaagacacagattctggcagagccagctgagctgcctgggcaaggtgatccccgtggccacccacctgctgaacaacggcagcggcgtgggcgtgctgcagtgcctggagcacatgatcggcgccgtgagaagcaaggtgctggagatccacagccacttcccccacaagcccatcatcctgatcggctggaacaccggcgccctggtggcctgccacgtgagcgtgatggagtacgtgaccgccgtggtgtgcctgggcttccccctgctgaccgtggacggccccagaggcgacgtggacgaccccctgctggacatgaagacccccgtgctgttcgtgatcggccagaacagcctgcagtgccaccccgaggccatggaggacttcagagagaagatcagagccgagaacagcctggtggtggtgggcggcgccgacgacaacctgagaatcagcaaggccaagaagaagagcgagggcctgacccagagcatggtggacagatgcatccaggacgagatcgtggacttcctgaccggcgtgctgaccagagccgagggccacatgggcagcgagcccagagaccaggacgccgagaagaagaagaagcccagagacgtggccagaagagacctggccttcgaggtgcccgagagaggcagcagacccgccagccccgccgccaagctgcccgccagccccagcggcagcgaggacctgagcagcgtgagcagcagccccaccagcagccccaagaccaaggtgaccaccgtgaccagcgcccagaagagcagccagatcggcagcagccagctgctgaagagacacgtgcagagaaccgaggccgtgctgacccacaagcaggcccaggtgcccatcagcagcgagccccccgaggagggcgagaaggaggacctgagagtgcagctgaagagacaccaccccagcacccccctgcccgtgtacagctggttccaccactag

SEQ ID NO: 21914 - DNA, 2295 bp, Artificial Sequence
  Description of Artificial Sequence: Synthetic coding sequence
atgaccctgccccactgccacagactgatgctgacccaccacctgttctggaccggctggaccatggcccagaacaagctgttcaacaagatcctgaaggccctgcagagcgacagactggccagactggccaacgagggcgcctgcaacgagcccgtgctgagaagagtggccgtggacaagtgcgccagaagagtgagacaggccctggccagcgtgagctgggacaccaagctgatccagtggctgcacaccaccctggtggagaccctgagcctgcccatgctggccgcctacctggacgccctgcagaccctgaagggcaagatccccaccctgatcgacagaatgctggtgagcagcaacaccaagaccggcgccgccggcgccgaggccctgagcctgctgctgaagagaccctgggaccccgccgtgggcgtgctgagccacaacaagcccagcaagctgcccggcagccccctgatcctgatcgccagcagcggccccagcagcagcgtgttccccaccagcagaagacacagattctggcagagccagctgagctgcctgggcaaggtgatccccgtggccacccacctgctgaacaacggcagcggcgtgggcgtgctgcagtgcctggagcacatgatcggcgccgtgagaagcaaggtgctggagatccacagccacttcccccacaagcccatcatcctgatcggctggaacaccggcgccctggtggcctgccacgtgagcgtgatggagtacgtgaccgccgtggtgtgcctgggcttccccctgctgaccgtggacggccccagaggcgacgtggacgaccccctgctggacatgaagacccccgtgctgttcgtgatcggccagaacagcctgcagtgccaccccgaggccatggaggacttcagagagaagatcagagccgagaacagcctggtggtggtgggcggcgccgacgacaacctgagaatcagcaaggccaagaagaagagcgagggcctgacccagagcatggtggacagatgcatccaggacgagatcgtggacttcctgaccggcgtgctgaccagagccgagggccacatgggcagcgagcccagagaccaggacgccgagaagaagaagaagcccagagacgtggccagaagagacctggccttcgaggtgcccgagagaggcagcagacccgccagccccgccgccaagctgcccgccagccccagcggcagcgaggacctgagcagcgtgagcagcagccccaccagcagccccaagaccaaggtgaccaccgtgaccagcgcccagaagagcagccagatcggcagcagccagctgctgaagagacacgtgcagagaaccgaggccgtgctgacccacaagcaggcccaggtgcccatcagcagcgagccccccgaggagggcgagaaggaggacctgagagtgcagctgaagagacaccaccccagcagccccctgcccggcagcaagaccagcaagagacccaagatcaaggtgagcctgatcagccagggcgacaccgccggcggcccctgcgcccccagccagggcagcgcccccgagggcggcaagcccatcaccatgaccctgggccaggccagcgccggcgccaaggagctgaccggcctgctgaccaccgccaagagcagcagcagcgagggcggcgtgagcgccagccccgtgcccagcgtggtgagcagcagcaccgcccccagcgccctgcacaccctgcagagcagactggtggccaccagccccggcagcagcctgcccggcgccaccagcgccagcagcctgctgcagggcctgagcttcagcctgcaggacatcagcagcaagaccagcggcctgcccgccaaccccagccccggccccgccccccaggccaccagcgtgaagctgcccacccccatgcagagcctgggcgccatcaccaccggcaccagcaccatcgtgagaaccatccccgtggccaccaccctgagcagcctgggcgccacccccggcggcaagcccaccgccatccaccagctgctgaccaacggcggcctggccaagctggccagcagcctgcccggcctggcccagatcagcaaccaggccagcggcctgaaggtgcccaccaccatcaccctgaccctgagaggccagcccagcagaatcaccaccctgagccccatgggcagcggcgccgcccccagcgaggagagcagcagccaggtgctgcccagcagcagccagagactgccccccgccccctag

SEQ ID NO: 21915 - DNA, 1059 bp, Artificial Sequence
  Description of Artificial Sequence: Synthetic coding sequence
atgcccctgtacgacaaccagaaggccagaagcgtgatgaacgagtgcgagagacacgtgatcttcgccagaaccgacgccgacgccccccccccccccgaggactgggaggagcacgtgaacagaaccggctggaccatggcccagaacaagctgttcaacaagatcctgaaggccctgcagagcgacagactggccagactggccaacgagggcgcctgcaacgagcccgtgctgagaagagtggccgtggacaagtgcgccagaagagtgagacaggccctggccagcgtgagctgggacaccaagctgatccagtggctgcacaccaccctggtggagaccctgagcctgcccatgctggccgcctacctggacgccctgcagaccctgaagggcaagatccccaccctgatcgacagaatgctggtgagcagcaacaccaagaccggcgccgccggcgccgaggccctgagcctgctgctgaagagaccctgggaccccgccgtgggcgtgctgagccacaacaagcccagcaagctgcccggcagccccctgatcctgatcgccagcagcggccccagcagcagcgtgttccccaccagcagaagacacagattctggcagagccagctgagctgcctgggcaaggtgatccccgtggccacccacctgctgaacaacggcagcggcgtgggcgtgctgcagtgcctggagcacatgatcggcgccgtgagaagcaaggtgctggagatccacagccacttcccccacaagcccatcatcctgatcggctggaacaccggcgccctggtggcctgccacgtgagcgtgatggagtacgtgaccgccgtggtgtgcctgggcttccccctgctgaccgtggacggccccagaggcgacgtggacgaccccctgctggacatgaagacccccgtgctgttcgtgatcggccagaacagcctgcagtgccaccccgaggccatggaggacttcagagagaagatcagagccgagaacagcctggtggtggtgggcggcgccgacgacaacctgtag

SEQ ID NO: 21916 - DNA, 1329 bp, Artificial Sequence
  Description of Artificial Sequence: Synthetic coding sequence
atgagcgccgcccagggctgggacagaaacagaagaagaggcggcggcgccgccggcgccggcggcggcggcagcggcgccggcggcggcagcggcggcagcggcggcagaggcaccggccagctgaacagattcgtgcagctgagcggcagaccccacctgcccggcaagaagaagatcagatgggaccccgtgagaagaagattcatccagagctgccccatcatcagaatccccaacagattcctgagaggccacagacccccccccgccagaagcggccacagatgcgtggccgacaacaccaacctgtacgtgttcggcggctacaaccccgactacgacgagagcggcggccccgacaacgaggactaccccctgttcagagagctgtggagataccacttcgccaccggcgtgtggcaccagatgggcaccgacggctacatgcccagagagctggccagcatgagcctggtgctgcacggcaacaacctgctggtgttcggcggcaccggcatccccttcggcgagagcaacggcaacgacgtgcacgtgtgcaacgtgaagtacaagagatgggccctgctgagctgcagaggcaagaagcccagcagaatctacggccaggccatggccatcatcaacggcagcctgtacgtgttcggcggcaccaccggctacatctacagcaccgacctgcacaagctggacctgaacaccagagagtggacccagctgaagcccaacaacctgagctgcgacctgcccgaggagagatacagacacgagatcgcccacgacggccagagaatctacatcctgggcggcggcaccagctggaccgcctacagcctgaacaagatccacgcctacaacctggagaccaacgcctgggaggagatcgccaccaagccccacgagaagatcggcttccccgccgccagaagatgccacagctgcgtgcagatcaagaacgacgtgttcatctgcggcggctacaacggcgaggtgatcctgggcgacatctggaagctgaacctgcagaccttccagtgggtgaagctgcccgccaccatgcccgagcccgtgtacttccactgcgccgccgtgacccccgccggctgcatgtacatccacggcggcgtggtgaacatccacgagaacaagagaaccggcagcctgttcaagatctggctggtggtgcccagcctgctggagctggcctgggagaagctgctggccgccttccccaacctggccaacctgagcagaacccagctgctgcacctgggcctgacccagggcctgatcgagagactgaagtag

SEQ ID NO: 21917 - DNA, 1563 bp, Artificial Sequence
  Description of Artificial Sequence: Synthetic coding sequence
atgggcaagaagggcaagaaggagaagaagggcagaggcgccgagaagaccgccgccaagatggagaagaaggtgagcaagagaagcagaaaggaggaggaggacctggaggccctgatcgcccacttccagaccctggacgccaagagaacccagaccgtggagctgccctgccccccccccagccccagactgaacgccagcctgagcgtgcaccccgagaaggacgagctgatcctgttcggcggcgagtacttcaacggccagaagaccttcctgtacaacgagctgtacgtgtacaacaccagaaaggacacctggaccaaggtggacatccccagccccccccccagaagatgcgcccaccaggccgtggtggtgccccagggcggcggccagctgtgggtgttcggcggcgagttcgccagccccaacggcgagcagttctaccactacaaggacctgtgggtgctgcacctggccaccaagacctgggagcaggtgaagagcaccggcggccccagcggcagaagcggccacagaatggtggcctggaagagacagctgatcctgttcggcggcttccacgagagcaccagagactacatctactacaacgacgtgtacgccttcaacctggacaccttcacctggagcaagctgagccccagcggcaccggccccacccccagaagcggctgccagatgagcgtgaccccccagggcggcatcgtggtgtacggcggctacagcaagcagagagtgaagaaggacgtggacaagggcaccagacacagcgacatgttcctgctgaagcccgaggacggcagagaggacaagtgggtgtggaccagaatgaaccccagcggcgtgaagcccacccccagaagcggcttcagcgtggccatggcccccaaccaccagaccctgttcttcggcggcgtgtgcgacgaggaggaggaggagagcctgagcggcgagttcttcaacgacctgtacttctacgacgccaccagaaacagatggttcgagggccagctgaagggccccaagagcgagaagaagaagagaagaagaggcagaaaggaggagcccgagggcggcagcagacccgcctgcggcggcgccggcacccagggccccgtgcagctggtgaaggaggtggtggccgaggacggcaccgtggtgaccatcaagcaggtgctgaccgcccccggcagcgccggccagcccagaagcgaggacgaggacagcctggaggaggccggcagccccgcccccggcccctgccccagaagcaacgccatgctggccgtgaagcacggcgtgctgtacgtgtacggcggcatgttcgaggccggcgacagacaggtgaccctgagcgacctgcactgcctggacctgcacagaatggaggcctggaaggccctggtggagatggaccccgagacccaggagtggctggaggagaccgacagcgaggaggacagcgaggaggtggagggcgccgagggcggcgtggacgacgaggacagcggcgaggagagcggcgccgaggactag

SEQ ID NO: 21918 - DNA, 777 bp, Artificial Sequence
  Description of Artificial Sequence: Synthetic coding sequence
atggtggcctggaagagacagctgatcctgttcggcggcttccacgagagcaccagagactacatctactacaacgacgtgtacgccttcaacctggacaccttcacctggagcaagctgagccccagcggcaccggccccacccccagaagcggctgccagatgagcgtgaccccccagggcggcatcgtggtgtacggcggctacagcaagcagagagtgaagaaggacgtggacaagggcaccagacacagcgacatgttcctgctgaagcccgaggacggcagagaggacaagtgggtgtggaccagaatgaaccccagcggcgtgaagcccacccccagaagcggcttcagcgtggccatggcccccaaccaccagaccctgttcttcggcggcgtgtgcgacgaggaggaggaggagagcctgagcggcgagttcttcaacgacctgtacttctacgacgccaccagaaacagatggttcgagggccagctgaagaagctgagaagcggctggagaagaagaaccagaaagagaaccgtgagaagactgagagcccccagagtgggcagcaccaccaagaccgccgagagaagagccgtgagaagaaccgagagcccctgccagggcagactggccagcgccgtgcccaccagcgcccaggaccccgccgtgctgagcgaggccctgggcgccagcgtgagacccgacgcccaggagagagccgagggcggctggcccagacccggctgcgagctgagccccatggtgtag

SEQ ID NO: 21919 - DNA, 1470 bp, Artificial Sequence
  Description of Artificial Sequence: Synthetic coding sequence
atgggcaagaagggcaagaaggagaagaagggcagaggcgccgagaagaccgccgccaagatggagaagaaggtgagcaagagaagcagaaaggaggaggaggacctggaggccctgatcgcccacttccagaccctggacgccaagagaacccagaccgtggagctgccctgccccccccccagccccagactgaacgccagcctgagcgtgcaccccgagaaggacgagctgatcctgttcggcggcgagtacttcaacggccagaagaccttcctgtacaacgagctgtacgtgtacaacaccagaaaggacacctggaccaaggtggacatccccagccccccccccagaagatgcgcccaccaggccgtggtggtgccccagggcggcggccagctgtgggtgttcggcggcgagttcgccagccccaacggcgagcagttctaccactacaaggacctgtgggtgctgcacctggccaccaagacctgggagcaggtgaaggactacatctactacaacgacgtgtacgccttcaacctggacaccttcacctggagcaagctgagccccagcggcaccggccccacccccagaagcggctgccagatgagcgtgaccccccagggcggcatcgtggtgtacggcggctacagcaagcagagagtgaagaaggacgtggacaagggcaccagacacagcgacatgttcctgctgaagcccgaggacggcagagaggacaagtgggtgtggaccagaatgaaccccagcggcgtgaagcccacccccagaagcggcttcagcgtggccatggcccccaaccaccagaccctgttcttcggcggcgtgtgcgacgaggaggaggaggagagcctgagcggcgagttcttcaacgacctgtacttctacgacgccaccagaaacagatggttcgagggccagctgaagggccccaagagcgagaagaagaagagaagaagaggcagaaaggaggagcccgagggcggcagcagacccgcctgcggcggcgccggcacccagggccccgtgcagctggtgaaggaggtggtggccgaggacggcaccgtggtgaccatcaagcaggtgctgaccgcccccggcagcgccggccagcccagaagcgaggacgaggacagcctggaggaggccggcagccccgcccccggcccctgccccagaagcaacgccatgctggccgtgaagcacggcgtgctgtacgtgtacggcggcatgttcgaggccggcgacagacaggtgaccctgagcgacctgcactgcctggacctgcacagaatggaggcctggaaggccctggtggagatggaccccgagacccaggagtggctggaggagaccgacagcgaggaggacagcgaggaggtggagggcgccgagggcggcgtggacgacgaggacagcggcgaggagagcggcgccgaggactag

SEQ ID NO: 21920 - DNA, 1392 bp, Artificial Sequence
  Description of Artificial Sequence: Synthetic coding sequence
atgggcaagaagggcaagaaggagaagaagggcagaggcgccgagaagaccgccgccaagatggagaagaaggtgagcaagagaagcagaaaggaggagaccttcctgtacaacgagctgtacgtgtacaacaccagaaaggacacctggaccaaggtggacatccccagccccccccccagaagatgcgcccaccaggccgtggtggtgccccagggcggcggccagctgtgggtgttcggcggcgagttcgccagccccaacggcgagcagttctaccactacaaggacctgtgggtgctgcacctggccaccaagacctgggagcaggtgaagagcaccggcggccccagcggcagaagcggccacagaatggtggcctggaagagacagctgatcctgttcggcggcttccacgagagcaccagagactacatctactacaacgacgtgtacgccttcaacctggacaccttcacctggagcaagctgagccccagcggcaccggccccacccccagaagcggctgccagatgagcgtgaccccccagggcggcatcgtggtgtacggcggctacagcaagcagagagtgaagaaggacgtggacaagggcaccagacacagcgacatgttcctgctgaagcccgaggacggcagagaggacaagtgggtgtggaccagaatgaaccccagcggcgtgaagcccacccccagaagcggcttcagcgtggccatggcccccaaccaccagaccctgttcttcggcggcgtgtgcgacgaggaggaggaggagagcctgagcggcgagttcttcaacgacctgtacttctacgacgccaccagaaacagatggttcgagggccagctgaagggccccaagagcgagaagaagaagagaagaagaggcagaaaggaggagcccgagggcggcagcagacccgcctgcggcggcgccggcacccagggccccgtgcagctggtgaaggaggtggtggccgaggacggcaccgtggtgaccatcaagcaggtgctgaccgcccccggcagcgccggccagcccagaagcgaggacgaggacagcctggaggaggccggcagccccgcccccggcccctgccccagaagcaacgccatgctggccgtgaagcacggcgtgctgtacgtgtacggcggcatgttcgaggccggcgacagacaggtgaccctgagcgacctgcactgcctggacctgcacagaatggaggcctggaaggccctggtggagatggaccccgagacccaggagtggctggaggagaccgacagcgaggaggacagcgaggaggtggagggcgccgagggcggcgtggacgacgaggacagcggcgaggagagcggcgccgaggactag

SEQ ID NO: 21921 - DNA, 1518 bp, Artificial Sequence
  Description of Artificial Sequence: Synthetic coding sequence
atgagcgccgaggagatggtgcagatcagactggaggacagatgctaccccgtgagcaagagaaagctgatcgagcagagcgactacttcagagccctgtacagaagcggcatgagagaggccctgagccaggaggccggcggccccgaggtgcagcagctgagaggcctgagcgcccccggcctgagactggtgctggacttcatcaacgccggcggcgccagagagggctggctgctgggccccagaggcgagaagggcggcggcgtggacgaggacgaggagatggacgaggtgagcctgctgagcgagctggtggaggccgccagcttcctgcaggtgaccagcctgctgcagctgctgctgagccaggtgagactgaacaactgcctggagatgtacagactggcccaggtgtacggcctgcccgacctgcaggaggcctgcctgagattcatggtggtgcacttccacgaggtgctgtgcaagccccagttccacctgctgggcagccccccccaggcccccggcgacgtgagcctgaagcagagactgagagaggccagaatgaccggcacccccgtgctggtggccctgggcgacttcctgggcggccccctggccccccacccctaccagggcgagccccccagcatgctgagatacgaggagatgaccgagagatggttccccctggccaacaacctgccccccgacctggtgaacgtgagaggctacggcagcgccatcctggacaactacctgttcatcgtgggcggctacagaatcaccagccaggagatcagcgccgcccacagctacaaccccagcaccaacgagtggctgcaggtggccagcatgaaccagaagagaagcaacttcaagctggtggccgtgaacagcaagctgtacgccatcggcggccaggccgtgagcaacgtggagtgctacaaccccgagcaggacgcctggaacttcgtggcccccctgcccaaccccctggccgagttcagcgcctgcgagtgcaagggcaagatctacgtgatcggcggctacaccaccagagacagaaacatgaacatcctgcagtactgccccagcagcgacatgtggaccctgttcgagacctgcgacgtgcacatcagaaagcagcagatggtgagcgtggaggagaccatctacatcgtgggcggctgcctgcacgagctgggccccaacagaagaagcagccagagcgaggacatgctgaccgtgcagagctacaacaccgtgaccagacagtggctgtacctgaaggagaacaccagcaagagcggcctgaacctgacctgcgccctgcacaacgacggcatctacatcatgagcagagacgtgaccctgagcaccagcctggagcacagagtgttcctgaagtacaacatcttcagcgacagctgggaggccttcagaagattccccgccttcggccacaacctgctggtgagcagcctgtacctgcccaacaaggccgagacctag

SEQ ID NO: 21922 - DNA, 1785 bp, Artificial Sequence
  Description of Artificial Sequence: Synthetic coding sequence
atggtgctgagaagccaccccttccccagacaggacagaccccagggcagcgtgcccagagccgtgcccggcagccccgtgggccccagcaccagcacccacagcgaggacagacacggccccagcagcagcgtgggcaccgtgatcggcaccggcaccggcggcctggtggaggccggcggccagccccagcccagaagcagcgagaccaacggcagccccagccccgaccccccccccggcctgagaggcgagggcaccagagagaagagcctggaccccctgccccaggccgccatgcccagaggccccgcccagccccccgcccagagaccccccggccccgccgccagcagcagcgccagaagaagccagcccgtgccccagctgagaaagagaagcagatgcgagatcgcccccagcagcgagcaggaggtgagacccgccgccagcggcgacccccagggcgaggcccccggcgagggcggcagccccgccggcagaagcggcgccctgaccgagaagcaggaggaggccagaaagctgatggtgttcctgcagagacccggcggctggggcgtggtggagggccccagaaagcccagcagcagagccctggagcccgccaccgccgccgccctgagaagaagactggacctgggcagctgcctggacgtgctggccttcgcccagcagcacggcgagcccggcctggcccaggagacctacgccctgatgagcgacaacctgctgagagtgctgggcgacccctgcctgtacagaagactgagcgccgccgacagagagagaatcctgagcctgagaaccggcagaggcagagccgtgctgggcgtgctggtgctgcccagcctgtaccagggcggcagaagcggcctgcccagaggccccagaggcgaggagccccccgccgccgcccccgtgagcctgcccctgcccgcccacctgcacgtgttcaaccccagagagaacacctggagacccctgacccaggtgcccgaggaggcccccctgagaggctgcggcctgtgcaccatgcacaactacctgttcctggccggcggcatcagaggcagcggcgccaaggccgtgtgcagcaacgaggtgttctgctacaaccccctgaccaacatctggagccaggtgagacccatgcagcaggccagagcccagctgaagctggtggccctggacggcctgctgtacgccatcggcggcgagtgcctgtacagcatggagtgctacgaccccagaaccgacgcctggacccccagagcccccctgcccgccggcaccttccccgtggcccacgaggccgtggcctgcagaggcgacatctacgtgaccggcggccacctgttctacagactgctgagatacagccccgtgaaggacgcctgggacgagtgcccctacagcgccagccacagaagaagcagcgacatcgtggccctgggcggcttcctgtacagattcgacctgctgagaggcgtgggcgccgccgtgatgagatacaacaccgtgaccggcagctggagcagagccgccagcctgcccctgcccgcccccgcccccctgcactgcaccaccctgggcaacaccatctactgcctgaacccccaggtgaccgccaccttcaccgtgagcggcggcaccgcccagttccaggccaaggagctgcagcccttccccctgggcagcaccggcgtgctgagccccttcatcctgaccctgccccccgaggacagactgcagaccagcctgtag

SEQ ID NO: 21923 - DNA, 1053 bp, Artificial Sequence
  Description of Artificial Sequence: Synthetic coding sequence
atggaggtgcccaacgtgaaggacttccagtggaagagactggcccccctgcccagcagaagagtgtactgcagcctgctggagaccggcggccaggtgtacgccatcggcggctgcgacgacaacggcgtgcccatggactgcttcgaggtgtacagccccgaggccgaccagtggaccgccctgcccagactgcccaccgccagagccggcgtggccgtgaccgccctgggcaagagaatcatggtgatcggcggcgtgggcaccaaccagctgcccctgaaggtggtggagatgtacaacatcgacgagggcaagtggaagaagagaagcatgctgagagaggccgccatgggcatcagcgtgaccgccaaggactacagagtgtacgccgccggcggcatgggcctggacctgagaccccacaaccacctgcagcactacgacatgctgaaggacatgtgggtgagcctggcccccatgcccacccccagatacgccgccaccagcttcctgagaggcagcaagatctacgtgctgggcggcagacagagcaagtacgccgtgaacgccttcgaggtgttcgacatcgagaccagaagctggaccaagttccccaacatcccctacaagagagccttcagcagcttcgtgaccctggacaaccacctgtacagcctgggcggcctgagacagggcagactgtacagacagcccaagttcctgagaaccatggacgtgttcgacatggagcagggcggctggctgaagatggagagaagcttcttcctgaagaagagaagagccgacttcgtggccggcagcctgagcggcagagtgatcgtggccggcggcctgggcaaccagcccaccgtgctggagaccgccgaggccttccaccccggcaagaacaagtgggagatcctgcccgccatgcccacccccagatgcgcctgcagcagcatcgtggtgaagaactgcctgctggccgtgggcggcgtgaaccagggcctgagcgacgccgtggaggccctgtgcgtgagcgacagctag

SEQ ID NO: 21924 - DNA, 1053 bp, Artificial Sequence; identical to SEQ ID NO: 21923
  Description of Artificial Sequence: Synthetic coding sequence

SEQ ID NO: 21925 - DNA, 714 bp, Artificial Sequence
  Description of Artificial Sequence: Synthetic coding sequence
atgatcgccggctgcagaagcttcagcctgcagagcgactacagagtgtacgccgccggcggcatgggcctggacctgagaccccacaaccacctgcagcactacgacatgctgaaggacatgtgggtgagcctggcccccatgcccacccccagatacgccgccaccagcttcctgagaggcagcaagatctacgtgctgggcggcagacagagcaagtacgccgtgaacgccttcgaggtgttcgacatcgagaccagaagctggaccaagttccccaacatcccctacaagagagccttcagcagcttcgtgaccctggacaaccacctgtacagcctgggcggcctgagacagggcagactgtacagacagcccaagttcctgagaaccatggacgtgttcgacatggagcagggcggctggctgaagatggagagaagcttcttcctgaagaagagaagagccgacttcgtggccggcagcctgagcggcagagtgatcgtggccggcggcctgggcaaccagcccaccgtgctggagaccgccgaggccttccaccccggcaagaacaagtgggagatcctgcccgccatgcccacccccagatgcgcctgcagcagcatcgtggtgaagaactgcctgctggccgtgggcggcgtgaaccagggcctgagcgacgccgtggaggccctgtgcgtgagcgacagctag

SEQ ID NO: 21926 - DNA, 1053 bp, Artificial Sequence; identical to SEQ ID NO: 21923
  Description of Artificial Sequence: Synthetic coding sequence

SEQ ID NO: 21927 - DNA, 1050 bp, Artificial Sequence
  Description of Artificial Sequence: Synthetic coding sequence
atggccgtggccgtgccccccggcagagccgccggcagcggctgggcctggagacccgtggccagagacgccctgctggccagagccttccacagctgcaccgagctgagaggcagattctacctggtgggcggcctgctggccggcggcgccagagagcccagcagcgacaccgtggtgttcgaccccgccagaggccaggccgtgagactgggcgccagaggcagcccccccagaagccaccacgacgccgcccccgtggacggcagatggctgtgcgtggtgggcggctgggacggcagcagaagactggccaccgtgaccgccctggacaccgagagaggcgtgtgggaggcctggaccggcacccccggcgactgcccccccgccggcctgagcagccacacctgcaccagaatcagcgacagagagctgcaggtggccggcagagagggcggcatccacacccagagaagatacggcagcatctacaccctgagactggaccccagcgccagaacctactgctacaagcaggagggctgccacaccgccagcagaagcggccactgcgccgccctgctgcagacccccggcccccaccccggccaccagctgctgctgttcggcggctgcaacctggccgagcccgaggtggccggccactggagccacggcaagatcaaggaggagccccccgtggccccccacctgatggagcagctggccagactggtgagcagcggccagggcagccagaagggcccccacggcctgagacaccacagctgcagcgtggtgggccccttcgccgtgctgttcggcggcgagaccctgaccagagccagagacaccatctgcaacgacctgtacatctacgacaccagaaccagcccccccctgtggttccacttcccctgcgccgacagaggcatgaagagaatgggccacagaacctgcctgtggaacgaccagctgtacctggtgggcggcttcggcgaggacggcagaaccgccagcccccaggtgtgcatcctggacttcatctag

SEQ ID NO: 21928 - DNA, 867 bp, Artificial Sequence
  Description of Artificial Sequence: Synthetic coding sequence
atggccgtggccgtgccccccggcagagccgccggcagcggctgggcctggagacccgtggccagagacgccctgctggccagagccttccacagctgcaccgagctgagaggcagattctacctggtgggcggcctgctggccggcggcgccagagagcccagcagcgacaccgtggtgttcgaccccgccagaggccaggccgtgagactgggcgccagaggcagcccccccagaagccaccacgacgccgcccccgtggacggcagatggctgtgcgtggtgggcggctgggacggcagcagaagactggccaccgtgaccgccctggacaccgagagaggcgtgtgggaggcctggaccggcacccccggcgactgcccccccgccggcctgagcagccacacctgcaccagaatcagcgacagagagctgcaggtggccggcagagagggcggcatccacacccagagaagatacggcagcatctacaccctgagactggaccccagcgccagaacctactgctacaagcaggagggctgccacaccgccagcagaagcggccactgcgccgccctgctgcagacccccggcccccaccccggccaccagctgctgctgttcggcggctgcaacctggccgagcccgaggtggccggccactggagccacggcaagatcaagagcttcctgagcccccagggcggcaccacctgctgcagcagcttcgacggcaccgcctgcaaggcctgcgagcagtgggccggcgtgcccgagggcgccccctggaccaccgccagcctgatgttctgcggcagagccctgtgctgcgccgtgtggtggagaaacagcgaccagagctag

SEQ ID NO: 21929 - DNA, 1872 bp, Artificial Sequence
  Description of Artificial Sequence: Synthetic coding sequence
atggagcacgccgtggccccctgcgtgctgtaccccggcaccgagcccggcgccgccggcgagagcgagagcgagggcgccgccagccccgcccagaccccctgcagcctgggcgccagcctgtgcttcagcagcggcgaggagagccccccccagagcctggccagcgccgccgagggcgccgccaccagcccccccagcagcggcggccccagagtggtggagagacagtgggaggccggcagcgccggcgccgccagccccgaggagctggccagccccgaggagagagcctgccccgaggagcccgccgcccccagccccgagcccagagtgtggctggaggaccccgccagccccgaggagcccggcgagcccgcccccgtgccccccggcttcggcgccgtgtacggcgagcccgacctggtgctggaggtgagcggcagaagactgagagcccacaaggccgtgctggccgccagaagcgactacttcagagccagagccagcagagacgtgctgagagtgcagggcgtgagcctgaccgccctgagactgctgctggccgacgcctacagcggcagaatggccggcgtgagacccgacaacgtggccgaggtggtggccggcgccagaagactgcagctgcccggcgccgcccagagagccaccgacgccgtgggcccccagctgagcctggccaactgctacgaggtgctgagcgccgccaagagacagagactgaacgagctgagagacgccgcctactgcttcatgagcgaccactacctggaggtgctgagagagcccgccgtgttcggcagactgagcggcgccgagagagacctgctgctgagaagaagactgagagccggcagagcccacctgctggccgccgccctgggccccgccggcgagagagccggcagcagaccccagagccccagcggcgacgccgacgccagaggcgacgccgccgtgtactgcttccacgccgccgccggcgagtggagagagctgaccagactgcccgagggcgcccccgccagaggctgcggcctgtgcgtgctgtacaactacctgttcgtggccggcggcgtggcccccgccggccccgacggcagagccagacccagcgaccaggtgttctgctacaaccccgccaccgacagctggagcgccgtgagacccctgagacaggccagaagccagctgagactgctggccctggacggccacctgtacgccgtgggcggcgagtgcctgctgagcgtggagagatacgaccccagagccgacagatgggcccccgtggcccccctgcccagaggcgccttcgccgtggcccacgaggccaccacctgccacggcgagatctacgtgagcggcggcagcctgttctacagactgctgaagtacgaccccagaagagacgagtggcaggagtgcccctgcagcagcagcagagagagaagcgccgacatggtggccctggacggcttcatctacagattcgacctgagcggcagcagaggcgaggcccaggccgccggccccagcggcgtgagcgtgagcagataccactgcctggccaagcagtggagcccctgcgtggcccccctgagactgcccggcggccccaccggcctgcagcccttcagatgcgccgccctggacggcgccatctactgcgtgagcagagccggcacctggagattccagcccgccagagagggcgaggccggcggcgacgccggccagggcggcggcttcgaggccctgggcgcccccctggacgtgagaggcgtgctgatccccttcgccctgagcctgcccgagaagccccccagaggcgagcagggcgccccctag

SEQ ID NO: 21930 - DNA, 1872 bp, Artificial Sequence
  Description of Artificial Sequence: Synthetic coding sequence
atggagtgcaagatcgagggcaaggagaagtaccagcacagcctgaacctgctgaacaagatccagaacatgaaggagctggccgagatgatcgacgtggtgctgaccgccgagggcgagaagttcccctgccacagactggtgctggccgccttcagcccctacttcaaggccatgttcacctgcggcctgctggagtgcaaccagagagaggtgatcctgtacgacatcaccgccgagagcgtgagcgtgctgctgaactacatgtacaacgccgccctggagatcaacaacgccaacgtgcagaccgtggccatggccgcctacttcatgcagatggaggaggtgttcagcgtgtgccagaagtacatgatggaccacatggacgccagcaactgcctgggcatctactacttcgccaagcagatcggcgccgaggacctgagcgacagaagcaagaagtacctgtaccagcacttcgccgaggtgagcctgcacgaggagatcctggagatcgaggtgcaccagttcctgaccctgatcaagagcgacgacctgaacatcagcagagaggagagcatcctggacctggtgctgagatgggtgaaccacaacaaggagctgagaaccgtgcacctggtggagctgctgaagcaggtgagactggagctggtgaaccccagcttcctgagacaggccctgagaagaaacaccatgctgctgtgcgacgccgactgcgtggacatcatccagaacgccttcaaggccatcaagaccccccagcagcacagcctgaacctgagatacggcatggagaccaccagcctgctgctgtgcatcggcaacaacagcagcggcatcagaagcagacacagaagctacggcgacgccagcttctgctacgaccccgtgagcagaaagacctacttcatcagcagccccaagtacggcgagggcctgggcaccgtgtgcaccggcgtggtgatggagaacaacaccatcatcgtggccggcgaggccagcgccagcaagctgagcagacagaagaacaagaacgtggagatctacagataccacgacagaggcaaccagttctgggagaagctgtgcaccgccgagttcagagagctgtacgccctgggcagcatccacaacgacctgtacgtgatcggcggccagatgaagatcaagaaccagtacctgatcaccaactgcgtggacaagtacagcgtggagagagacaactggaagagagtgagccccctgcccctgcagctggcctgccacgccgtggtgaccgtgaacaacaagctgtacgtgatcggcggctggaccccccagatggacctgcccgacgaggagcccgacagactgagcaacaagctgctgcagtacgaccccagccaggaccagtggagcgtgagagcccccatgaagtacagcaagtacagattcagcaccgccgtggtgaacagcgagatctacgtgctgggcggcatcggctgcgtgggccaggacaagggccaggtgagaaagtgcctggacgtggtggagatctacaaccccgacggcgacttctggagagagggcccccccatgcccagccccctgctgagcctgagaaccaacagcaccaacgccggcgccgtggacggcaagctgtacgtgtgcggcggcttccacggcgccgacagacacgaggtgatcagcaaggagatcctggagctggacccctgggagaaccagtggaacgtggtggccatcaacgtgctgatgcacgacagctacgacgtgtgcctggtggccagaatgaaccccagagacctgatccccccccccagcgacctggtggaggagggcaacgagcactag

SEQ ID NO: 21931 - DNA, 1872 bp, Artificial Sequence; identical to SEQ ID NO: 21930
  Description of Artificial Sequence: Synthetic coding sequence

SEQ ID NO: 21932 - DNA, 1872 bp, Artificial Sequence
  Description of Artificial Sequence: Synthetic coding sequence
atgagcacccaggacgagagacagatcaacaccgagtacgccgtgagcctgctggagcagctgaagctgttctacgagcagcagctgttcaccgacatcgtgctgatcgtggagggcaccgagttcccctgccacaagatggtgctggccacctgcagcagctacttcagagccatgttcatgagcggcctgagcgagagcaagcagacccacgtgcacctgagaaacgtggacgccgccaccctgcagatcatcatcacctacgcctacaccggcaacctggccatgaacgacagcaccgtggagcagctgtacgagaccgcctgcttcctgcaggtggaggacgtgctgcagagatgcagagagtacctgatcaagaagatcaacgccgagaactgcgtgagactgctgagcttcgccgacctgttcagctgcgaggagctgaagcagagcgccaagagaatggtggagcacaagttcaccgccgtgtaccaccaggacgccttcatgcagctgagccacgacctgctgatcgacatcctgagcagcgacaacctgaacgtggagaaggaggagaccgtgagagaggccgccatgctgtggctggagtacaacaccgagagcagaagccagtacctgagcagcgtgctgagccagatcagaatcgacgccctgagcgaggtgacccagagagcctggttccagggcctgccccccaacgacaagagcgtggtggtgcagggcctgtacaagagcatgcccaagttcttcaagcccagactgggcatgaccaaggaggagatgatgatcttcatcgaggccagcagcgagaacccctgcagcctgtacagcagcgtgtgctacagcccccaggccgagaaggtgtacaagctgtgcagcccccccgccgacctgcacaaggtgggcaccgtggtgacccccgacaacgacatctacatcgccggcggccaggtgcccctgaagaacaccaagaccaaccacagcaagaccagcaagctgcagaccgccttcagaaccgtgaactgcttctactggttcgacgcccagcagaacacctggttccccaagacccccatgctgttcgtgagaatcaagcccagcctggtgtgctgcgagggctacatctacgccatcggcggcgacagcgtgggcggcgagctgaacagaagaaccgtggagagatacgacaccgagaaggacgagtggaccatggtgagccccctgccctgcgcctggcagtggagcgccgccgtggtggtgcacgactgcatctacgtgatgaccctgaacctgatgtactgctacttccccagaagcgacagctgggtggagatggccatgagacagaccagcagaagcttcgccagcgccgccgccttcggcgacaagatcttctacatcggcggcctgcacatcgccaccaacagcggcatcagactgcccagcggcaccgtggacggcagcagcgtgaccgtggagatctacgacgtgaacaagaacgagtggaagatggccgccaacatccccgccaagagatacagcgacccctgcgtgagagccgtggtgatcagcaacagcctgtgcgtgttcatgagagagacccacctgaacgagagagccaagtacgtgacctaccagtacgacctggagctggacagatggagcctgagacagcacatcagcgagagagtgctgtgggacctgggcagagacttcagatgcaccgtgggcaagctgtaccccagctgcctggaggagagcccctggaagccccccacctacctgttcagcaccgacggcaccgaggagttcgagctggacggcgagatggtggccctgccccccgtgtag

SEQ ID NO: 21933 - DNA, 45 bp, Artificial Sequence
  Description of Artificial Sequence: Synthetic coding sequence
atgagcacccaggacgagagacagatcaacaccgagtacgcctag

SEQ ID NO: 21934 - DNA, 15 bp, Artificial Sequence
  Description of Artificial Sequence: Synthetic coding sequence
atgagcacccagtag

SEQ ID NO: 21935 - DNA, 147 bp, Artificial Sequence
  Description of Artificial Sequence: Synthetic coding sequence
atgagcacccaggacgagagacagatcaacaccgagtacgccgtgagcctgctggagcagctgaagctgttctacgagcagcagctgttcaccgacatcgtgctgatcgtggagggcaccgagttcccctgccacaagatggtgtag

SEQ ID NO: 21936 - DNA, 90 bp, Artificial Sequence
  Description of Artificial Sequence: Synthetic coding sequence
atgagcacccaggacgagagacagatcaacaccgagtacgccgtgagcctgctggagcagctgaagctgttctacgagcagcagctgtag

SEQ ID NO: 21937 - DNA, 1050 bp, Artificial Sequence
  Description of Artificial Sequence: Synthetic coding sequence
gtgagagaggccgccatgctgtggctggagtacaacaccgagagcagaagccagtacctgagcagcgtgctgagccagatcagaatcgacgccctgagcgaggtgacccagagagcctggttccagggcctgccccccaacgacaagagcgtggtggtgcagggcctgtacaagagcatgcccaagttcttcaagcccagactgggcatgaccaaggaggagatgatgatcttcatcgaggccagcagcgagaacccctgcagcctgtacagcagcgtgtgctacagcccccaggccgagaaggtgtacaagctgtgcagcccccccgccgacctgcacaaggtgggcaccgtggtgacccccgacaacgacatctacatcgccggcggccaggtgcccctgaagaacaccaagaccaaccacagcaagaccagcaagctgcagaccctgcagaactgcgagctgctgctgctggacgcccagcagaacaccagcaaggaccccaacgccttctgcccccacaaggccatcttctgctgcgagggctacatctacgccatcggcggcgacagcgtgggcggcgagctgaacagaagaaccgtggagagatacgacaccgagaaggacgagtggaccatggtgagccccctgccctgcgcctggcagtggagcgccgccgtggtggtgcacgactgcatctacgtgatgaccctgaacctgatgtactgctacttccccagaagcgacagctgggtggagatggccatgagacagaccagcagaagcttcgccagcgccgccgccttcggcgacaagatcttctacatcggcggcctgcacatcgccaccaacagcggcatcagactgcccagcggcaccgtggacggcagcagcgtgaccgtggagatctacgacgtgaacaagaacgagtggaagatggccgccaacatccccgccaagagatacagcgacccctgcgtgagagccgtggtgatcagcaacagcctgtgcgtgttcatgagagagacccacctgaacgagagagcctag

SEQ ID NO: 21938 - DNA, 1839 bp, Artificial Sequence
  Description of Artificial Sequence: Synthetic coding sequence
atggagctggccatggacaacagctacgccttcaaccagagaagcacctgcaacggcatccccagcgagaagaagaacaacttcctggtgagcgaggaccacggccagaagatcctgagcgtgctgcagaacttcagagagcagaacgtgttctacgacttcaagatcatcatgaaggacgagatcatcccctgccacagatgcgtgctggccgcctgcagcgacttcttcagagccatgttcgaggtgaacatgaaggagagagacgacggcagcgtgaccatcaccaacctgagcagcaaggccgtgaaggccttcctggactacgcctacaccggcaagaccaagatcaccgacgacaacgtggagatgttcttccagctgagcagcttcctgcaggtgagcttcctgagcaaggcctgcagcgacttcctgatcaagagcatcaacctggtgaactgcctgcagctgctgagcatcagcgacagctacggcagcaccagcctgttcgaccacgccctgcacttcgtgcagcaccacttcagcctgctgttcaagagcagcgacttcctggagatgaacttcggcgtgctgcagaagtgcctggagagcgacgagctgaacgtgcccgaggaggagatggtgctgaaggtggtgctgagctggaccaagcacaacctggagagcagacagaagtacctgccccacctgatcgagaaggtgagactgcaccagctgagcgaggagaccctgcaggactgcctgttcaacgaggagagcctgctgaagagcaccaactgcttcgacatcatcatggacgccatcaagtgcgtgcagggcagcggcggcctgttccccgacgccagacccagcaccaccgagaagtacatcttcatccacaagaccgaggagaacggcgagaaccagtacaccttctgctacaacatcaagagcgacagctggaagatcctgccccagagccacctgatcgacctgcccggcagcagcctgagcagctacggcgagaagatcttcctgaccggcggctgcaagggcaagtgctgcagaaccgtgagactgcacatcgccgagagctaccacgacgccaccgaccagacctggtgctactgccccgtgaagaacgacttcttcctggtgagcaccatgaagacccccagaaccatgcacaccagcgtgatggccctggacagactgttcgtgatcggcggcaagaccagaggcagcagagacatcaagagcctgctggacgtggagagctacaaccccctgagcaaggagtggatcagcgtgagccccctgcccagaggcatctactaccccgaggccagcacctgccagaacgtgatctacgtgctgggcagcgaggtggagatcaccgacgccttcaaccccagcctggactgcttcttcaagtacaacgccaccaccgaccagtggagcgagctggtggccgagttcggccagttcttccacgccaccctgatcaaggccgtgcccgtgaactgcaccctgtacatctgcgacctgagcacctacaaggtgtacagcttctgccccgacacctgcgtgtggaagggcgagggcagcttcgagtgcgccggcttcaacgccggcgccatcggcatcgaggacaagatctacatcctgggcggcgactacgcccccgacgagatcaccgacgaggtgcaggtgtaccacagcaacagaagcgagtgggaggaggtgagccccatgcccagagccctgaccgagttctactgccaggtgatccagttcaacaagtacagagacccctggttcagcaacctgtgcgcctag

SEQ ID NO: 21939 - DNA, 1839 bp, Artificial Sequence; identical to SEQ ID NO: 21938
  Description of Artificial Sequence: Synthetic coding sequence

SEQ ID NO: 21940 - DNA, 957 bp, Artificial Sequence
  Description of Artificial Sequence: Synthetic coding sequence
atgaagggcggcaacgccgacagctggcagagagagaagctggccagcatggagagccccgaggagcccggcgccagcatggacgagaactacttcgtgaactacaccttcaaggacagaagccacagcggcagagtggcccagggcatcatgaagctgtgcctggaggaggagctgttcgccgacgtgaccatcagcgtggagggcagagagttccagctgcacagactggtgctgagcgcccagagctgcttcttcagaagcatgttcaccagcaacctgaaggaggcccacaacagagtgatcgtgctgcaggacgtgagcgagagcgtgttccagctgctggtggactacatctaccacggcaccgtgaagctgagagccgaggagctgcaggagatctacgaggtgagcgacatgtaccagctgaccagcctgttcaacgccctgggcttctggcccgcccagtgcaagtgggagaccgccttcagagccgacagacacagcgacagcagcatcagactgcccagctgcgccaagacccacctggcccagctgcagaacaccgaggagttcctgcacctgccccacagactgctgaccgacatcatcagcgacggcgtgccctgcagccagaaccccaccgaggccatcgaggcctggatcaacttcaacaaggaggagagagaggccttcgccgagagcctgagaaccagcctgaaggagatcggcgagaacgtgcacatctacctgatcggcaaggagagcagcagaacccacagcctggccgtgagcctgcactgcgccgaggacgacagcatcagcgtgagcggccagaacagcctgtgccaccagatcaccgccgcctgcaagcacggcggcgacctgtacgtggtgggcggcagcatccccagaagaatgtggaagtgcaacaacgccaccgtggactgggagtag

SEQ ID NO: 21941 - DNA, 1557 bp, Artificial Sequence
  Description of Artificial Sequence: Synthetic coding sequence
atggagagccccgaggagcccggcgccagcatggacgagaactacttcgtgaactacaccttcaaggacagaagccacagcggcagagtggcccagggcatcatgaagctgtgcctggaggaggagctgttcgccgacgtgaccatcagcgtggagggcagagagttccagctgcacagactggtgctgagcgcccagagctgcttcttcagaagcatgttcaccagcaacctgaaggaggcccacaacagagtgatcgtgctgcaggacgtgagcgagagcgtgttccagctgctggtggactacatctaccacggcaccgtgaagctgagagccgaggagctgcaggagatctacgaggtgagcgacatgtaccagctgaccagcctgttcgaggagtgcagcagattcctggccagaaccgtgcaggtgggcaactgcctgcaggtgatgtggctggccgacagacacagcgaccccgagctgtacaccgccgccaagcactgcgccaagacccacctggcccagctgcagaacaccgaggagttcctgcacctgccccacagactgctgaccgacatcatcagcgacggcgtgccctgcagccagaaccccaccgaggccatcgaggcctggatcaacttcaacaaggaggagagagaggccttcgccgagagcctgagaaccagcctgaaggagatcggcgagaacgtgcacatctacctgatcggcaaggagagcagcagaacccacagcctggccgtgagcctgcactgcgccgaggacgacagcatcagcgtgagcggccagaacagcctgtgccaccagatcaccgccgcctgcaagcacggcggcgacctgtacgtggtgggcggcagcatccccagaagaatgtggaagtgcaacaacgccaccgtggactgggagtggtgcgcccccctgcccagagacagactgcagcacaccctggtgagcgtgcccggcaaggacgccatctacagcctgggcggcaagaccctgcaggacaccctgagcaacgccgtgatctactacagagtgggcgacaacgtgtggaccgagaccacccagctggaggtggccgtgagcggcgccgccggcgccaacctgaacggcatcatctacctgctgggcggcgaggagaacgacctggacttcttcaccaagcccagcagactgatccagtgcttcgacaccgagaccgacaagtgccacgtgaagccctacgtgctgcccttcgccggcagaatgcacgccgccgtgcacaaggacctggtgttcatcgtggccgagggcgacagcctggtgtgctacaaccccctgctggacagcttcaccagactgtgcctgcccgaggcctggagcagcgcccccagcctgtggaagatcgccagctgcaacggcagcatctacgtgttcagagacagatacaagaagggcgacgccaacacctacaagctggaccccgccaccagcgccgtgaccgtgaccagaggcatcaaggtgctgctgaccaacctgcagttcgtgctggcctag

SEQ ID NO: 21942 - DNA, 1605 bp, Artificial Sequence
  Description of Artificial Sequence: Synthetic coding sequence
atgaagggcggcaacgccgacagctggcagagagagaagctggccagcatggagagccccgaggagcccggcgccagcatggacgagaactacttcgtgaactacaccttcaaggacagaagccacagcggcagagtggcccagggcatcatgaagctgtgcctggaggaggagctgttcgccgacgtgaccatcagcgtggagggcagagagttccagctgcacagactggtgctgagcgcccagagctgcttcttcagaagcatgttcaccagcaacctgaaggaggcccacaacagagtgatcgtgctgcaggacgtgagcgagagcgtgttccagctgctggtggactacatctaccacggcaccgtgaagctgagagccgaggagctgcaggagatctacgaggtgagcgacatgtaccagctgaccagcctgttcgaggagtgcagcagattcctggccagaaccgtgcaggtgggcaactgcctgcaggtgatgtggctggccgacagacacagcgaccccgagctgtacaccgccgccaagcactgcgccaagacccacctggcccagctgcagaacaccgaggagttcctgcacctgccccacagactgctgaccgacatcatcagcgacggcgtgccctgcagccagaaccccaccgaggccatcgaggcctggatcaacttcaacaaggaggagagagaggccttcgccgagagcctgagaaccagcctgaaggagatcggcgagaacgtgcacatctacctgatcggcaaggagagcagcagaacccacagcctggccgtgagcctgcactgcgccgaggacgacagcatcagcgtgagcggccagaacagcctgtgccaccagatcaccgccgcctgcaagcacggcggcgacctgtacgtggtgggcggcagcatccccagaagaatgtggaagtgcaacaacgccaccgtggactgggagtggtgcgcccccctgcccagagacagactgcagcacaccctggtgagcgtgcccggcaaggacgccatctacagcctgggcggcaagaccctgcaggacaccctgagcaacgccgtgatctactacagagtgggcgacaacgtgtggaccgagaccacccagctggaggtggccgtgagcggcgccgccggcgccaacctgaacggcatcatctacctgctgggcggcgaggagaacgacctggacttcttcaccaagcccagcagactgatccagtgcttcgacaccgagaccgacaagtgccacgtgaagccctacgtgctgcccttcgccggcagaatgcacgccgccgtgcacaaggacctggtgttcatcgtggccgagggcgacagcctggtgtgctacaaccccctgctggacagcttcaccagactgtgcctgcccgaggcctggagcagcgcccccagcctgtggaagatcgccagctgcaacggcagcatctacgtgttcagagacagatacaagaagggcgacgccaacacctacaagctggaccccgccaccagcgccgtgaccgtgaccagaggcatcaaggtgctgctgaccaacctgcagttcgtgctggcctag

SEQ ID NO: 21943 - DNA, 1866 bp, Artificial Sequence
  Description of Artificial Sequence: Synthetic coding sequence
atggccctgggcctggagcaggccgaggagcagagactgtaccagcagaccctgctgcaggacggcctgaaggacatgctggaccacggcaagttcctggactgcgtggtgagagccggcgagagagagttcccctgccacagactggtgctggccgcctgcagcccctacttcagagccagattcctggccgagcccgagagagccggcgagctgcacctggaggaggtgagccccgacgtggtggcccaggtgctgcactacctgtacaccagcgagatcgccctggacgaggccagcgtgcaggacctgttcgccgccgcccacagattccagatccccagcatcttcaccatctgcgtgagcttcctgcagaagagactgtgcctgagcaactgcctggccgtgttcagactgggcctgctgctggactgcgccagactggccgtggccgccagagacttcatctgcgcccacttcaccctggtggccagagacgccgacttcctgggcctgagcgccgacgagctgatcgccatcatcagcagcgacggcctgaacgtggagaaggaggaggccgtgttcgaggccgtgatgagatgggccggcagcggcgacgccgaggcccaggccgagagacagagagccctgcccaccgtgttcgagagcgtgagatgcagactgctgcccagagccttcctggagagcagagtggagagacaccccctggtgagagcccagcccgagctgctgagaaaggtgcagatggtgaaggacgcccacgagggcagaatcaccaccctgagaaagaagaagaagggcaaggacggcgccggcgccaaggaggccgacaagggcaccagcaaggccaaggccgaggaggacgaggaggccgagagaatcctgcccggcatcctgaacgacaccctgagattcggcatgttcctgcaggacctgatcttcatgatcagcgaggagggcgccgtggcctacgaccccgccgccaacgagtgctactgcgccagcctgagcaaccaggtgcccaagaaccacgtgagcctggtgaccaaggagaaccaggtgttcgtggccggcggcctgttctacaacgaggacaacaaggaggaccccatgagcgcctacttcctgcagttcgaccacctggacagcgagtggctgggcatgccccccctgcccagccccagatgcctgttcggcctgggcgaggccctgaacagcatctacgtggtgggcggcagagagatcaaggacggcgagagatgcctggacagcgtgatgtgctacgacagactgagcttcaagtggggcgagagcgaccccctgccctacgtggtgtacggccacaccgtgctgagccacatggacctggtgtacgtgatcggcggcaagggcagcgacagaaagtgcctgaacaagatgtgcgtgtacgaccccaagaagttcgagtggaaggagctggcccccatgcagaccgccagaagcctgttcggcgccaccgtgcacgacggcagaatcatcgtggccgccggcgtgaccgacaccggcctgaccagcagcgccgaggtgtacagcatcaccgacaacaagtgggcccccttcgaggccttcccccaggagagaagcagcctgagcctggtgagcctggtgggcaccctgtacgccatcggcggcttcgccaccctggagaccgagagcggcgagctggtgcccaccgagctgaacgacatctggagatacaacgaggaggagaagaagtgggagggcgtgctgagagagatcgcctacgccgccggcgccaccttcctgcccgtgagactgaacgtgctgtgcctgaccaagatgtag

SEQ ID NO: 21944 - DNA, 1101 bp, Artificial Sequence
  Description of Artificial Sequence: Synthetic coding sequence
atggtgaaggacgcccacgagggcagaatcaccaccctgagaaagaagaagaagggcaaggacggcgccggcgccaaggaggccgacaagggcaccagcaaggccaaggccgaggaggacgaggaggccgagagaatcctgcccggcatcctgaacgacaccctgagattcggcatgttcctgcaggacctgatcttcatgatcagcgaggagggcgccgtggcctacgaccccgccgccaacgagtgctactgcgccagcctgagcaaccaggtgcccaagaaccacgtgagcctggtgaccaaggagaaccaggtgttcgtggccggcggcctgttctacaacgaggacaacaaggaggaccccatgagcgcctacttcctgcagttcgaccacctggacagcgagtggctgggcatgccccccctgcccagccccagatgcctgttcggcctgggcgaggccctgaacagcatctacgtggtgggcggcagagagatcaaggacggcgagagatgcctggacagcgtgatgtgctacgacagactgagcttcaagtggggcgagagcgaccccctgccctacgtggtgtacggccacaccgtgctgagccacatggacctggtgtacgtgatcggcggcaagggcagcgacagaaagtgcctgaacaagatgtgcgtgtacgaccccaagaagttcgagtggaaggagctggcccccatgcagaccgccagaagcctgttcggcgccaccgtgcacgacggcagaatcatcgtggccgccggcgtgaccgacaccggcctgaccagcagcgccgaggtgtacagcatcaccgacaacaagtgggcccccttcgaggccttcccccaggagagaagcagcctgagcctggtgagcctggtgggcaccctgtacgccatcggcggcttcgccaccctggagaccgagagcggcgagctggtgcccaccgagctgaacgacatctggagatacaacgaggaggagaagaagtgggagggcgtgctgagagagatcgcctacgccgccggcgccaccttcctgcccgtgagactgaacgtgctgtgcctgaccaagatgtag

SEQ ID NO: 21945 - DNA, 2025 bp, Artificial Sequence
  Description of Artificial Sequence: Synthetic coding sequence
atgcagagcagagaggacgcccccagaagcagaagactggccagccccagaggcggcaagagacccaagaagatccacaagcccaccgtgagcgccttcttcaccggccccgaggagctgaaggacaccgcccacagcgccgccctgctggcccagctgaagagcttctacgacgccagactgctgtgcgacgtgaccatcgaggtggtgacccccggcagcggccccggcaccggcagactgttcccctgcaacagaaacgtgctggccgccgcctgcccctacttcaagagcatgttcaccggcggcatgtacgagagccagcaggccagcgtgaccatgcacgacgtggacgccgagagcttcgaggtgctggtggactactgctacaccggcagagtgagcctgagcgaggccaacgtggagagactgtacgccgccagcgacatgctgcagctggagtacgtgagagaggcctgcgccagcttcctggccagaagactggacctgaccaactgcaccgccatcctgaagttcgccgacgccttcggccacagaaagctgagaagccaggcccagagctacatcgcccagaacttcaagcagctgagccacatgggcagcatcagagaggagaccctggccgacctgaccctggcccagctgctggccgtgctgagactggacagcctggacgtggagagcgagcagaccgtgtgccacgtggccgtgcagtggctggaggccgcccccaaggagagaggccccagcgccgccgaggtgttcaagtgcgtgagatggatgcacttcaccgaggaggaccaggactacctggagggcctgctgaccaagcccatcgtgaagaagtactgcctggacgtgatcgagggcgccctgcagatgagatacggcgacctgctgtacaagagcctggtgcccgtgcccaacagcagcagcagcagcagcagcagcaacagcctggtgagcgccgccgagaaccccccccagagactgggcatgtgcgccaaggagatggtgatcttcttcggccaccccagagaccccttcctgtgctgcgacccctacagcggcgacctgtacaaggtgcccagccccctgacctgcctggcccacaccagaaccgtgaccaccctggccgtgtgcatcagccccgaccacgacatctacctggccgcccagcccagaaccgacctgtgggtgtacaagcccgcccagaacagctggcagcagctggccgacagactgctgtgcagagagggcatggacgtggcctacctgaacggctacatctacatcctgggcggcagagaccccatcaccggcgtgaagctgaaggaggtggagtgctacaacgtgaagagaaaccagtgggccctggtggcccccctgccccacagcttcctgagcttcgacctgatggtgatcagagactacctgtacgccctgaacagcaagagaatgttctgctacgaccccagccacaacatgtggctgaagtgcgtgagcctgaagagaaacgacttccaggaggcctgcgtgttcaacgaggagatctactgcatctgcgacatccccgtgatgaaggtgtacaaccccgtgagagccgagtggagacagatgaacaacatccccctggtgagcgagaccaacaactacagaatcatcaagcacggccagaagctgctgctgatcaccagcagaaccccccagtggaagaagaacagagtgaccgtgtacgagtacgacatcagaggcgaccagtggatcaacatcggcaccaccctgggcctgctgcagttcgacagcaacttcttctgcctgagcgccagagtgtaccccagctgcctggagcccggccagagcttcctgaccgaggaggaggagatccccagcgagagcagcaccgagtgggacctgggcggcttcagcgagcccgacagcgagagcggcagcagcagcagcctgagcgacgacgacttctgggtgagagtggccccccagtag

SEQ ID NO: 21946 - DNA, 1827 bp, Artificial Sequence
  Description of Artificial Sequence: Synthetic coding sequence
atgcagagcagagaggacgcccccagaagcagaagactggccagccccagaggcggcaagagacccaagaagatccacaagcccaccgtgagcgccttcttcaccggccccgaggagctgaaggacaccgccagcgtgaccatgcacgacgtggacgccgagagcttcgaggtgctggtggactactgctacaccggcagagtgagcctgagcgaggccaacgtggagagactgtacgccgccagcgacatgctgcagctggagtacgtgagagaggcctgcgccagcttcctggccagaagactggacctgaccaactgcaccgccatcctgaagttcgccgacgccttcggccacagaaagctgagaagccaggcccagagctacatcgcccagaacttcaagcagctgagccacatgggcagcatcagagaggagaccctggccgacctgaccctggcccagctgctggccgtgctgagactggacagcctggacgtggagagcgagcagaccgtgtgccacgtggccgtgcagtggctggaggccgcccccaaggagagaggccccagcgccgccgaggtgttcaagtgcgtgagatggatgcacttcaccgaggaggaccaggactacctggagggcctgctgaccaagcccatcgtgaagaagtactgcctggacgtgatcgagggcgccctgcagatgagatacggcgacctgctgtacaagagcctggtgcccgtgcccaacagcagcagcagcagcagcagcagcaacagcctggtgagcgccgccgagaaccccccccagagactgggcatgtgcgccaaggagatggtgatcttcttcggccaccccagagaccccttcctgtgctgcgacccctacagcggcgacctgtacaaggtgcccagccccctgacctgcctggcccacaccagaaccgtgaccaccctggccgtgtgcatcagccccgaccacgacatctacctggccgcccagcccagaaccgacctgtgggtgtacaagcccgcccagaacagctggcagcagctggccgacagactgctgtgcagagagggcatggacgtggcctacctgaacggctacatctacatcctgggcggcagagaccccatcaccggcgtgaagctgaaggaggtggagtgctacaacgtgaagagaaaccagtgggccctggtggcccccctgccccacagcttcctgagcttcgacctgatggtgatcagagactacctgtacgccctgaacagcaagagaatgttctgctacgaccccagccacaacatgtggctgaagtgcgtgagcctgaagagaaacgacttccaggaggcctgcgtgttcaacgaggagatctactgcatctgcgacatccccgtgatgaaggtgtacaaccccgtgagagccgagtggagacagatgaacaacatccccctggtgagcgagaccaacaactacagaatcatcaagcacggccagaagctgctgctgatcaccagcagaaccccccagtggaagaagaacagagtgaccgtgtacgagtacgacatcagaggcgaccagtggatcaacatcggcaccaccctgggcctgctgcagttcgacagcaacttcttctgcctgagcgccagagtgtaccccagctgcctggagcccggccagagcttcctgaccgaggaggaggagatccccagcgagagcagcaccgagtgggacctgggcggcttcagcgagcccgacagcgagagcggcagcagcagcagcctgagcgacgacgacttctgggtgagagtggccccccagtag

SEQ ID NO: 21947 - DNA, 2055 bp, Artificial Sequence
  Description of Artificial Sequence: Synthetic coding sequence
atgcagagcagagaggacgtgcccagaagcagaagactggccagccccagaggcggcagaagacccaagagaatcagcaagcccagcgtgagcgccttcttcaccggccccgaggagctgaaggacaccgcccacagcgccgccctgctggcccagctgaagagcttctacgacgccagactgctgtgcgacgtgaccatcgaggtggtgacccccggcagcggccccggcaccggcagactgttcagctgcaacagaaacgtgctggccgccgcctgcccctacttcaagagcatgttcaccggcggcatgtacgagagccagcaggccagcgtgaccatgcacgacgtggacgccgagagcttcgaggtgctggtggactactgctacaccggcagagtgagcctgagcgaggccaacgtgcagagactgtacgccgccagcgacatgctgcagctggagtacgtgagagaggcctgcgccagcttcctggccagaagactggacctgaccaactgcaccgccatcctgaagttcgccgacgccttcgaccaccacaagctgagaagccaggcccagagctacatcgcccacaacttcaagcagctgagcagaatgggcagcatcagagaggagaccctggccgacctgaccctggcccagctgctggccgtgctgagactggacagcctggacatcgagagcgagagaaccgtgtgccacgtggccgtgcagtggctggaggccgccgccaaggagagaggccccagcgccgccgaggtgttcaagtgcgtgagatggatgcacttcaccgaggaggaccaggactacctggagggcctgctgaccaagcccatcgtgaagaagtactgcctggacgtgatcgagggcgccctgcagatgagatacggcgacctgctgtacaagagcctggtgcccgtgcccaacagcagcagcagcagcagcagcagcaacagcctggtgagcgccgccgagaaccccccccagagactgggcatgtgcgccaaggagatggtgatcttcttcggccaccccagagaccccttcctgtgctacgacccctacagcggcgacatctacaccatgcccagccccctgaccagcttcgcccacaccaagaccgtgaccagcagcgccgtgtgcgtgagccccgaccacgacatctacctggccgcccagcccagaaaggacctgtgggtgtacaagcccgcccagaacagctggcagcagctggccgacagactgctgtgcagagagggcatggacgtggcctacctgaacggctacatctacatcctgggcggcagagaccccatcaccggcgtgaagctgaaggaggtggagtgctacagcgtgcagagaaaccagtgggccctggtggcccccgtgccccacagcttctacagcttcgagctgatcgtggtgcagaactacctgtacgccgtgaacagcaagagaatgctgtgctacgaccccagccacaacatgtggctgaactgcgccagcctgaagagaagcgacttccaggaggcctgcgtgttcaacgacgagatctactgcatctgcgacatccccgtgatgaaggtgtacaaccccgccagaggcgagtggagaagaatcagcaacatccccctggacagcgagacccacaactaccagatcgtgaaccacgaccagaagctgctgctgatcaccagcaccaccccccagtggaagaagaacagagtgaccgtgtacgagtacgacaccagagaggaccagtggatcaacatcggcaccatgctgggcctgctgcagttcgacagcggcttcatctgcctgtgcgccagagtgtaccccagctgcctggagcccggccagagcttcatcaccgaggaggacgacgccagaagcgagagcagcaccgagtgggacctggacggcttcagcgagctggacagcgagagcggcagcagcagcagcttcagcgacgacgaggtgtgggtgcaggtggccccccagagaaacgcccaggaccagcagggcagcctgtag

SEQ ID NO: 21948 - DNA, 1761 bp, Artificial Sequence
  Description of Artificial Sequence: Synthetic coding sequence
atgttcaccggcggcatgtacgagagccagcaggccagcgtgaccatgcacgacgtggacgccgagagcttcgaggtgctggtggactactgctacaccggcagagtgagcctgagcgaggccaacgtgcagagactgtacgccgccagcgacatgctgcagctggagtacgtgagagaggcctgcgccagcttcctggccagaagactggacctgaccaactgcaccgccatcctgaagttcgccgacgccttcgaccaccacaagctgagaagccaggcccagagctacatcgcccacaacttcaagcagctgagcagaatgggcagcatcagagaggagaccctggccgacctgaccctggcccagctgctggccgtgctgagactggacagcctggacatcgagagcgagagaaccgtgtgccacgtggccgtgcagtggctggaggccgccgccaaggagagaggccccagcgccgccgaggtgttcaagtgcgtgagatggatgcacttcaccgaggaggaccaggactacctggagggcctgctgaccaagcccatcgtgaagaagtactgcctggacgtgatcgagggcgccctgcagatgagatacggcgacctgctgtacaagagcctggtgcccgtgcccaacagcagcagcagcagcagcagcagcaacagcctggtgagcgccgccgagaaccccccccagagactgggcatgtgcgccaaggagatggtgatcttcttcggccaccccagagaccccttcctgtgctacgacccctacagcggcgacatctacaccatgcccagccccctgaccagcttcgcccacaccaagaccgtgaccagcagcgccgtgtgcgtgagccccgaccacgacatctacctggccgcccagcccagaaaggacctgtgggtgtacaagcccgcccagaacagctggcagcagctggccgacagactgctgtgcagagagggcatggacgtggcctacctgaacggctacatctacatcctgggcggcagagaccccatcaccggcgtgaagctgaaggaggtggagtgctacagcgtgcagagaaaccagtgggccctggtggcccccgtgccccacagcttctacagcttcgagctgatcgtggtgcagaactacctgtacgccgtgaacagcaagagaatgctgtgctacgaccccagccacaacatgtggctgaactgcgccagcctgaagagaagcgacttccaggaggcctgcgtgttcaacgacgagatctactgcatctgcgacatccccgtgatgaaggtgtacaaccccgccagaggcgagtggagaagaatcagcaacatccccctggacagcgagacccacaactaccagatcgtgaaccacgaccagaagctgctgctgatcaccagcaccaccccccagtggaagaagaacagagtgaccgtgtacgagtacgacaccagagaggaccagtggatcaacatcggcaccatgctgggcctgctgcagttcgacagcggcttcatctgcctgtgcgccagagtgtaccccagctgcctggagcccggccagagcttcatcaccgaggaggacgacgccagaagcgagagcagcaccgagtgggacctggacggcttcagcgagctggacagcgagagcggcagcagcagcagcttcagcgacgacgaggtgtgggtgcaggtggccccccagagaaacgcccaggaccagcagggcagcctgtag

SEQ ID NO: 21949 - DNA, 1728 bp, Artificial Sequence
  Description of Artificial Sequence: Synthetic coding sequence
atggaccccttccacgcctgcagcatcctgaagcagctgaagaccatgtacgacgagggccagctgaccgacatcgtggtggaggtggaccacggcaagaccttcagctgccacagaaacgtgctggccgccatcagcccctacttcagaagcatgttcaccagcggcctgaccgagagcacccagaaggaggtgagaatcgtgggcgtggaggccgagagcatggacctggtgctgaactacgcctacaccagcagagtgatcctgaccgaggccaacgtgcaggccctgttcaccgccgccagcatcttccagatccccagcatccaggaccagtgcgccaagtacatgatcagccacctggacccccagaacagcatcggcgtgttcatcttcgccgaccactacggccaccaggagctgggcgacagaagcaaggagtacatcagaaagaagttcctgtgcgtgaccaaggagcaggagttcctgcagctgaccaaggaccagctgatcagcatcctggacagcgacgacctgaacgtggacagagaggagcacgtgtacgagagcatcatcagatggttcgagcacgagcagaacgagagagaggtgcacctgcccgagatcttcgccaagtgcatcagattccccctgatggaggacaccttcatcgagaagatccccccccagttcgcccaggccatcgccaagagctgcgtggagaagggccccagcaacaccaacggctgcacccagagactgggcatgaccgccagcgagatgatcatctgcttcgacgccgcccacaagcacagcggcaagaagcagaccgtgccctgcctggacatcgtgaccggcagagtgttcaagctgtgcaagccccccaacgacctgagagaggtgggcatcctggtgagccccgacaacgacatctacatcgccggcggctacagacccagcagcagcgaggtgagcatcgaccacaaggccgagaacgacttctggatgtacgaccacagcaccaacagatggctgagcaagcccagcctgctgagagccagaatcggctgcaagctggtgtactgctgcggcaagatgtacgccatcggcggcagagtgtacgagggcgacggcagaaacagcctgaagagcgtggagtgctacgacagcagagagaactgctggaccaccgtgtgcgccatgcccgtggccatggagttccacaacgccgtggagtacaaggagaagatctacgtgctgcagggcgagttcttcctgttctacgagccccagaaggactactggggcttcctgacccccatgaccgtgcccagaatccagggcctggccgccgtgtacaaggacagcatctactacatcgccggcacctgcggcaaccaccagagaatgttcaccgtggaggcctacgacatcgagctgaacaagtggaccagaaagaaggacttcccctgcgaccagagcatcaacccctacctgaagctggtgctgttccagaacaagctgcacctgttcgtgagagccacccaggtgaccgtggaggagcacgtgttcagaaccagcagaaagaacagcctgtaccagtacgacgacatcgccgaccagtggatgaaggtgtacgagacccccgacagactgtgggacctgggcagacacttcgagtgcgccgtggccaagctgtacccccagtgcctgcagaaggtgctgtag

SEQ ID NO: 21950 - DNA, 1806 bp, Artificial Sequence
  Description of Artificial Sequence: Synthetic coding sequence
atggccgccagcgccgacctgagcaagagcagccccacccccaacggcatccccagcagcgaccccgccagcgacgccatggaccccttccacgcctgcagcatcctgaagcagctgaagaccatgtacgacgagggccagctgaccgacatcgtggtggaggtggaccacggcaagaccttcagctgccacagaaacgtgctggccgccatcagcccctacttcagaagcatgttcaccagcggcctgaccgagagcacccagaaggaggtgagaatcgtgggcgtggaggccgagagcatggacctggtgctgaactacgcctacaccagcagagtgatcctgaccgaggccaacgtgcaggccctgttcaccgccgccagcatcttccagatccccagcatccaggaccagtgcgccaagtacatgatcagccacctggacccccagaacagcatcggcgtgttcatcttcgccgaccactacggccaccaggagctgggcgacagaagcaaggagtacatcagaaagaagttcctgtgcgtgaccaaggagcaggagttcctgcagctgaccaaggaccagctgatcagcatcctggacagcgacgacctgaacgtggacagagaggagcacgtgtacgagagcatcatcagatggttcgagcacgagcagaacgagagagaggtgcacctgcccgagatcttcgccaagtgcatcagattccccctgatggaggacaccttcatcgagaagatccccccccagttcgcccaggccatcgccaagagctgcgtggagaagggccccagcaacaccaacggctgcacccagagactgggcatgaccgccagcgagatgatcatctgcttcgacgccgcccacaagcacagcggcaagaagcagaccgtgccctgcctggacatcgtgaccggcagagtgttcaagctgtgcaagccccccaacgacctgagagaggtgggcatcctggtgagccccgacaacgacatctacatcgccggcggctacagacccagcagcagcgaggtgagcatcgaccacaaggccgagaacgacttctggatgtacgaccacagcaccaacagatggctgagcaagcccagcctgctgagagccagaatcggctgcaagctggtgtactgctgcggcaagatgtacgccatcggcggcagagtgtacgagggcgacggcagaaacagcctgaagagcgtggagtgctacgacagcagagagaactgctggaccaccgtgtgcgccatgcccgtggccatggagttccacaacgccgtggagtacaaggagaagatctacgtgctgcagggcgagttcttcctgttctacgagccccagaaggactactggggcttcctgacccccatgaccgtgcccagaatccagggcctggccgccgtgtacaaggacagcatctactacatcgccggcacctgcggcaaccaccagagaatgttcaccgtggaggcctacgacatcgagctgaacaagtggaccagaaagaaggacttcccctgcgaccagagcatcaacccctacctgaagctggtgctgttccagaacaagctgcacctgttcgtgagagccacccaggtgaccgtggaggagcacgtgttcagaaccagcagaaagaacagcctgtaccagtacgacgacatcgccgaccagtggatgaaggtgtacgagacccccgacagactgtgggacctgggcagacacttcgagtgcgccgtggccaagctgtacccccagtgcctgcagaaggtgctgtag

SEQ ID NO: 21951 - DNA, 948 bp, Artificial Sequence
  Description of Artificial Sequence: Synthetic coding sequence
atggacgtgaacaagttcgaggccagcgtgggcttcctggacgtgaagaagttcctgagcacctggaagctgcagaaccccagaacccacttcgtgctgagcccccactgcttcatgggcggcatcatggcccccaaggacatcatgaccaacacccacgccaagagcatcctgaacagcatgaacagcctgagaaagagcaacaccctgtgcgacgtgaccctgagagtggagcagaaggacttccccgcccacagaatcgtgctggccgcctgcagcgactacttctgcgccatgttcaccagcgagctgagcgagaagggcaagccctacgtggacatccagggcctgaccgccagcaccatggagatcctgctggacttcgtgtacaccgagaccgtgcacgtgaccgtggagaacgtgcaggagctgctgcccgccgcctgcctgctgcagctgaagggcgtgaagcaggcctgctgcgagttcctggagagccagctggaccccagcaactgcctgggcatcagagacttcgccgagacccacaactgcgtggacctgatgcaggccgccgaggtgttcagccagaagcacttccccgaggtggtgcagcacgaggagttcatcctgctgagccagggcgaggtggagaagctgatcaagtgcgacgagatccaggtggacagcgaggagcccgtgttcgaggccgtgatcaactgggtgaagcacgccaagaaggagagagaggagagcctgcccaacctgctgcagtacgtgagaatgcccctgctgacccccagatacatcaccgacgtgatcgacgccgagcccttcatcagatgcagcctgcagtgcagagacctggtggacgaggccaagaagttccacctgagacccgagctgagaagccagatgcagggccccagaaccagagccagactgtag

SEQ ID NO: 21952 - DNA, 615 bp, Artificial Sequence
  Description of Artificial Sequence: Synthetic coding sequence
atgcagggccccagaaccagagccagactgggcgccaacgaggtgctgctggtggtgggcggcttcggcagccagcagagccccatcgacgtggtggagaagtacgaccccaagacccaggagtggagcttcctgcccagcatcaccagaaagagaagatacgtggccagcgtgagcctgcacgacagaatctacgtgatcggcggctacgacggcagaagcagactgagcagcgtggagtgcctggactacaccgccgacgaggacggcgtgtggtacagcgtggcccccatgaacgtgagaagaggcctggccggcgccaccaccctgggcgacatgatctacgtgagcggcggcttcgacggcagcagaagacacaccagcatggagagatacgaccccaacatcgaccagtggagcatgctgggcgacatgcagaccgccagagagggcgccggcctggtggtggccagcggcgtgatctactgcctgggcggctacgacggcctgaacatcctgaacagcgtggagaagtacgacccccacaccggccactggaccaacgtgacccccatggccaccaagagaagcgacatgatggtgatcccctgctag

SEQ ID NO: 21953 - DNA, 1707 bp, Artificial Sequence
  Description of Artificial Sequence: Synthetic coding sequence
atgggcggcatcatggcccccaaggacatcatgaccaacacccacgccaagagcatcctgaacagcatgaacagcctgagaaagagcaacaccctgtgcgacgtgaccctgagagtggagcagaaggacttccccgcccacagaatcgtgctggccgcctgcagcgactacttctgcgccatgttcaccagcgagctgagcgagaagggcaagccctacgtggacatccagggcctgaccgccagcaccatggagatcctgctggacttcgtgtacaccgagaccgtgcacgtgaccgtggagaacgtgcaggagctgctgcccgccgcctgcctgctgcagctgaagggcgtgaagcaggcctgctgcgagttcctggagagccagctggaccccagcaactgcctgggcatcagagacttcgccgagacccacaactgcgtggacctgatgcaggccgccgaggtgttcagccagaagcacttccccgaggtggtgcagcacgaggagttcatcctgctgagccagggcgaggtggagaagctgatcaagtgcgacgagatccaggtggacagcgaggagcccgtgttcgaggccgtgatcaactgggtgaagcacgccaagaaggagagagaggagagcctgcccaacctgctgcagtacgtgagaatgcccctgctgacccccagatacatcaccgacgtgatcgacgccgagcccttcatcagatgcagcctgcagtgcagagacctggtggacgaggccaagaagttccacctgagacccgagctgagaagccagatgcagggccccagaaccagagccagactgggcgccaacgaggtgctgctggtggtgggcggcttcggcagccagcagagccccatcgacgtggtggagaagtacgaccccaagacccaggagtggagcttcctgcccagcatcaccagaaagagaagatacgtggccagcgtgagcctgcacgacagaatctacgtgatcggcggctacgacggcagaagcagactgagcagcgtggagtgcctggactacaccgccgacgaggacggcgtgtggtacagcgtggcccccatgaacgtgagaagaggcctggccggcgccaccaccctgggcgacatgatctacgtgagcggcggcttcgacggcagcagaagacacaccagcatggagagatacgaccccaacatcgaccagtggagcatgctgggcgacatgcagaccgccagagagggcgccggcctggtggtggccagcggcgtgatctactgcctgggcggctacgacggcctgaacatcctgaacagcgtggagaagtacgacccccacaccggccactggaccaacgtgacccccatggccaccaagagaagcggcgccggcgtggccctgctgaacgaccacatctacgtggtgggcggcttcgacggcaccgcccacctgagcagcgtggaggcctacaacatcagaaccgacagctggaccaccgtgaccagcatgaccacccccagatgctacgtgggcgccaccgtgctgagaggcagactgtacgccatcgccggctacgacggcaacagcctgctgagcagcatcgagtgctacgaccccatcatcgacagctgggaggtggtgaccagcatgggcacccagagatgcgacgccggcgtgtgcgtgctgagagagaagtag

SEQ ID NO: 21954 - DNA, 1821 bp, Artificial Sequence
  Description of Artificial Sequence: Synthetic coding sequence
atggacgtgaacaagttcgaggccagcgtgggcttcctggacgtgaagaagttcctgagcacctggaagctgcagaaccccagaacccacttcgtgctgagcccccactgcttcatgggcggcatcatggcccccaaggacatcatgaccaacacccacgccaagagcatcctgaacagcatgaacagcctgagaaagagcaacaccctgtgcgacgtgaccctgagagtggagcagaaggacttccccgcccacagaatcgtgctggccgcctgcagcgactacttctgcgccatgttcaccagcgagctgagcgagaagggcaagccctacgtggacatccagggcctgaccgccagcaccatggagatcctgctggacttcgtgtacaccgagaccgtgcacgtgaccgtggagaacgtgcaggagctgctgcccgccgcctgcctgctgcagctgaagggcgtgaagcaggcctgctgcgagttcctggagagccagctggaccccagcaactgcctgggcatcagagacttcgccgagacccacaactgcgtggacctgatgcaggccgccgaggtgttcagccagaagcacttccccgaggtggtgcagcacgaggagttcatcctgctgagccagggcgaggtggagaagctgatcaagtgcgacgagatccaggtggacagcgaggagcccgtgttcgaggccgtgatcaactgggtgaagcacgccaagaaggagagagaggagagcctgcccaacctgctgcagtacgtgagaatgcccctgctgacccccagatacatcaccgacgtgatcgacgccgagcccttcatcagatgcagcctgcagtgcagagacctggtggacgaggccaagaagttccacctgagacccgagctgagaagccagatgcagggccccagaaccagagccagactgggcgccaacgaggtgctgctggtggtgggcggcttcggcagccagcagagccccatcgacgtggtggagaagtacgaccccaagacccaggagtggagcttcctgcccagcatcaccagaaagagaagatacgtggccagcgtgagcctgcacgacagaatctacgtgatcggcggctacgacggcagaagcagactgagcagcgtggagtgcctggactacaccgccgacgaggacggcgtgtggtacagcgtggcccccatgaacgtgagaagaggcctggccggcgccaccaccctgggcgacatgatctacgtgagcggcggcttcgacggcagcagaagacacaccagcatggagagatacgaccccaacatcgaccagtggagcatgctgggcgacatgcagaccgccagagagggcgccggcctggtggtggccagcggcgtgatctactgcctgggcggctacgacggcctgaacatcctgaacagcgtggagaagtacgacccccacaccggccactggaccaacgtgacccccatggccaccaagagaagcggcgccggcgtggccctgctgaacgaccacatctacgtggtgggcggcttcgacggcaccgcccacctgagcagcgtggaggcctacaacatcagaaccgacagctggaccaccgtgaccagcatgaccacccccagatgctacgtgggcgccaccgtgctgagaggcagactgtacgccatcgccggctacgacggcaacagcctgctgagcagcatcgagtgctacgaccccatcatcgacagctgggaggtggtgaccagcatgggcacccagagatgcgacgccggcgtgtgcgtgctgagagagaagtag

SEQ ID NO: 21955 - DNA, 1815 bp, Artificial Sequence
  Description of Artificial Sequence: Synthetic coding sequence
atggccggcgacgtggagggcttctgcagcagcatccacgacaccagcgtgagcgccggcttcagagccctgtacgaggagggcctgctgctggacgtgaccctggtgatcgaggaccaccagttccaggcccacaaggccctgctggccacccagagcgactacttcagaatcatgttcaccgccgacatgagagagagagaccaggacaagatccacctgaagggcctgaccgccaccggcttcagccacgtgctgcagttcatgtactacggcaccatcgagctgagcatgaacaccgtgcacgagatcctgcaggccgccatgtacgtgcagctgatcgaggtggtgaagttctgctgcagcttcctgctggccaagatctgcctggagaactgcgccgagatcatgagactgctggacgacttcggcgtgaacatcgagggcgtgagagagaagctggacaccttcctgctggacaacttcgtgcccctgatgagcagacccgacttcctgagctacctgagcttcgagaagctgatgagctacctggacaacgaccacctgagcagattccccgagatcgagctgtacgaggccgtgcagagctggctgagacacgacagaagaagatggagacacaccgacaccatcatccagaacatcagattctgcctgatgacccccaccagcgtgttcgagaaggtgaagaccagcgagttctacagatacagcagacagctgagatacgaggtggaccaggccctgaactacttccagaacgtgcaccagcagcccctgctggacatgaagagcagcagaatcagaagcgccaagccccagaccaccgtgttcagaggcatgatcggccacagcatggtgaacagcaagatcctgctgctgaagaagcccagagtgtggtgggagctggagggcccccaggtgcccctgagacccgactgcctggccatcgtgaacaacttcgtgttcctgctgggcggcgaggagctgggccccgacggcgagttccacgccagcagcaaggtgttcagatacgaccccagacagaacagctggctgcagatggccgacatgagcgtgcccagaagcgagttcgccgtgggcgtgatcggcaagttcatctacgccgtggccggcagaaccagagacgagaccttctacagcaccgagagatacgacatcaccaacgacaagtgggagttcgtggacccctaccccgtgaacaagtacggccacgagggcaccgtgctgaacaacaagctgttcatcaccggcggcatcaccagcagcagcaccagcaagcaggtgtgcgtgttcgaccccagcaaggagggcaccatcgagcagagaaccagaagaacccaggtggtgaccaactgctgggagaacaagagcaagatgaactacgccagatgcttccacaagatgatcagctacaacggcaagctgtacgtgttcggcggcgtgtgcgtgatcctgagagccagcttcgagagccagggctgccccagcaccgaggtgtacaaccccgagaccgaccagtggaccatcctggccagcatgcccatcggcagaagcggccacggcgtgaccgtgctggacaagcagatcatggtgctgggcggcctgtgctacaacggccactacagcgacagcatcctgaccttcgaccccgacgagaacaagtggaaggaggacgagtaccccagaatgccctgcaagctggacggcctgcaggtgtgcaacctgcacttccccgactacgtgctggacgaggtgagaagatgcaactag

SEQ ID NO: 21956 - DNA, 1437 bp, Artificial Sequence
  Description of Artificial Sequence: Synthetic coding sequence
atggacaccagcgacctgttcgccagctgcagaaagggcgacgtgggcagagtgagatacctgctggagcagagagacgtggaggtgaacgtgagagacaagtgggacagcacccccctgtactacgcctgcctgtgcggccacgaggagctggtgctgtacctgctggccaacggcgccagatgcgaggccaacaccttcgacggcgagagatgcctgtacggcgccctgagcgaccccatcagaagagccctgagagactacaagcaggtgaccgccagctgcagaagaagagactactacgacgacttcctgcagagactgctggagcagggcatccacagcgacgtggtgttcgtggtgcacggcaagcccttcagagtgcacagatgcgtgctgggcgccagaagcgcctacttcgccaacatgctggacaccaagtggaagggcaagagcgtggtggtgctgagacaccccctgatcaaccccgtggccttcggcgccctgctgcagtacctgtacaccggcagactggacatcggcgtggagcacgtgagcgactgcgagagactggccaagcagtgccagctgtgggacctgctgagcgacctggaggccaagtgcgagaaggtgagcgagttcgtggccagcaagcccggcacctgcgtgaaggtgctgaccatcgagcccccccccgccgaccccagactgagagaggacatggccctgctggccgactgcgccctgccccccgagctgagaggcgacctgtgggagctgcccttcccctgccccgacggcttcaacagctgccccgacatctgcttcagagtggccggctgcagcttcctgtgccacaaggccttcttctgcggcagaagcgactacttcagagccctgctggacgaccacttcagagagagcgaggagcccgccaccagcggcggcccccccgccgtgaccctgcacggcatcagccccgacgtgttcacccacgtgctgtactacatgtacagcgaccacaccgagctgagccccgaggccgcctacgacgtgctgagcgtggccgacatgtacctgctgcccggcctgaagagactgtgcggcagaagcctggcccagatgctggacgaggacaccgtggtgggcgtgtggagagtggccaagctgttcagactggccagactggaggaccagtgcaccgagtacatggccaaggtgatcgagaagctggtggagagagaggacttcgtggaggccgtgaaggaggaggccgccgccgtggccgccagacaggagaccgacagcatccccctggtggacgacatcagattccacgtggccagcaccgtgcagacctacagcgccatcgaggaggcccagcagagactgagagccctggaggacctgctggtgagcatcggcctggactgctag

SEQ ID NO: 21957 - DNA, 1389 bp, Artificial Sequence
  Description of Artificial Sequence: Synthetic coding sequence
atgggcgccagcttcctgcagctgcagagcatcaaggacgcctgctgcaccttcctgagagagagactgcaccccaagaactgcctgggcgtgagacagttcgccgagaccatgatgtgcgccgtgctgtacgacgccgccaacagcttcatccaccagcacttcgtggaggtgagcatgagcgaggagttcctggccctgcccctggaggacgtgctggagctggtgagcagagacgagctgaacgtgaagagcgaggagcaggtgttcgaggccgccctggcctgggtgagatacgacagagagcagagaggcccctacctgcccgagctgctgagcaacatcagactgcccctgtgcagaccccagttcctgagcgacagagtgcagcaggacgacctggtgagatgctgccacaagtgcagagacctggtggacgaggccaaggactaccacctgatgcccgagagaagaccccacctgcccgccttcagaaccagacccagatgctgcaccagcatcgccggcctgatctacgccgtgggcggcctgaacagcgccggcgacagcctgaacgtggtggaggtgttcgaccccatcgccaactgctgggagagatgcagacccatgaccaccgccagaagcagagtgggcgtggccgtggtgaacggcctgctgtacgccatcggcggctacgacggccagctgagactgagcaccgtggaggcctacaaccccgagaccgacacctggaccagagtgggcagcatgaacagcaagagaagcgccatgggcaccgtggtgctggacggccagatctacgtgtgcggcggctacgacggcaacagcagcctgagcagcgtggagacctacagccccgagaccgacaagtggaccgtggtgaccagcatgagcagcaacagaagcgccgccggcgtgaccgtgttcgagggcagaatctacgtgagcggcggccacgacggcctgcagatcttcagcagcgtggagcactacaaccaccacaccgccacctggcaccccgccgccggcatgctgaacaagagatgcagacacggcgccgccagcctgggcagcaagatgttcgtgtgcggcggctacgacggcagcggcttcctgagcatcgccgagatgtacagcagcgtggccgaccagtggtgcctgatcgtgcccatgcacaccagaagaagcagagtgagcctggtggccagctgcggcagactgtacgccgtgggcggctacgacggccagagcaacctgagcagcgtggagatgtacgaccccgagaccgactgctggaccttcatggcccccatggcctgccacgagggcggcgtgggcgtgggctgcatccccctgctgaccatctag

SEQ ID NO: 21958 - DNA, 1905 bp, Artificial Sequence
  Description of Artificial Sequence: Synthetic coding sequence
atggccgaggagcaggagttcacccagctgtgcaagctgcccgcccagcccagccacccccactgcgtgaacaacacctacagaagcgcccagcacagccaggccctgctgagaggcctgctggccctgagagacagcggcatcctgttcgacgtggtgctggtggtggagggcagacacatcgaggcccacagaatcctgctggccgccagctgcgactacttcagaggcatgttcgccggcggcctgaaggagatggagcaggaggaggtgctgatccacggcgtgagctacaacgccatgtgccagatcctgcacttcatctacaccagcgagctggagctgagcctgagcaacgtgcaggagaccctggtggccgcctgccagctgcagatccccgagatcatccacttctgctgcgacttcctgatgagctgggtggacgaggagaacatcctggacgtgtacagactggccgagctgttcgacctgagcagactgaccgagcagctggacacctacatcctgaagaacttcgtggccttcagcagaaccgacaagtacagacagctgcccctggagaaggtgtacagcctgctgagcagcaacagactggaggtgagctgcgagaccgaggtgtacgagggcgccctgctgtaccactacagcctggagcaggtgcaggccgaccagatcagcctgcacgagccccccaagctgctggagaccgtgagattccccctgatggaggccgaggtgctgcagagactgcacgacaagctggaccccagccccctgagagacaccgtggccagcgccctgatgtaccacagaaacgagagcctgcagcccagcctgcagagcccccagaccgagctgagaagcgacttccagtgcgtggtgggcttcggcggcatccacagcacccccagcaccgtgctgagcgaccaggccaagtacctgaaccccctgctgggcgagtggaagcacttcaccgccagcctggcccccagaatgagcaaccagggcatcgccgtgctgaacaacttcgtgtacctgatcggcggcgacaacaacgtgcagggcttcagagccgagagcagatgctggagatacgaccccagacacaacagatggttccagatccagagcctgcagcaggagcacgccgacctgagcgtgtgcgtggtgggcagatacatctacgccgtggccggcagagactaccacaacgacctgaacgccgtggagagatacgaccccgccaccaacagctgggcctacgtggcccccctgaagagagaggtgtacgcccacgccggcgccaccctggagggcaagatgtacatcacctgcggcagaagaggcgaggactacctgaaggagacccactgctacgaccccggcagcaacacctggcacaccctggccgacggccccgtgagaagagcctggcacggcatggccaccctgctgaacaagctgtacgtgatcggcggcagcaacaacgacgccggctacagaagagacgtgcaccaggtggcctgctacagctgcaccagcggccagtggagcagcgtgtgccccctgcccgccggccacggcgagcccggcatcgccgtgctggacaacagaatctacgtgctgggcggcagaagccacaacagaggcagcagaaccggctacgtgcacatctacgacgtggagaaggactgctgggaggagggcccccagctggacaacagcatcagcggcctggccgcctgcgtgctgaccctgcccagaagcctgctgctggagccccccagaggcacccccgacagaagccaggccgaccccgacttcgccagcgaggtgatgagcgtgagcgactgggaggagttcgacaacagcagcgaggactag

SEQ ID NO: 21959 - DNA, 1476 bp, Artificial Sequence
  Description of Artificial Sequence: Synthetic coding sequence
atgagctgggtggacgaggagaacatcctggacgtgtacagactggccgagctgttcgacctgagcagactgaccgagcagctggacacctacatcctgaagaacttcgtggccttcagcagaaccgacaagtacagacagctgcccctggagaaggtgtacagcctgctgagcagcaacagactggaggtgagctgcgagaccgaggtgtacgagggcgccctgctgtaccactacagcctggagcaggtgcaggccgaccagatcagcctgcacgagccccccaagctgctggagaccgtgagattccccctgatggaggccgaggtgctgcagagactgcacgacaagctggaccccagccccctgagagacaccgtggccagcgccctgatgtaccacagaaacgagagcctgcagcccagcctgcagagcccccagaccgagctgagaagcgacttccagtgcgtggtgggcttcggcggcatccacagcacccccagcaccgtgctgagcgaccaggccaagtacctgaaccccctgctgggcgagtggaagcacttcaccgccagcctggcccccagaatgagcaaccagggcatcgccgtgctgaacaacttcgtgtacctgatcggcggcgacaacaacgtgcagggcttcagagccgagagcagatgctggagatacgaccccagacacaacagatggttccagatccagagcctgcagcaggagcacgccgacctgagcgtgtgcgtggtgggcagatacatctacgccgtggccggcagagactaccacaacgacctgaacgccgtggagagatacgaccccgccaccaacagctgggcctacgtggcccccctgaagagagaggtgtacgcccacgccggcgccaccctggagggcaagatgtacatcacctgcggcagaagaggcgaggactacctgaaggagacccactgctacgaccccggcagcaacacctggcacaccctggccgacggccccgtgagaagagcctggcacggcatggccaccctgctgaacaagctgtacgtgatcggcggcagcaacaacgacgccggctacagaagagacgtgcaccaggtggcctgctacagctgcaccagcggccagtggagcagcgtgtgccccctgcccgccggccacggcgagcccggcatcgccgtgctggacaacagaatctacgtgctgggcggcagaagccacaacagaggcagcagaaccggctacgtgcacatctacgacgtggagaaggactgctgggaggagggcccccagctggacaacagcatcagcggcctggccgcctgcgtgctgaccctgcccagaagcctgctgctggagccccccagaggcacccccgacagaagccaggccgaccccgacttcgccagcgaggtgatgagcgtgagcgactgggaggagttcgacaacagcagcgaggactag

SEQ ID NO: 21960 - DNA, 708 bp, Artificial Sequence
  Description of Artificial Sequence: Synthetic coding sequence
atggccgaggagcaggagttcacccagctgtgcaagctgcccgcccagcccagccacccccactgcgtgaacaacacctacagaagcgcccagcacagccaggccctgctgagaggcctgctggccctgagagacagcggcatcctgttcgacgtggtgctggtggtggagggcagacacatcgaggcccacagaatcctgctggccgccagctgcgactacttcagaggcatgttcgccggcggcctgaaggagatggagcaggaggaggtgctgatccacggcgtgagctacaacgccatgtgccagatcctgcacttcatctacaccagcgagctggagctgagcctgagcaacgtgcaggagaccctggtggccgcctgccagctgcagatccccgagatcatccacttctgctgcgacttcctgatgagctgggtggacgaggagaacatcctggacgtgtacagactggccgagctgttcgacctgagcagactgaccgagcagctggacacctacatcctgaagaacttcgtggccttcagcagaaccgacaagtacagacagctgcccctggagaaggtgtacagcctgctgagcagcaacagactggaggtgagctgcgagaccgaggtgtacgagggcgccctgctgtaccactacagcctggagcaggtgcaggccgaccagatcagcctgcactag

SEQ ID NO: 21961 - DNA, 1677 bp, Artificial Sequence
  Description of Artificial Sequence: Synthetic coding sequence
atggccctgaagggccaggaggactacatctacctgttcaaggacagcacccaccccgtggacttcctggacgccttcagaaccttctacctggacggcctgttcaccgacatcaccctgcagtgccccagcggcatcatcttccactgccacagagccgtgctggccgcctgcagcaactacttcaaggccatgttcaccgccgacatgaaggagaagttcaagaacaagatcaagctgagcggcatccaccacgacatcctggagggcctggtgaactacgcctacaccagccagatcgagatcaccaagagaaacgtgcagagcctgctggaggccgccgacctgctgcagttcctgagcgtgaagaaggcctgcgagagattcctggtgagacacctggacatcgacaactgcatcggcatgcacagcttcgccgagttccacgtgtgccccgagctggagaaggagagcagaagaatcctgtgcagcaagttcaaggaggtgtggcagcaggaggagttcctggagatcagcctggagaagttcctgttcatcctgagcagaaagaacctgagcgtgtggaaggaggaggccatcatcgagcccgtgatcaagtggaccgcccacgacgtggagaacagaatcgagtgcctgtacaacctgctgagctacatcaacatcgacatcgaccccgtgtacctgaagaccgccctgggcctgcagagaagctgcctgctgaccgagaacaagatcagaagcctgatctacaacgccctgaaccccatgcacaaggagatcagccagagaagcaccgccaccatgtacatcatcggcggctactactggcaccccctgagcgaggtgcacatctgggaccccctgaccaacgtgtggatccagggcgccgagatccccgactacaccagagagagctacggcgtgacctgcctgggccccaacatctacgtgaccggcggctacagaaccgacaacatcgaggccctggacaccgtgtggatctacaacagcgagagcgacgagtggaccgagggcctgcccatgctgaacgccagatactaccactgcgccgtgaccctgggcggctgcgtgtacgccctgggcggctacagaaagggcgcccccgccgaggaggccgagttctacgaccccctgaaggagaagtggatccccatcgccaacatgatcaagggcgtgggcaacgccaccgcctgcgtgctgcacgacgtgatctacgtgatcggcggccactgcggctacagaggcagctgcacctacgacaaggtgcagagctacaacagcgacatcaacgagtggagcctgatcaccagcagcccccaccccgagtacggcctgtgcagcgtgcccttcgagaacaagctgtacctggtgggcggccagaccaccatcaccgagtgctacgaccccgagcagaacgagtggagagagatcgcccccatgatggagagaagaatggagtgcggcgccgtgatcatgaacggctgcatctacgtgaccggcggctacagctacagcaagggcacctacctgcagagcatcgagaagtacgaccccgacctgaacaagtgggagatcgtgggcaacctgcccagcgccatgagaagccacggctgcgtgtgcgtgtacaacgtgtag

SEQ ID NO: 21962 - DNA, 1677 bp, Artificial Sequence; identical to SEQ ID NO: 21961
  Description of Artificial Sequence: Synthetic coding sequence

SEQ ID NO: 21963 - DNA, 1848 bp, Artificial Sequence
  Description of Artificial Sequence: Synthetic coding sequence
atggccgagagcggcggcagcagcggcggcgccggcggcggcggcgccttcggcgccggccccggccccgagagacccaacagcaccgccgacaagaacggcgccctgaagtgcaccttcagcgcccccagccacagcaccagcctgctgcagggcctggccaccctgagagcccagggccagctgctggacgtggtgctgaccatcaacagagaggccttccccgcccacaaggtggtgctggccgcctgcagcgactacttcagagccatgttcaccggcggcatgagagaggccagccaggacgtgatcgagctgaagggcgtgagcgccagaggcctgagacacatcatcgacttcgcctacagcgccgaggtgaccctggacctggactgcgtgcaggacgtgctgggcgccgccgtgttcctgcagatgctgcccgtggtggagctgtgcgaggagttcctgaaggccgccatgagcgtggagacctgcctgaacatcggccagatggccaccaccttcagcctggccagcctgagagagagcgtggacgccttcaccttcagacacttcctgcagatcgccgaggaggaggacttcctgagactgcccctggagagactggtgttcttcctgcagagcaacagactgcagagctgcgccgagatcgacctgttcagagccgccgtgagatggctgcagcacgaccccgccagaagacccagagccagccacgtgctgtgccacatcagattccccctgatgcagagcagcgagctggtggacagcgtgcagaccctggacatcatggtggaggacgtgctgtgcagacagtacctgctggaggccttcaactaccaggtgctgcccttcagacagcacgagatgcagagccccagaaccgccgtgagaagcgacgtgcccagcctggtgaccttcggcggcaccccctacaccgacagcgacagaagcgtgagcagcaaggtgtaccagctgcccgagcccggcgccagacacttcagagagctgaccgagatggaggtgggctgcagccacacctgcgtggccgtgctggacaacttcgtgtacgtggccggcggccagcacctgcagtacagaagcggcgagggcgccgtggacgcctgctacagatacgacccccacctgaacagatggctgagactgcaggccatgcaggagagcagaatccagttccagctgaacgtgctgtgcggcatggtgtacgccaccggcggcagaaacagagccggcagcctggccagcgtggagagatactgccccagaagaaacgagtggggctacgcctgcagcctgaagagaagaacctggggccacgccggcgccgccagcggcggcagactgtacatcagcggcggctacggcatcagcgtggaggacaagaaggccctgcactgctacgaccccgtggccgaccagtgggagttcaaggcccccatgagcgagcccagagtgctgcacgccatggtgggcgccggcggcagaatctacgccctgggcggcagaatggaccacgtggacagatgcttcgacgtgctggccgtggagtactacgtgcccgagaccgaccagtggaccagcgtgagccccatgagagccggccagagcgaggccggctgctgcctgctggagagaaagatctacatcgtgggcggctacaactggagactgaacaacgtgaccggcatcgtgcaggtgtacaacaccgacaccgacgagtgggagagagacctgcacttccccgagagcttcgccggcatcgcctgcgcccccgtgctgctgcccagagccggcaccagaagatag

SEQ ID NO: 21964 - DNA, 438 bp, Artificial Sequence
  Description of Artificial Sequence: Synthetic coding sequence
atggccgagagcggcggcagcagcggcggcgccggcggcggcggcgccttcggcgccggccccggccccgagagacccaacagcaccgccgacaagaacggcgccctgaagtgcaccttcagcgcccccagccacagcaccagcctgctgcagggcctggccaccctgagagcccagggccagctgctggacgtggtgctgaccatcaacagagaggccttccccgcccacaaggtggtgctggccgcctgcagcgactacttcagagccatgttcaccggcggcatgagagaggccagccaggacgtgatcgagctgaagggcgtgagcgccagaggcctgagacacatcatcgacttcgcctacagcgccgaggtgaccctggacctggactgcgtgcaggaggtggcccccaagacccccggcaccctggcctag

SEQ ID NO: 21965 - DNA, 1716 bp, Artificial Sequence
  Description of Artificial Sequence: Synthetic coding sequence
atggaccacaccagccccacctacatgctggccaacctgacccacctgcacagcgagcagctgctgcagggcctgaacctgctgagacagcaccacgagctgtgcgacatcatcctgagagtgggcgacgtgaagatccacgcccacaaggtggtgctggccagcgtgagcccctacttcaaggccatgttcaccggcaacctgagcgagaaggagaacagcgaggtggagttccagtgcatcgacgagaccgccctgcaggccatcgtggagtacgcctacaccggcaccgtgttcatcagccaggacaccgtggagagcctgctgcccgccgccaacctgctgcagatcaagctggtgctgaaggagtgctgcgccttcctggagagccagctggaccccggcaactgcatcggcatcagcagattcgccgagacctacggctgcagagacctgtacctggccgccaccaagtacatctgccagaacttcgaggccgtgtgccagaccgaggagttcttcgagctgacccacgccgacctggacgagatcgtgagcaacgactgcctgaacgtggccaccgaggagaccgtgttctacgccctggagagctggatcaagtacgacgtgcaggagagacagaagtacctggcccagctgctgaacagcgtgagactgcccctgctgagcgtgaagttcctgaccagactgtacgaggccaaccacctgatcagagacgacagaacctgcaagcacctgctgaacgaggccctgaagtaccacttcatgcccgagcacagactgagccaccagaccgtgctgatgaccagacccagatgcgcccccaaggtgctgtgcgccgtgggcggcaagagcggcctgttcgcctgcctggacagcgtggagatgtacttcccccagaacgacagctggatcggcctggcccccctgaacatccccagatacgagttcggcatctgcgtgctggaccagaaggtgtacgtgatcggcggcatcgccaccaacgtgagacccggcgtgaccatcagaaagcacgagaacagcgtggagtgctggaaccccgacaccaacacctggaccagcctggagagaatgaacgagagcagaagcaccctgggcgtggtggtgctggccggcgagctgtacgccctgggcggctacgacggccagagctacctgcagagcgtggagaagtacatccccaagatcagaaagtggcagcccgtggcccccatgaccaccaccagaagctgcttcgccgccgccgtgctggacggcatgatctacgccatcggcggctacggccccgcccacatgaacagcgtggagagatacgaccccagcaaggacagctgggagatggtggccagcatggccgacaagagaatccacttcggcgtgggcgtgatgctgggcttcatcttcgtggtgggcggccacaacggcgtgagccacctgagcagcatcgagagatacgacccccaccagaaccagtggaccgtgtgcagacccatgaaggagcccagaaccggcgtgggcgccgccgtgatcgacaactacctgtacgtggtgggcggccacagcggcagcagctacctgaacaccgtgcagaagtacgaccccatcagcgacacctggctggacagcgccggcatgatctactgcagatgcaacttcggcctgaccgccctgtag

SEQ ID NO: 21966 - DNA, 255 bp, Artificial Sequence
  Description of Artificial Sequence: Synthetic coding sequence
atggaccacaccagccccacctacatgctggccaacctgacccacctgcacagcgagcagctgctgcagggcctgaacctgctgagacagcaccacgagctgtgcgacatcatcctgagagtgggcgacgtgaagatccacgcccacaaggtggtgctggccagcgtgagcccctacttcaaggccatgttcaccggcaacctgagcgagaaggagaacagcgaggtggagttccagtgcatcgacgagacctag

SEQ ID NO: 21967 - DNA, 489 bp, Artificial Sequence
  Description of Artificial Sequence: Synthetic coding sequence
atggaccacaccagccccacctacatgctggccaacctgacccacctgcacagcgagcagctgctgcagggcctgaacctgctgagacagcaccacgagctgtgcgacatcatcctgagagtgggcgacgtgaagatccacgcccacaaggtggtgctggccagcgtgagcccctacttcaaggccatgttcaccggcaacctgagcgagaaggagaacagcgaggtggagttccagtgcatcgacgagaccgccctgcaggccatcgtggagtacgcctacaccggcaccgtgttcatcagccaggacaccgtggagagcctgctgcccgccgccaacctgctgcagatcaagctggtgctgaaggagtgctgcgccttcctggagagccagctggaccccggcaactgcatcggcatcagcagattcgccgagacctacggctgcagagacctgtacctggccgccaccaagtacatctgccagtag

SEQ ID NO: 21968 - DNA, 138 bp, Artificial Sequence
  Description of Artificial Sequence: Synthetic coding sequence
atggaccacaccagccccacctacatgctggccaacctgacccacctgcacagcgagcagctgctgcagggcctgaacctgctgagacagcaccacgagctgtgcgacatcatcctgagagtgggcgacgtgaagtag

SEQ ID NO: 21969 - DNA, 2628 bp, Artificial Sequence
  Description of Artificial Sequence: Synthetic coding sequence
atgagcagacaccacagcagattcgagagagactacagagtgggctgggacagaagagagtggagcgtgaacggcacccacggcaccaccagcatctgcagcgtgaccagcggcgccggcggcggcaccgccagcagcctgagcgtgagacccggcctgctgcccctgcccgtggtgcccagcagactgcccacccccgccaccgcccccgccccctgcaccaccggcagcagcgaggccatcaccagcctggtggccagcagcgccagcgccgtgaccaccaaggcccccggcatcagcaagggcgacagccagagccagggcctggccaccagcatcagatggggccagacccccatcaaccagagcaccccctgggacaccgacgagccccccagcaagcagatgagagagagcgacaaccccggcaccggcccctgggtgaccaccgtggccgccggcaaccagcccaccctgatcgcccacagctacggcgtggcccagccccccaccttcagccccgccgtgaacgtgcaggcccccgtgatcggcgtgacccccagcctgcccccccacgtgggcccccagctgcccctgatgcccggccactacagcctgccccagccccccagccagcccctgagcagcgtggtggtgaacatgcccgcccaggccctgtacgccagcccccagcccctggccgtgagcaccctgcccggcgtgggccaggtggccagacccggccccaccgccgtgggcaacggccacatggccggccccctgctgcccccccccccccccgcccagcccagcgccaccctgcccagcggcgcccccgccaccaacggcccccccaccaccgacagcgcccacggcctgcagatgctgagaaccatcggcgtgggcaagtacgagttcaccgaccccggccaccccagagagatgctgaaggagctgaaccagcagagaagagccaaggccttcaccgacctgaagatcgtggtggagggcagagagttcgaggtgcaccagaacgtgctggccagctgcagcctgtacttcaaggacctgatccagagaagcgtgcaggacagcggccagggcggcagagagaagctggagctggtgctgagcaacctgcaggccgacgtgctggagctgctgctggagttcgtgtacaccggcagcctggtgatcgacagcgccaacgccaagaccctgctggaggccgccagcaagttccagttccacaccttctgcaaggtgtgcgtgagcttcctggagaagcagctgaccgccagcaactgcctgggcgtgctggccatggccgaggccatgcagtgcagcgagctgtaccacatggccaaggccttcgccctgcagatcttccccgaggtggccgcccaggaggagatcctgagcatcagcaaggacgacttcatcgcctacgtgagcaacgacagcctgaacaccaaggccgaggagctggtgtacgagaccgtgatcaagtggatcaagaaggaccccgccaccagaacccagtacgccgccgagctgctggccgtggtgagactgcccttcatccaccccagctacctgctgaacgtggtggacaacgaggagctgatcaagagcagcgaggcctgcagagacctggtgaacgaggccaagagataccacatgctgccccacgccagacaggagatgcagacccccagaaccagacccagactgagcgccggcgtggccgaggtgatcgtgctggtgggcggcagacagatggtgggcatgacccagagaagcctggtggccgtgacctgctggaacccccagaacaacaagtggtaccccctggccagcctgcccttctacgacagagagttcttcagcgtggtgagcgccggcgacaacatctacctgagcggcggcatggagagcggcgtgaccctggccgacgtgtggtgctacatgagcctgctggacaactggaacctggtgagcagaatgaccgtgcccagatgcagacacaacagcctggtgtacgacggcaagatctacaccctgggcggcctgggcgtggccggcaacgtggaccacgtggagagatacgacaccatcaccaaccagtgggaggccgtggcccccctgcccaaggccgtgcacagcgccgccgccaccgtgtgcggcggcaagatctacgtgttcggcggcgtgaacgaggccggcagagccgccggcgtgctgcagagctacgtgccccagaccaacacctggagcttcatcgagagccccatgatcgacaacaagtacgcccccgccgtgaccctgaacggcttcgtgttcatcctgggcggcgcctacgccagagccaccaccatctacgaccccgagaagggcaacatcaaggccggccccaacatgaaccacagcagacagttctgcagcgccgtggtgctggacggcaagatctacgccaccggcggcatcgtgagcagcgagggccccgccctgggcaacatggaggcctacgagcccaccaccaacacctggaccctgctgccccacatgccctgccccgtgttcagacacggctgcgtggtgatcaagaagtacatccagagcggctag

SEQ ID NO: 21970 - DNA, 1683 bp, Artificial Sequence
  Description of Artificial Sequence: Synthetic coding sequence
atgctggacggcctgcagagactgagaagccagcccaagctggccgacgtgaccctgctggtgggcggcagagagctgccctgccacagaggcctgctggccctgagcagcccctacttccacgccatgttcgccggcgacttcgccgagagcttcagcgccagagtggagctgagagacgtggagcccgccgtggtgggccagctggtggacttcgtgtacaccggcagactgaccatcacccagggcaacgtggaggccctgaccagaaccgccgccagactgcacttccccagcgtgcagaaggtgtgcggcagatacctgcagcagcagctggacgccgccaactgcctgggcatctgcgagttcggcgagcagcagggcctgctgggcgtggccgccaaggcctgggccttcctgagagagaacttcgaggccgtggccagagaggacgagttcctgcagctgcccagagagagactggtgacctgcctggccggcgacctgctgcaggtgcagcccgagcagagcagactggaggccctgatgagatgggtgagacacgacccccaggccagagccgcccacctgcccgagctgctgagcctggtgcacctggacgccgtgcccagaccctgcgtgcagcagctgctggccagcgagcccctgatccaggagagcgaggcctgcagagccgccctgagccagggccacgacggcgcccccctggccctgcagcagaagctggaggaggtgctggtggtggtgggcggccaggccctggaggaggaggaggccggcgaggagcccacccccggcctgggcaacttcgccttctacaacagcaaggccaagagatggatggccctgcccgacttccccgactaccacaagtggggcttcagcctggccgccctgaacaacaacatctacgtgaccggcggcagcagaggcaccaagaccgacacctggagcaccacccaggcctggtgcttccccctgaaggaggccagctggaagcccgtggcccccatgctgaagcccagaaccaaccacgccagcgccgccctgaacggcgagatctacgtgatcggcggcaccaccctggacgtggtggaggtggagagctacgacccctacaccgacagctggacccccgtgagccccgccctgaagtacgtgagcaacttcagcgccgccggctgcagaggcagactgtacctggtgggcagcagcgcctgcaagtacaacgccctggccctgcagtgctacaaccccgtgaccgacgcctggagcgtgatcgccagccccttcctgcccaagtacctgagcagccccagatgcgccgccctgcacggcgagctgtacctgatcggcgacaacaccaagaaggtgtacgtgtacgaccccggcgccaacctgtggcagaaggtgcagagccagcacagcctgcacgagaacggcgccctggtgcccctgggcgacgccctgtacgtgaccggcggcagatggcagggcatggagggcgactaccacgtggagatggaggcctacgacaccgtgagagacacctggaccagacacggcgccctgcccagactgtggctgtaccacggcgccagcaccgtgttcctggacgtgagcaagtggacccagcccagcggccccacccaggagcactag

SEQ ID NO: 21971 - DNA, 1737 bp, Artificial Sequence
  Description of Artificial Sequence: Synthetic coding sequence
atggtgagaaacgtggacgacctggacttccacctgcccagccacgcccaggacatgctggacggcctgcagagactgagaagccagcccaagctggccgacgtgaccctgctggtgggcggcagagagctgccctgccacagaggcctgctggccctgagcagcccctacttccacgccatgttcgccggcgacttcgccgagagcttcagcgccagagtggagctgagagacgtggagcccgccgtggtgggccagctggtggacttcgtgtacaccggcagactgaccatcacccagggcaacgtggaggccctgaccagaaccgccgccagactgcacttccccagcgtgcagaaggtgtgcggcagatacctgcagcagcagctggacgccgccaactgcctgggcatctgcgagttcggcgagcagcagggcctgctgggcgtggccgccaaggcctgggccttcctgagagagaacttcgaggccgtggccagagaggacgagttcctgcagctgcccagagagagactggtgacctgcctggccggcgacctgctgcaggtgcagcccgagcagagcagactggaggccctgatgagatgggtgagacacgacccccaggccagagccgcccacctgcccgagctgctgagcctggtgcacctggacgccgtgcccagaccctgcgtgcagcagctgctggccagcgagcccctgatccaggagagcgaggcctgcagagccgccctgagccagggccacgacggcgcccccctggccctgcagcagaagctggaggaggtgctggtggtggtgggcggccaggccctggaggaggaggaggccggcgaggagcccacccccggcctgggcaacttcgccttctacaacagcaaggccaagagatggatggccctgcccgacttccccgactaccacaagtggggcttcagcctggccgccctgaacaacaacatctacgtgaccggcggcagcagaggcaccaagaccgacacctggagcaccacccaggcctggtgcttccccctgaaggaggccagctggaagcccgtggcccccatgctgaagcccagaaccaaccacgccagcgccgccctgaacggcgagatctacgtgatcggcggcaccaccctggacgtggtggaggtggagagctacgacccctacaccgacagctggacccccgtgagccccgccctgaagtacgtgagcaacttcagcgccgccggctgcagaggcagactgtacctggtgggcagcagcgcctgcaagtacaacgccctggccctgcagtgctacaaccccgtgaccgacgcctggagcgtgatcgccagccccttcctgcccaagtacctgagcagccccagatgcgccgccctgcacggcgagctgtacctgatcggcgacaacaccaagaaggtgtacgtgtacgaccccggcgccaacctgtggcagaaggtgcagagccagcacagcctgcacgagaacggcgccctggtgcccctgggcgacgccctgtacgtgaccggcggcagatggcagggcatggagggcgactaccacgtggagatggaggcctacgacaccgtgagagacacctggaccagacacggcgccctgcccagactgtggctgtaccacggcgccagcaccgtgttcctggacgtgagcaagtggacccagcccagcggccccacccaggagcactag

SEQ ID NO: 21972 - DNA, 420 bp, Artificial Sequence
  Description of Artificial Sequence: Synthetic coding sequence
atgcccagcgagagatgcctgagcatccaggagatgctgaccggccagagactgtgccacagcgagagccacaacgacagcgtgctggccgccctgaaccagcagagaagcgacggcatcctgtgcgacatcaccctgatcgccgaggagcagaagttccacgcccacaaggccgtgctggccgcctgcagcgactacttcagagccatgttcagcctgtgcatggtggagagcggcgccgacgaggtgaacctgcacggcgtgaccagcctgggcctgaagcaggccctggagttcgcctacaccggccagatcctgctggagcccggcgtgatccaggacgtgctggccgccggcagccacctgcagctgctggagctgctgaacctgtgcagccactacctgatccaggtggagtag

SEQ ID NO: 21973 - DNA, 621 bp, Artificial Sequence
  Description of Artificial Sequence: Synthetic coding sequence
atggtggagagcggcgccgacgaggtgaacctgcacggcgtgaccagcctgggcctgaagcaggccctggagttcgcctacaccggccagatcctgctggagcccggcgtgatccaggacgtgctggccgccggcagccacctgcagctgctggagctgctgaacctgtgcagccactacctgatccaggagctgaacagcttcaactacctggacctgtacagactggccgacctgttcaacctgaccctgctggagaaggccgtgatcgacttcctggtgaagcacctgagcgagctgctgaagagcagacccgaggaggtgctgaccctgccctactgcctgctgcaggaggtgctgaagagcgacagactgaccagcctgagcgaggagcagatctggcagaagtgcggcatctgcgccgccttctgcgccctgagaggcgactggtgccccggcctgccccagtgggacgacaagaccgccagctgcgaggtggtgggcacccagctgcccctgcccgtgcacggcagagcccccgccatccaccccctgtggcccaacggctgcggctacagcccctacagctgccccgtgccccccccctgccccagcaagtag

SEQ ID NO: 21974 - DNA, 1863 bp, Artificial Sequence
  Description of Artificial Sequence: Synthetic coding sequence
atgcccagcgagagatgcctgagcatccaggagatgctgaccggccagagactgtgccacagcgagagccacaacgacagcgtgctggccgccctgaaccagcagagaagcgacggcatcctgtgcgacatcaccctgatcgccgaggagcagaagttccacgcccacaaggccgtgctggccgcctgcagcgactacttcagagccatgttcagcctgtgcatggtggagagcggcgccgacgaggtgaacctgcacggcgtgaccagcctgggcctgaagcaggccctggagttcgcctacaccggccagatcctgctggagcccggcgtgatccaggacgtgctggccgccggcagccacctgcagctgctggagctgctgaacctgtgcagccactacctgatccaggagctgaacagcttcaactacctggacctgtacagactggccgacctgttcaacctgaccctgctggagaaggccgtgatcgacttcctggtgaagcacctgagcgagctgctgaagagcagacccgaggaggtgctgaccctgccctactgcctgctgcaggaggtgctgaagagcgacagactgaccagcctgagcgaggagcagatctggcagctggccgtgagatggctggagcacaactgccactaccagtacatggacgagctgctgcagtacatcagattcggcctgatggacgtggacaccctgcacaccgtggccctgagccaccccctggtgcaggccagcgagaccgccaccgccctggtgaacgaggccctggagtaccaccagagcatctacgcccagcccgtgtggcagaccagaagaaccaagcccagattccagagcgacaccctgtacatcatcggcggcaagaagagagaggtgtgcaaggtgaaggagctgagatacttcaaccccgtggaccaggagaacgccctgatcgccgccatcgccaactggagcgagctggcccccatgcccgtgggcagaagccaccactgcgtggccgtgatgggcgacttcctgttcgtggccggcggcgaggtggagcacgccagcggcagaacctgcgccgtgagaaccgcctgcagatacgaccccagaagcaacagctgggccgagatcgcccccatgaagaactgcagagagcacttcgtgctgggcgccatggaggagtacctgtacgccgtgggcggcagaaacgagctgagacaggtgctgcccaccgtggagagatactgccccaagaagaacaagtggaccttcgtgcagagcttcgacagaagcctgagctgccacgccggctacgtggccgacggcctgctgtggatcagcggcggcgtgaccaacaccgcccagtaccagaacagactgatggtgtacgagcccaaccagaacaagtggatcagcagaagccccatgctgcagagaagagtgtaccacagcatggccgccgtgcagagaaagctgtacgtgctgggcggcaacgacctggactacaacaacgacagaatcctggtgagacacatcgacagctacaacatcgacaccgaccagtggaccagatgcaacttcaacctgctgaccggccagaacgagagcggcgtggccgtgcacaacggcagaatctacctggtgggcggctacagcatctggaccaacgagcccctggcctgcatccaggtgctggacgtgagcagagagggcaaggaggaggtgttctacggccccaccctgcccttcgccagcaacggcatcgccgcctgcttcctgcccgccccctacttcacctgccccaacctgcagaccctgcaggtgccccaccacagaatcggcaccatctag

SEQ ID NO: 21975 - DNA, 531 bp, Artificial Sequence
  Description of Artificial Sequence: Synthetic coding sequence
atcctgctggagcccggcgtgatccaggacgtgctggccgccggcagccacctgcagctgctggagctgctgaacctgtgcagccactacctgatccaggagctgaacagcttcaactacctggacctgtacagactggccgacctgttcaacctgaccctgctggagaaggccgtgatcgacttcctggtgaagcacctgagcgagctgctgaagagcagacccgaggaggtgctgaccctgccctactgcctgctgcaggaggtgctgaagagcgacagactgaccagcctgagcgaggagcagatctggcagaagtgcggcatctgcgccgccttctgcgccctgagaggcgactggtgccccggcctgccccagtgggacgacaagaccgccagctgcgaggtggtgggcacccagctgcccctgcccgtgcacggcagagcccccgccatccaccccctgtggcccaacggctgcggctacagcccctacagctgccccgtgccccccccctgccccagcaagtag

SEQ ID NO: 21976 - DNA, 1755 bp, Artificial Sequence
  Description of Artificial Sequence: Synthetic coding sequence
atgcccagcgagagatgcctgagcatccaggagatgctgaccggccagagactgtgccacagcgagagccacaacgacagcgtgctggccgccctgaaccagcagagaagcgacggcatcctgtgcgacatcaccctgatcgccgaggagcagaagttccacgcccacaaggccgtgctggccgcctgcagcgactacttcagaatcctgctggagcccggcgtgatccaggacgtgctggccgccggcagccacctgcagctgctggagctgctgaacctgtgcagccactacctgatccaggagctgaacagcttcaactacctggacctgtacagactggccgacctgttcaacctgaccctgctggagaaggccgtgatcgacttcctggtgaagcacctgagcgagctgctgaagagcagacccgaggaggtgctgaccctgccctactgcctgctgcaggaggtgctgaagagcgacagactgaccagcctgagcgaggagcagatctggcagctggccgtgagatggctggagcacaactgccactaccagtacatggacgagctgctgcagtacatcagattcggcctgatggacgtggacaccctgcacaccgtggccctgagccaccccctggtgcaggccagcgagaccgccaccgccctggtgaacgaggccctggagtaccaccagagcatctacgcccagcccgtgtggcagaccagaagaaccaagcccagattccagagcgacaccctgtacatcatcggcggcaagaagagagaggtgtgcaaggtgaaggagctgagatacttcaaccccgtggaccaggagaacgccctgatcgccgccatcgccaactggagcgagctggcccccatgcccgtgggcagaagccaccactgcgtggccgtgatgggcgacttcctgttcgtggccggcggcgaggtggagcacgccagcggcagaacctgcgccgtgagaaccgcctgcagatacgaccccagaagcaacagctgggccgagatcgcccccatgaagaactgcagagagcacttcgtgctgggcgccatggaggagtacctgtacgccgtgggcggcagaaacgagctgagacaggtgctgcccaccgtggagagatactgccccaagaagaacaagtggaccttcgtgcagagcttcgacagaagcctgagctgccacgccggctacgtggccgacggcctgctgtggatcagcggcggcgtgaccaacaccgcccagtaccagaacagactgatggtgtacgagcccaaccagaacaagtggatcagcagaagccccatgctgcagagaagagtgtaccacagcatggccgccgtgcagagaaagctgtacgtgctgggcggcaacgacctggactacaacaacgacagaatcctggtgagacacatcgacagctacaacatcgacaccgaccagtggaccagatgcaacttcaacctgctgaccggccagaacgagagcggcgtggccgtgcacaacggcagaatctacctggtgggcggctacagcatctggaccaacgagcccctggcctgcatccaggtgctggacgtgagcagagagggcaaggaggaggtgttctacggccccaccctgcccttcgccagcaacggcatcgccgcctgcttcctgcccgccccctacttcacctgccccaacctgcagaccctgcaggtgccccaccacagaatcggcaccatctag

SEQ ID NO: 21977 - DNA, 1656 bp, Artificial Sequence
  Description of Artificial Sequence: Synthetic coding sequence
atgcccagcgagagatgcctgagcatccaggagatgctgaccggccagagactgtgccacagcgagagccacaacgacagcgtgctggccgccctgaaccagcagagaagcgacggcatcctgtgcgacatcaccctgatcgccgaggagcagaagttccacgcccacaaggccgtgctggccgcctgcagcgactacttcagagagctgaacagcttcaactacctggacctgtacagactggccgacctgttcaacctgaccctgctggagaaggccgtgatcgacttcctggtgaagcacctgagcgagctgctgaagagcagacccgaggaggtgctgaccctgccctactgcctgctgcaggaggtgctgaagagcgacagactgaccagcctgagcgaggagcagatctggcagctggccgtgagatggctggagcacaactgccactaccagtacatggacgagctgctgcagtacatcagattcggcctgatggacgtggacaccctgcacaccgtggccctgagccaccccctggtgcaggccagcgagaccgccaccgccctggtgaacgaggccctggagtaccaccagagcatctacgcccagcccgtgtggcagaccagaagaaccaagcccagattccagagcgacaccctgtacatcatcggcggcaagaagagagaggtgtgcaaggtgaaggagctgagatacttcaaccccgtggaccaggagaacgccctgatcgccgccatcgccaactggagcgagctggcccccatgcccgtgggcagaagccaccactgcgtggccgtgatgggcgacttcctgttcgtggccggcggcgaggtggagcacgccagcggcagaacctgcgccgtgagaaccgcctgcagatacgaccccagaagcaacagctgggccgagatcgcccccatgaagaactgcagagagcacttcgtgctgggcgccatggaggagtacctgtacgccgtgggcggcagaaacgagctgagacaggtgctgcccaccgtggagagatactgccccaagaagaacaagtggaccttcgtgcagagcttcgacagaagcctgagctgccacgccggctacgtggccgacggcctgctgtggatcagcggcggcgtgaccaacaccgcccagtaccagaacagactgatggtgtacgagcccaaccagaacaagtggatcagcagaagccccatgctgcagagaagagtgtaccacagcatggccgccgtgcagagaaagctgtacgtgctgggcggcaacgacctggactacaacaacgacagaatcctggtgagacacatcgacagctacaacatcgacaccgaccagtggaccagatgcaacttcaacctgctgaccggccagaacgagagcggcgtggccgtgcacaacggcagaatctacctggtgggcggctacagcatctggaccaacgagcccctggcctgcatccaggtgctggacgtgagcagagagggcaaggaggaggtgttctacggccccaccctgcccttcgccagcaacggcatcgccgcctgcttcctgcccgccccctacttcacctgccccaacctgcagaccctgcaggtgccccaccacagaatcggcaccatctag

SEQ ID NO: 21978 - DNA, 531 bp, Artificial Sequence
  Description of Artificial Sequence: Synthetic coding sequence
atgctgcccctgagccaccccggcggcgtgaccaacaccgcccagtaccagaacagactgatggtgtacgagcccaaccagaacaagtggatcagcagaagccccatgctgcagagaagagtgtaccacagcatggccgccgtgcagagaaagctgtacgtgctgggcggcaacgacctggactacaacaacgacagaatcctggtgagacacatcgacagctacaacatcgacaccgaccagtggaccagatgcaacttcaacctgctgaccggccagaacgagagcggcgtggccgtgcacaacggcagaatctacctggtgggcggctacagcatctggaccaacgagcccctggcctgcatccaggtgctggacgtgagcagagagggcaaggaggaggtgttctacggccccaccctgcccttcgccagcaacggcatcgccgcctgcttcctgcccgccccctacttcacctgccccaacctgcagaccctgcaggtgccccaccacagaatcggcaccatctag

SEQ ID NO: 21979 - DNA, 1602 bp, Artificial Sequence
  Description of Artificial Sequence: Synthetic coding sequence
atgctgctgagcggcatgagagagagccagggcaccgaggtgagcctgagaaccatcagcacccaggacctgagactgctggtgagcttcgcctacagcggcgtggtgagagccagatggcccggcctgctgagagccgcccaggccgccctgcagtaccagagcagcagctgcctggacctgtgccagaagggcctggccagaggcctgagccccgccagatgcctggccctgttccccatggccgaggcccccggcctggagagactgtggagcaaggccagacactacctgctgacccacctgcccgccgtggccctgtgccccgccttccccagcctgcccgccgcctgcctggccgagctgctggacagcgacgagctgcacgtgcaggaggagttcgaggccttcgtggccgccagatgctggctggccgccaaccccgagacccaggagagcgaggccaaggccctgctgagatgcgtgagattcggcagaatgagcaccagagagctgagaagagtgagagccgccggcctgctgccccccctgacccccgacctgctgcaccagctgatggtggaggccgacgtgcccggccaggagagaagaagagagcccgacagagccctggtggtgatcggcggcgacggcctgagacccgacatggccctgagacagcccagcagagccgtgtggtgggccagagccttcagatgcggcgtgggcctggtgagaaccgtggagtggggccagctgcccgccctgcccgcccccggcagattcagacacggcgccgccagcctggccggcagcgagctgtacgtgtgcggcggccaggacttctacagccacagcaacaccctggccagcaccctgagatgggagcccagccaggaggactgggaggagatggcccccctgagccaggccagaagcctgttcagcctggtggccctggacggcaagctgtacgccctgggcggcagacacaacgacgtggccctggacagcgtggagacctacaaccccgagctgaacgtgtggagacccgcccccgccctgcccgccccctgcttcgcccacgccgccgccatcctggagggccagctgtacgtgagcggcggctgcggcggcaccggccagtacctggccagcctgatgcactacgaccccaagctggagaagcccggcaccttcctgagccccatgggcgtgcccagagccggccacgtgatggccgccctgggcggcagactgtacgtggccggcggcctgggcgagaccgaggacctgctgagcttcgaggcctacgagctgagaaccgacagctggacccacctggcccccctgcccagcccccacgtgggcgccgccagcgccgtgctgcagggcgagctgctggtgctgggcggctacagccacagaacctacgccctgagccacctgatccacgcctactgccccggcctgggcagatggctgtgcctgggcaccctgcccagacccagagccgagatgcccgcctgcatcctgaccctgcccgccgtgcagcacatcgccctggtgcccaccccccaccagaccaagcccgccggctag

SEQ ID NO: 21980 - DNA, 1935 bp, Artificial Sequence
  Description of Artificial Sequence: Synthetic coding sequence
atgagctacttcctgagctactgcaaggcccacggcggcgccctgctgaccggctaccaggccctgagagccgagggcttcctgtgcgacgtgaccctggagaccgagggcagcgagttccccgcccacagaagcctgctggcctgcagcagcgactacttcagagccctgttcaagagccacacccaggagagcagagccagagtgatccacctgcacgtgcccagcgccgccggcctgcagagactgctggacttcatctacaccgcctggctgagcctgagcatggacaccgtggaggacaccctggaggccgccagctacctgcaggtgaccgaggccctgggcctgtgcggcagatacctggagagacagctggcccccgagaactgctgcttcgccgccaacgtggccgccagattcggcctggcccacaccctggacgccgccgagagatgcatcgtgagccacctgcaggagctgctggccagaggcgccggccccgccggcctgctggagctgaaccccaccagcctgagagccgtgctgggcgcccccgacgtggccagagtgcccgaggccagactgctgggcctggccctggcctggctgagacaggagcccaccaccgagagactggcccactgcaccgagctgctggagagagtgagattcggcctggtgcccgccgacgtgctgagaagagtgtacagcggcagcggcctggtgctgcccgccagagtgaagggcctgatcatccaggccctgaactaccacaccacccccagcagacagcccctgatgcagggcgagcagaccagcatcagaagcccccagaccagaatcctgctggtgggcggcagaagagccagagaggtggtgatcgaggaggtggccgccccccagagagccgccagaggccaggtggccgcccccgagcccgaggaggaggaggaggagctggaggaggaggaggaggaggaggagtgggagctgacccagaacgtggtggccttcgacgtgtacaaccacagatggagaagcctgacccagctgcccacccccctgctgggccacagcgtgtgcaccgccggcaacttcctgttcgtgctgggcggcgagagccccagcggcagcgccagcagccccctggccgacgacagcagagtggtgaccgcccaggtgcacagatacgaccccagattccacgcctggaccgaggtgcccgccatgagagaggccagagcccacttctggtgcggcgccgtgggcgagagactgctggccgtgggcggcctgggcgccggcggcgaggtgctggccagcgtggagatgtacgacctgagaagagacagatggaccgccgccggcgccctgcccagagccctgcacggccacgccggcgccgtgggcgacagaggcgtggtgtacatcagcggcggcaaggccggcagaggcgagggcggcgccagcagcctgagagacctgtacgtgctgggccccgaggagcaggtgtggagcaagaaggcccccatgggcaccgccagattcggccaccacatggccgtgctgagaggcgccgtgttcgccttcctgggcagatacgagcccttcagcgagatcgagagatacgaccccggcgccgaccagtggaccagactgagacccctgccctacgacagattctgctacggcctggccgtggtggaggagaccgccctgctgctgggcggcctgaagtggagagacagcagacaggtgcccaccagaaacgtggtgggctacgacctggacctggacagatgggaggacatcggctgcgccctgccctgggcctggagcggcctgagatgcgccgtgctgcagctggccgagggcggcgacgacgagagagagggcgaggtgggcgaggccctggacctggtgctgggctag

SEQ ID NO: 21981 - DNA, 1092 bp, Artificial Sequence
  Description of Artificial Sequence: Synthetic coding sequence
atgagatgggtgagacacgacgcccccgccagaagaggccagctgagaagactgctggagcacgtgagactgcccctgctggcccccgcctacttcctggagaaggtggaggccgacgagctgctgcaggcctgcggcgagtgcagacccctgctgctggaggccagagcctgcttcatcctgggcagagaggccggcgccctgagaaccagacccagaagattcatggacctggccgaggtgatcgtggtgatcggcggctgcgacagaaagggcctgctgaagctgcccttcgccgacgcctaccaccccgagagccagagatggacccccctgcccagcctgcccggctacaccagaagcgagttcgccgcctgcgccctgagaaacgacgtgtacgtgagcggcggccacatcaacagccacgacgtgtggatgttcagcagccacctgcacacctggatcaaggtggccagcctgcacaagggcagatggagacacaagatggccgtggtgcagggccagctgttcgccgtgggcggcttcgacggcctgagaagactgcacagcgtggagagatacgaccccttcagcaacacctgggccgccgccgcccccctgcccgaggccgtgagcagcgccgccgtggccagctgcgccggcaagctgttcgtgatcggcggcgccagacagggcggcgtgaacaccgacaaggtgcagtgcttcgaccccaaggaggacagatggagcctgagaagccccgcccccttcagccagagatgcctggaggccgtgagcctggaggacaccatctacgtgatgggcggcctgatgagcaagatcttcacctacgaccccggcaccgacgtgtggggcgaggccgccgtgctgcccagccccgtggagagctgcggcgtgaccgtgtgcgacggcaaggtgcacatcctgggcggcagagacgacagaggcgagagcaccgacaaggtgttcaccttcgaccccagcagcggccaggtggaggtgcagcccagcctgcagagatgcaccagcagccacggctgcgtgaccatcatccagagcctgggcagatag

SEQ ID NO: 21982 - DNA, 1752 bp, Artificial Sequence
  Description of Artificial Sequence: Synthetic coding sequence
atgagacagggccacgcccccgaggagagcgagcccggctgcgaggccccctgcgccggcccctgccacgcccagagagtgctgcaggccctgaacgcctacagaagaagcggcaccctgaccgacgtggtgctgagagccggcggcagagacttcccctgccacagagccgccctgagcgccggcagcgcctacttcagaagcctgttcgccgccggcagacccgagagaggccccgccgtggtgcccgtggtgcccgtggcccccgaggcccccggcaccagccccgccggcgccgccgccgccctggccgtggtgctggactacgtgtacggcgccggcgtgagactgagagccgaggacgaggccgccgccgtgctggccctggccgagagactgggcgtggccggcctgagagaggcctgcgtgagattcctggagggcagactgagagccgccaacagcctggccctgagaagagtggccgccgccttcagcctggcccccctggccgagagatgcggcagagtgctgagacaggccttcgccgaggtggccagacacgccgacttcctggagctggcccccgacgaggtggtggccctgctggccgaccccgccctgggcgtggccagagaggaggccgtgttcgaggccgccatgagatgggtgagacacgacgcccccgccagaagaggccagctgagaagactgctggagcacgtgagactgcccctgctggcccccgcctacttcctggagaaggtggaggccgacgagctgctgcaggcctgcggcgagtgcagacccctgctgctggaggccagagcctgcttcatcctgggcagagaggccggcgccctgagaaccagacccagaagattcatggacctggccgaggtgatcgtggtgatcggcggctgcgacagaaagggcctgctgaagctgcccttcgccgacgcctaccaccccgagagccagagatggacccccctgcccagcctgcccggctacaccagaagcgagttcgccgcctgcgccctgagaaacgacgtgtacgtgagcggcggccacatcaacagccacgacgtgtggatgttcagcagccacctgcacacctggatcaaggtggccagcctgcacaagggcagatggagacacaagatggccgtggtgcagggccagctgttcgccgtgggcggcttcgacggcctgagaagactgcacagcgtggagagatacgaccccttcagcaacacctgggccgccgccgcccccctgcccgaggccgtgagcagcgccgccgtggccagctgcgccggcaagctgttcgtgatcggcggcgccagacagggcggcgtgaacaccgacaaggtgcagtgcttcgaccccaaggaggacagatggagcctgagaagccccgcccccttcagccagagatgcctggaggccgtgagcctggaggacaccatctacgtgatgggcggcctgatgagcaagatcttcacctacgaccccggcaccgacgtgtggggcgaggccgccgtgctgcccagccccgtggagagctgcggcgtgaccgtgtgcgacggcaaggtgcacatcctgggcggcagagacgacagaggcgagagcaccgacaaggtgttcaccttcgaccccagcagcggccaggtggaggtgcagcccagcctgcagagatgcaccagcagccacggctgcgtgaccatcatccagagcctgggcagatag

SEQ ID NO: 21983 - DNA, 1662 bp, Artificial Sequence
  Description of Artificial Sequence: Synthetic coding sequence
atgatggagggcagcagacagaccagagtgagcagaccctacaagatcagcgagagcagcaaggtgtacagatgggccgaccacagcagcaccgtgctgcagagactgaacgagcagagactgagaggcctgttctgcgacgtggtgctggtggccgacgagcagagagtgcccgcccacagaaacctgctggccgtgtgcagcgactacttcaacagcatgttcaccatcggcatgagagaggccttccagaaggaggtggagctgatcggcgccagctacatcggcctgaaggccgtggtggacttcctgtacggcggcgagctggtgctggacggcggcaacatcgactacgtgctggagaccgcccacctgctgcagatctggaccgtggtggacttctgctgcgagtacctggagcaggaggtgagcgaggacaactacctgtacctgcaggagctggccagcatctacagcctgaagagactggacgccttcatcgacggcttcatcctgaaccacttcggcaccctgagcttcacccccgacttcctgcagaacgtgagcatgcagaagctgtgcgtgtacctgagcagcagcgaggtgcagagagagtgcgagcacgacctgctgcaggccgccctgcagtggctgacccagcagcccgagagagaggcccacgccagacaggtgctggagaacatccacttccccctgatccccaagaacgacctgctgcacagagtgaagcccgccgtgtgcagcctgctgcccaaggaggccaactgcgagggcttcatcgaggaggccgtgagataccacaacaacctggccgcccagcccgtgatgcagaccaagagaaccgccctgagaaccaaccaggagagactgctgttcgtgggcggcgaggtgagcgagagatgcctggagctgagcgacgacacctgctacctggacgccaagagcgagcagtgggtgaaggagacccccctgcccgccagaagaagccaccactgcgtggccgtgctgggcggcttcatcttcatcgccggcggcagcttcagcagagacaacggcggcgacgccgccagcaacctgctgtacagattcacctacggccacgccggcaccatctacaaggacttcgtgtacatcagcggcggccacgactaccagatcggcccctacagaaagaacctgctgtgctacgaccacagaaccgacgtgtgggaggagagaagacccatgaccaccgccagaggctggcacagcatgtgcagcctgggcgacagcatctacagcatcggcggcagcgacgacaacatcgagagcatggagagattcgacgtgctgggcgtggaggcctacagcccccagtgcaaccagtggaccagagtggcccccctgctgcacgccaacagcgagagcggcgtggccgtgtgggagggcagaatctacatcctgggcggctacagctgggagaacaccgccttcagcaagaccgtgcaggtgtacgacagagaggccgacaagtggagcagaggcgtggacctgcccaaggccatcgccggcggcagcgcctgcgtgtgcgccctggagcccagacccgaggacaagaagaagaagggcaagggcaagagacaccaggacagaggccagtag

SEQ ID NO: 21984 - DNA, 1851 bp, Artificial Sequence
  Description of Artificial Sequence: Synthetic coding sequence
atgatggagggcagcagacagaccagagtgagcagaccctacaagatcagcgagagcagcaaggtgtacagatgggccgaccacagcagcaccgtgctgcagagactgaacgagcagagactgagaggcctgttctgcgacgtggtgctggtggccgacgagcagagagtgcccgcccacagaaacctgctggccgtgtgcagcgactacttcaacagcatgttcaccatcggcatgagagaggccttccagaaggaggtggagctgatcggcgccagctacatcggcctgaaggccgtggtggacttcctgtacggcggcgagctggtgctggacggcggcaacatcgactacgtgctggagaccgcccacctgctgcagatctggaccgtggtggacttctgctgcgagtacctggagcaggaggtgagcgaggacaactacctgtacctgcaggagctggccagcatctacagcctgaagagactggacgccttcatcgacggcttcatcctgaaccacttcggcaccctgagcttcacccccgacttcctgcagaacgtgagcatgcagaagctgtgcgtgtacctgagcagcagcgaggtgcagagagagtgcgagcacgacctgctgcaggccgccctgcagtggctgacccagcagcccgagagagaggcccacgccagacaggtgctggagaacatccacttccccctgatccccaagaacgacctgctgcacagagtgaagcccgccgtgtgcagcctgctgcccaaggaggccaactgcgagggcttcatcgaggaggccgtgagataccacaacaacctggccgcccagcccgtgatgcagaccaagagaaccgccctgagaaccaaccaggagagactgctgttcgtgggcggcgaggtgagcgagagatgcctggagctgagcgacgacacctgctacctggacgccaagagcgagcagtgggtgaaggagacccccctgcccgccagaagaagccaccactgcgtggccgtgctgggcggcttcatcttcatcgccggcggcagcttcagcagagacaacggcggcgacgccgccagcaacctgctgtacagatacgaccccagatgcaagcagtggatcaaggtggccagcatgaaccagagaagagtggacttctacctggccagcatcgaggacatgctggtggccatcggcggcagaaacgagaacggcgccctgagcagcgtggagacctacagccccaagaccgacagctggagctacgtggccggcctgcccagattcacctacggccacgccggcaccatctacaaggacttcgtgtacatcagcggcggccacgactaccagatcggcccctacagaaagaacctgctgtgctacgaccacagaaccgacgtgtgggaggagagaagacccatgaccaccgccagaggctggcacagcatgtgcagcctgggcgacagcatctacagcatcggcggcagcgacgacaacatcgagagcatggagagattcgacgtgctgggcgtggaggcctacagcccccagtgcaaccagtggaccagagtggcccccctgctgcacgccaacagcgagagcggcgtggccgtgtgggagggcagaatctacatcctgggcggctacagctgggagaacaccgccttcagcaagaccgtgcaggtgtacgacagagaggccgacaagtggagcagaggcgtggacctgcccaaggccatcgccggcggcagcgcctgcgtgtgcgccctggagcccagacccgaggacaagaagaagaagggcaagggcaagagacaccaggacagaggccagtag

SEQ ID NO: 21985 - DNA, 1851 bp, Artificial Sequence; identical to SEQ ID NO: 21984
  Description of Artificial Sequence: Synthetic coding sequence

SEQ ID NO: 21986 - DNA, 1746 bp, Artificial Sequence
  Description of Artificial Sequence: Synthetic coding sequence
atggacgaggagagcctggacggcctgctgttcaaggaccacgacttcagcagcgacctgctgagacagctgaacagcctgagacagagcagaatcctgaccgacgtgagcatctgcgccggcgccagagagatcccctgccacagaaacgtgctggccagcagcagcccctacttcagagccatgttctgcagcagcttcagagagaagagcgaggccaaggtgcagctgaagggcatcgacccccccaccctggaccagatcgtgagctacgtgtacaccggcgaggcccacatcgccaccgacaacgtgctgcccgtgatggaggccgccagcatgctgcagttccccaagctgttcgaggcctgcagcagctacctgcagagccagctggcccccagcaactgcctgggcatgatcagactgagcgagatcctgagctgcgagaccctgaagaagaaggccagagaggtggccctgaccagcttccccgaggtggccgccagcgccgacctgaaggagctgtgcgccctggagctgagagactacctgggcgacgacggcctgtgcggcgaggaggagaaggtgttcgaggccctgatggtgtggatcaagcacgacctgcaggccagaaagagatacatgcaggagctgttcaagcaggtgagactgcagtacatccaccccgccttcttccaccacttcatcgccaacgacgccctgctgcagagcagccccgcctgccagatcatcctggagaccgccaagagacagatgttcagcctgtgcggcaccaccgtgcccgactgcaagctgctgctgcacgtgccccccagaaacagctaccaggacttcctgatcctgctgggcggcagaaaggacagccagcagaccaccagagacgtgctgctgtacagcaagcagaccggccagtggcagagcctggccaagctgcccaccagactgtacaaggccagcgccatcaccctgcacagaagcatctacgtgctgggcggcatggccgtgagcagcggcagaagcctggtgagccacaacgtgtacatcttcagcctgaagctgaaccagtggagactgggcgagcccatgctggtggccagatacagccacagaagcaccgcccacaagaacttcatcttcagcatcggcggcatcggcgagggccaggagctgatgggcagcatggagagatacgacagcatctgcaacgtgtgggagagcatggccagcatgcccgtgggcgtgctgcaccccgccgtggccgtgaaggaccagagactgtacctgttcggcggcgaggacatcatgcagaaccccgtgagactgatccaggtgtaccacatcagcagaaacagctggttcaagatggagaccagaatgatcaagaacgtgtgcgcccccgccgtggtgctgggcgagagaatcgtgatcgtgggcggctacaccagaagaatcctggcctacgacccccagagcaacaagttcgtgaagtgcgccgacatgaaggacagaagaatgcaccacggcgccaccgtgatgggcaacaagctgtacgtgaccggcggcagaagactgaccaccgactgcaacatcgaggacagcgccagcttcgactgctacgaccccgagaccgacacctggaccagccagggccagctgccccacaagctgttcgaccacgcctgcctgaccctgcagtgcatccccagaaccagcggcctgccctag

SEQ ID NO: 21987 - DNA, 1854 bp, Artificial Sequence
  Description of Artificial Sequence: Synthetic coding sequence
atgaaggtgagcctgggcaacggcgagatgggcgtgagcgcccacctgcagccctgcaaggccggcaccaccagattcttcaccagcaacacccacagcagcgtggtgctgcagggcttcgaccagctgagaatcgagggcctgctgtgcgacgtgaccctggtgcccggcgacggcgacgagatcttccccgtgcacagagccatgatggccagcgccagcgactacttcaaggccatgttcaccggcggcatgaaggagcaggacctgatgtgcatcaagctgcacggcgtgaacaaggtgggcctgaagaagatcatcgacttcatctacaccgccaagctgagcctgaacatggacaacctgcaggacaccctggaggccgccagcttcctgcagatcctgcccgtgctggacttctgcaaggtgttcctgatcagcggcgtgagcctggacaactgcgtggaggtgggcagaatcgccaacacctacaacctgatcgaggtggacaagtacgtgaacaacttcatcctgaagaacttccccgccctgctgagcaccggcgagttcctgaagctgcccttcgagagactggccttcgtgctgagcagcaacagcctgaagcactgcaccgagctggagctgttcaaggccgcctgcagatggctgagactggaggaccccagaatggactacgccgccaagctgatgaagaacatcagattccccctgatgaccccccaggacctgatcaactacgtgcagaccgtggacttcatgagaaccgacaacacctgcgtgaacctgctgctggaggccagcaactaccagatgatgccctacatgcagcccgtgatgcagagcgacagaaccgccatcagaagcgacagcacccacctggtgaccctgggcggcgtgctgagacagcagctggtggtgagcaaggagctgagaatgtacgacgagagagcccaggagtggagaagcctggcccccatggacgcccccagataccagcacggcatcgccgtgatcggcaacttcctgtacgtggtgggcggccagagcaactacgacaccaagggcaagaccgccgtggacaccgtgttcagattcgaccccagatacaacaagtggatgcaggtggccagcctgaacgagaagagaaccttcttccacctgagcgccctgaagggccacctgtacgccgtgggcggcagaagcgccgccggcgagctggccaccgtggagtgctacaaccccagaatgaacgagtggagctacgtggccaagatgagcgagccccactacggccacgccggcaccgtgtacggcggcctgatgtacatcagcggcggcatcacccacgacaccttccagaacgagctgatgtgcttcgaccccgacaccgacaagtggatgcagaaggcccccatgaccaccgtgagaggcctgcactgcatgtgcaccgtgggcgacaagctgtacgtgatcggcggcaaccacttcagaggcaccagcgactacgacgacgtgctgagctgcgagtactacagccccaccctggaccagtggacccccatcgccgccatgctgagaggccagagcgacgtgggcgtggccgtgttcgagaacaagatctacgtggtgggcggctacagctggaacaacagatgcatggtggagatcgtgcagaagtacgaccccgagaaggacgagtggcacaaggtgttcgacctgcccgagagcctgggcggcatcagagcctgcaccctgaccgtgttcccccccgaggagaaccccggcagccccagcagagagagccccctgagcgcccccagcgaccacagctag

SEQ ID NO: 21988 - DNA, 1650 bp, Artificial Sequence
  Description of Artificial Sequence: Synthetic coding sequence
atgatggccagcgccagcgactacttcaaggccatgttcaccggcggcatgaaggagcaggacctgatgtgcatcaagctgcacggcgtgaacaaggtgggcctgaagaagatcatcgacttcatctacaccgccaagctgagcctgaacatggacaacctgcaggacaccctggaggccgccagcttcctgcagatcctgcccgtgctggacttctgcaaggtgttcctgatcagcggcgtgagcctggacaactgcgtggaggtgggcagaatcgccaacacctacaacctgatcgaggtggacaagtacgtgaacaacttcatcctgaagaacttccccgccctgctgagcaccggcgagttcctgaagctgcccttcgagagactggccttcgtgctgagcagcaacagcctgaagcactgcaccgagctggagctgttcaaggccgcctgcagatggctgagactggaggaccccagaatggactacgccgccaagctgatgaagaacatcagattccccctgatgaccccccaggacctgatcaactacgtgcagaccgtggacttcatgagaaccgacaacacctgcgtgaacctgctgctggaggccagcaactaccagatgatgccctacatgcagcccgtgatgcagagcgacagaaccgccatcagaagcgacagcacccacctggtgaccctgggcggcgtgctgagacagcagctggtggtgagcaaggagctgagaatgtacgacgagagagcccaggagtggagaagcctggcccccatggacgcccccagataccagcacggcatcgccgtgatcggcaacttcctgtacgtggtgggcggccagagcaactacgacaccaagggcaagaccgccgtggacaccgtgttcagattcgaccccagatacaacaagtggatgcaggtggccagcctgaacgagaagagaaccttcttccacctgagcgccctgaagggccacctgtacgccgtgggcggcagaagcgccgccggcgagctggccaccgtggagtgctacaaccccagaatgaacgagtggagctacgtggccaagatgagcgagccccactacggccacgccggcaccgtgtacggcggcctgatgtacatcagcggcggcatcacccacgacaccttccagaacgagctgatgtgcttcgaccccgacaccgacaagtggatgcagaaggcccccatgaccaccgtgagaggcctgcactgcatgtgcaccgtgggcgacaagctgtacgtgatcggcggcaaccacttcagaggcaccagcgactacgacgacgtgctgagctgcgagtactacagccccaccctggaccagtggacccccatcgccgccatgctgagaggccagagcgacgtgggcgtggccgtgttcgagaacaagatctacgtggtgggcggctacagctggaacaacagatgcatggtggagatcgtgcagaagtacgaccccgagaaggacgagtggcacaaggtgttcgacctgcccgagagcctgggcggcatcagagcctgcaccctgaccgtgttcccccccgaggagaaccccggcagccccagcagagagagccccctgagcgcccccagcgaccacagctag

SEQ ID NO: 21989 - DNA, 534 bp, Artificial Sequence
  Description of Artificial Sequence: Synthetic coding sequence
atgaccaccagcatcagacagttcaccagcagcagcagcatcaagggcagcagcggcctgggcggcggcagcagcagaaccagctgccagctgagcggcggcctgggcgccggcagctgcagacccggcagcgccggcggcctgggcagcgccctgggcggcagcagctacagcagctgctacagcttcggcagcggcggcggctacggcagcagcagcttcgagggcgtggacggcctgctggtgggcggcgagaaggccaccatgcagaacctgaacgacagactggccagctacctggacaaggtgagagccctggaggaggccgacaccgagctggaggtgaagatcagagactggtaccagagacaggcccccggccccgccagagactacagccagtactacagaatcatcgaggagctgcagaacaagcccccctggaccatgcccaccagctgctacatcctgaccatgcccatctggctgctgctgaccagcgcccccaagagctggcagaacgagggcagatag

SEQ ID NO: 21990 - DNA, 1326 bp, Artificial Sequence
  Description of Artificial Sequence: Synthetic coding sequence
atgaccaccagcatcagacagttcaccagcagcagcagcatcaagggcagcagcggcctgggcggcggcagcagcagaaccagctgccagctgagcggcggcctgggcgccggcagctgcagacccggcagcgccggcggcctgggcagcgccctgggcggcagcagctacagcagctgctacagcttcggcagcggcggcggctacggcagcagcagcttcgagggcgtggacggcctgctggtgggcggcgagaaggccaccatgcagaacctgaacgacagactggccagctacctggacaaggtgagagccctggaggaggccgacaccgagctggaggtgaagatcagagactggtaccagagacaggcccccggccccgccagagactacagccagtactacagaatcatcgaggagctgcagaacaagatcctgaccgccaccgtggacaacgccaacatcctgctgcacatcgacaacgcccacctggccgccgccgacttcagaaccaagttcgagaccgagcaggccctgtgcctgagcgtggaggccgacatcaacggcccctgcagagtgctggacgagctgaccctggccagagccgacctggagatgcacatcgagaacctgaaggaggagctggcctacctgaagaagaaccacgaggagatgaacgcccccagaggccaggtgggcggcgagatcaacgtggagatgggcgccgcccccggcgtggacctgagcagaatcctgaacgagatgagagagcagtacgagaagatggccgagaagaacagaaaggacgccgaggactggttcttcagcaagaccgaggagctgaacagagaggtggccaccaacagcgagctggtgcagagcggcaagagcgagatcagcgagctgagatgcaccatgcaggccctggagatcgagctgcagagccagctgagcatgaaggccagcctggagggcaacctggccgagaccgagaacagatactgcatgcagctgagccagatccagggcctgatcggcagcgtggaggagagactggcccagctgctgtgcgagatggagcagcagaaccaggagtacaagatcctgctggacatgaagatgagactggagctggagatcaccacctaccacagactgctggagggcgaggacgcccacgagggcctgctggcccccacccacttcaagctgcccgccagccccgccgccgtgaccacctgccaggtgcccaccatcgtggaggaggtgcaggacggcaaggtgatcagcagcagagagcaggtgagacagaccaccagatag

SEQ ID NO: 21991 - DNA, 366 bp, Artificial Sequence
  Description of Artificial Sequence: Synthetic coding sequence
atggccagctgcagcaccagcggcacctgcggcagcagctgctgccagcccagctgctgcgagaccagctgctgccagcccagctgctgccagaccagcagctgcggcaccggctgcggcatcggcggcggcatcggctacggccaggagggcagcggcggcagcgtgagcaccagaatcagatggtgccaccccgactgccacgtggagggcacctgcctgcccccctgctacctggtgagctgcaccccccccagctgctgccagctgcaccacgccgaggccagctgctgcagacccagctactgcggccagagctgctgcagacccgcctgctgctgccactgctgcgagcccacctgctag

SEQ ID NO: 21992 - DNA, 372 bp, Artificial Sequence
  Description of Artificial Sequence: Synthetic coding sequence
atgaccggcagctgctgcggcagcaccttcagcagcctgagctacggcggcggctgctgccagccctgctgctgcagagacccctgctgctgcagacccgtgacctgccagaccaccgtgtgcagacccgtgacctgcgtgcccagatgcaccagacccatctgcgagccctgcagaagacccgtgtgctgcgacccctgcagcctgcaggagggctgctgcagacccatcacctgctgccccagcagctgcaccgccgtggtgtgcagaccctgctgctgggccaccacctgctgccagcccgtgagcgtgcagagcccctgcggccagcccaccccctgcagcaccacctgcagaaccagcagctgctag

SEQ ID NO: 21993 - DNA, 390 bp, Artificial Sequence
  Description of Artificial Sequence: Synthetic coding sequence
atgaccggcagctgctgcggcagcaccttcagcagcctgagctacggcggcggctgctgccagccctgctgctgcagagacccctgctgctgcagacccgtgacctgccagaccaccgtgtgcagacccgtgacctgcgtgcccagatgcaccagacccatctgcgagccctgcagaagacccgtgtgctgcgacccctgcagcctgcaggagggctgctgcagacccatcacctgctgccccagcagctgcaccgccgtggtgtgcagaccctgctgctgggccaccacctgctgccagcccgtgagcgtgcagagcccctgcggccagcccagcccctgcggccagcccaccccctgcagcaccacctgcagaaccagcagctgctag

SEQ ID NO: 21994 - DNA, 468 bp, Artificial Sequence
  Description of Artificial Sequence: Synthetic coding sequence
atggtgagcagctgctgcggcagcgtgtgcagcgaccagggctgcagccaggacctgtgccaggagacctgctgcagacccagctgctgccagaccacctgctgcagaaccacctgctacagacccagctgctgcgtgagcagctgctgcagaccccagtgctgccagagcgtgtgctgccagcccacctgctgcagacccacctgctgcgagaccacctgctgccaccccagatgctgcatcagcagctgctgcagacccagctgctgcatgagcagctgctgcaagccccagtgctgccagagcgtgtgctgccagcccacctgctgcagacccagctgctgcagaccctgctgctgcctgagacccgtgtgcggcagagtgagctgccacaccacctgctacagacccacctgcgtgatcagcacctgccccagacccctgtgctgcgccagcagctgctgctag

SEQ ID NO: 21995 - DNA, 660 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctgcggcagcggctgcggcggctgcggcagcggctgcggcggctgcggcagcagctgctgcgtgcccatctgctgctgcaagcccgtgtgctgctgcgtgcccgcctgcagctgcagcagctgcggcagctgcggcggcagcaagggcggctacggcagctgcggcggcagcaagggcggctgcgtgagctgcggcggcagcaagggcggctgcggcagctgcggcggcagcaagggcggctgcggcagctgcggcggcagcaagggcggctgcggcagctgcggcggcagcaagggcggctgcggcagctgcggctgcagccagtgcagctgctgcaagccctgctgcttcagcagcggctgcggcagcagctgctgccagagcagctgctgcaagcccagctgctgccagagcagctgctgcaagccctactgctgccagagcagctgctgcaagccctgctgcagcagcagcggctgcggcagcagctgctgccagagcagctgctgcaacccctgctgcagccagagcagctgctgcgtgcccgtgtgctgccagtgcaagatctag

SEQ ID NO: 21996 - DNA, 687 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctgcggcagcggctgcggcggctgcggcagcggctgcggcggctgcggcagcagctgctgcgtgcccatctgctgctgcaagcccgtgtgctgctgcgtgcccgcctgcagctgcagcagctgcggcagctgcggcggcagcaagggcggctacggcagctgcggcggcagcaagggcggctgcgtgagctgcggcggcagcaagggcggctgcggcagctgcggcggcagcaagggcggctgcggcagctgcggcggcagcaagggcggctgcggcagctgcggcggcagcaagggcggctgcggcagctgcggctgcagccagtgcagctgctgcaagccctgctgcttcagcagcggctgcggcagcagctgctgccagagcagctgctgcaagccctgctgcagcagcagcggctgcggcagcagctgctgccagagcagctgctgcaagccctactgctgccagagcagctgctgcaagccctgctgcagcagcagcggctgcggcagcagctgctgccagagcagctgctgcaacccctgctgcagccagagcagctgctgcgtgcccgtgtgctgccagtgcaagatctag

SEQ ID NO: 21997 - DNA, 351 bp, Artificial Sequence
  Description of Artificial Sequence: Synthetic coding sequence
tgctgccaccccacctgctgccagaacacctgctgcagaaccacctgctgccagcccacctgcgtggccagctgctgccagcccagctgctgcagcaccccctgctgccagcccacctgctgcggcagcagctgctgcggcaccacctgctgccagcccacctgctgccagcccacctgctgcagaaacaccagctgccagcccacctgctgcggcagcagctgctgccagcccccctgctgcagacccacctgctgccagaccacctgctacagaaccacctgctgcagacccagctgctgctgcagcccctgctgcgtgagcagctgctgccagcccagctgctgctag

SEQ ID NO: 21998 - DNA, 306 bp, Artificial Sequence
  Description of Artificial Sequence: Synthetic coding sequence
agacccttctgctgccacaccccctgctgccagcccagctgctgcgtgcccagctgctgccagccctgctgccaccccacctgctgccagaacacctgctgcagaaccacctgctgccagcccacctgcgtggccagctgctgccagcccagctgctgcagcaccccctgctgccagcccacctgctgcggccagacctgcaacgagagcagctactgcctgccctgctgcagacccacctgctgccagaccacctgctacagaaccacctgctgcagacccagctgctgctgcagcccctgctag

SEQ ID NO: 21999 - DNA, 753 bp, Artificial Sequence
  Description of Artificial Sequence: Synthetic coding sequence
atgacccactgctgcagcccctgctgccagcccacctgctgcagaaccacctgctgcagaaccacctgctggaagcccaccaccgtgaccacctgcagcagcaccccctgctgccagcccagctgctgcgtgcccagctgctgccagccctgctgccaccccacctgctgccagaacacctgctgcagaaccacctgctgccagcccacctgcgtggccagctgctgccagcccagctgctgcagcaccccctgctgccagcccacctgctgcggcagcagctgctgcggccagaccagctgcggcagcagctgctgccagcccatctgcggcagcagctgctgccagccctgctgccaccccacctgctaccagaccatctgcttcagaaccacctgctgccagcccacctgctgccagcccacctgctgcagaaacaccagctgccagcccacctgctgcggcagcagctgctgccagccctgctgccaccccacctgctgccagaccatctgcagaagcacctgctgccagcccagctgcgtgaccagatgctgcagcaccccctgctgccagcccacctgcggcggcagcagctgctgcagccagacctgcaacgagagcagctactgcctgccctgctgcagacccacctgctgccagaccacctgctacagaaccacctgctgcagacccagctgctgctgcagcccctgctgcgtgagcagctgctgccagcccagctgctgctag

SEQ ID NO: 22000 - DNA, 483 bp, Artificial Sequence
  Description of Artificial Sequence: Synthetic coding sequence
atgacccactgctgcagccccggctgccagcccacctgctgcagaaccacctgctgcagaaccacctgctggcagcccaccatcgtgaccacctgcagcagcaccccctgctgccagcccagctgctgcgtgagcagctgctgccagccctactgccaccccacctgctgccagaacacctgctgcagaaccacctgctgccagcccacctgcgtgaccagctgctgccagcccagctgctgcagcaccccctgctaccagcccatctgctgcggcagcagctgctgcggccagaccagctgcggcagcagctgcggccagagcagcagctgcgcccccgtgtactgcagaagaacctgctaccaccccaccaccgtgtgcctgcccggctgcctgaaccagagctgcggcagcagctgctgccagccctgctactgccccgcctgctgcgtgagcagctgctgccagcacagctgctgctag

SEQ ID NO: 22001 - DNA, 510 bp, Artificial Sequence
  Description of Artificial Sequence: Synthetic coding sequence
atgacccactgctgcagcccctgctgccagcccacctgctgcagaaccacctgctggaagcccaccaccgtgaccacctgcagcagcaccccctgctgccagcccagctgctgcgtgagcagctgctgccagccctgctgccaccccacctgctgccagaacacctgctgcagaaccacctgctgccagcccacctgcgtgaccagctgctgccagcccagctgctgcagcaccccctgctgccagcccatctgctgcggcagcagctgctgcggccagaccagctgcggcagcagctgctgccagcccagcagctgcgcccccatctactgcagaagaacctgctaccaccccaccagcgtgtacctgcccggctgcctgaaccagagctgcggcagcagctgctgccagccctgctgcagacccgcctgctgcgagaccacctgctgcagaaccacctgcttccagcccacctgcgtgaccagctgctgccagcccgcctgctgctag

SEQ ID NO: 22002 - DNA, 510 bp, Artificial Sequence
  Description of Artificial Sequence: Synthetic coding sequence
atgacccactgctgcagcccctgctgccagcccacctgctgcagaaccacctgctggaagcccaccaccgtgaccacctgcagcagcaccccctgctgccagcccagctgctgcgtgagcagctgctgccagccctgctgcagacccgcctgctgccagaacacctgctgcagaaccacctgctgccagcccacctgcctgaccagctgctgccagcccagctgctgcagcaccacctgctgccagcccatctgctgcggcagcagctgctgcggccagaccagctgcggcagcagctgcggccagagcagcagctgcgcccccgtgtactgcagaagaacctgctactaccccaccaccgtgtgcctgcccggctgcctgaaccagagctgcggcagcagctgctgccagccctgctgcagacccgcctgctgcgagaccacctgctgcagaaccacctgcttccagcccacctgcgtgagcagctgctgccagcccagctgctgctag

SEQ ID NO: 22003 - DNA, 528 bp, Artificial Sequence
  Description of Artificial Sequence: Synthetic coding sequence
atgacccactgctgcagcccctgctgccagcccacctgctgcagaaccacctgctgcagaaccacctgctggaagcccaccaccgtgaccacctgcagcagcaccccctgctgccagcccagctgctgcgtgagcagctgctgccagcccccctgctgcagacccgcctgctgccagaacacctgctgcagaaccacctgctgccagcccacctgcctgaccagctgctgccagcccagctgctgcagcaccacctgctgccagcccatctgctgcggcagcagctgctgcggccagaccagctgcggcagcagctgcggccagagcagcagctgcgcccccgtgtactgcagaagaacctgctactaccccaccaccgtgtgcctgcccggctgcctgaaccagagctgcggcagcagctgctgccagccctgctgcagacccgcctgctgcgagaccacctgctgcagaaccacctgcttccagcccacctgcgtgagcagctgctgccagcccagctgctgctag

SEQ ID NO: 22004 - DNA, 2037 bp, Artificial Sequence
  Description of Artificial Sequence: Synthetic coding sequence
atgcccacctggggcgccagacccgccagccccgacagattcgccgtgagcgccgaggccgagaacaaggtgagagagcagcagccccacgtggagagaatcttcagcgtgggcgtgagcgtgctgcccaaggactgccccgacaacccccacatctggctgcagctggagggccccaaggagaacgccagcagagccaaggagtacctgaagggcctgtgcagccccgagctgcaggacgagatccactacccccccaagctgcactgcatcttcctgggcgcccagggcttcttcctggactgcctggcctggagcaccagcgcccacctggtgcccagagcccccggcagcctgatgatcagcggcctgaccgaggccttcgtgatggcccagagcagagtggaggagctggccgagagactgagctgggacttcacccccggccccagcagcggcgccagccagtgcaccggcgtgctgagagacttcagcgccctgctgcagagccccggcgacgcccacagagaggccctgctgcagctgcccctggccgtgcaggaggagctgctgagcctggtgcaggaggccagcagcggccagggccccggcgccctggccagctgggagggcagaagcagcgccctgctgggcgcccagtgccagggcgtgagagccccccccagcgacggcagagagagcctggacaccggcagcatgggccccggcgactgcagaggcgccagaggcgacacctacgccgtggagaaggagggcggcaagcagggcggccccagagagatggactggggctggaaggagctgcccggcgaggaggcctgggagagagaggtggccctgagaccccagagcgtgggcggcggcgccagagagagcgcccccctgaagggcaaggccctgggcaaggaggagatcgccctgggcggcggcggcttctgcgtgcacagagagccccccggcgcccacggcagctgccacagagccgcccagagcagaggcgccagcctgctgcagagactgcacaacggcaacgccagcccccccagagtgcccagccccccccccgcccccgagcccccctggcactgcggcgacagaggcgactgcggcgacagaggcgacgtgggcgacagaggcgacaagcagcagggcatggccagaggcagaggcccccagtggaagagaggcgccagaggcggcaacctggtgaccggcacccagagattcaaggaggccctgcaggaccccttcaccctgtgcctggccaacgtgcccggccagcccgacctgagacacatcgtgatcgacggcagcaacgtggccatggtgcacggcctgcagcactacttcagcagcagaggcatcgccatcgccgtgcagtacttctgggacagaggccacagagacatcaccgtgttcgtgccccagtggagattcagcaaggacgccaaggtgagagagagccacttcctgcagaagctgtacagcctgagcctgctgagcctgacccccagcagagtgatggacggcaagagaatcagcagctacgacgacagattcatggtgaagctggccgaggagaccgacggcatcatcgtgagcaacgaccagttcagagacctggccgaggagagcgagaagtggatggccatcatcagagagagactgctgcccttcaccttcgtgggcaacctgttcatggtgcccgacgaccccctgggcagaaacggccccaccctggacgagttcctgaagaagcccgccagaacccagggcagcagcaaggcccagcaccccagcagaggcttcgccgagcacggcaagcagcagcagggcagagaggaggagaagggcagcggcggcatcagaaagaccagagagaccgagagactgagaagacagctgctggaggtgttctggggccaggaccacaaggtggacttcatcctgcagagagagccctactgcagagacatcaaccagctgagcgaggccctgctgagcctgaacttctag

SEQ ID NO: 22005 - DNA, 2037 bp, Artificial Sequence; identical to SEQ ID NO: 22004
  Description of Artificial Sequence: Synthetic coding sequence

SEQ ID NO: 22006 - DNA, 408 bp, Artificial Sequence
  Description of Artificial Sequence: Synthetic coding sequence
atgcccacctggggcgccagacccgccagccccgacagattcgccgtgagcgccgaggccgagaacaaggtgagagagcagcagccccacgtggagagaatcttcagcgtgggcgtgagcgtgctgcccaaggactgccccgacaacccccacatctggctgcagctggagggccccaaggagaacgccagcagagccaaggagtacctgaagggcctgtgcagccccgagctgcaggacgagatccactacccccccaagctgcactgcatcttcctgggcgcccagggcttcttcctggactgcctggcctggagcaccagcgcccacctggtgcccagagcccccggcagcctgatgatcagcggcctgaccgaggccttcgtgatggcccagagcagagtgtag

SEQ ID NO: 22007 - DNA, 2037 bp, Artificial Sequence; identical to SEQ ID NO: 22004
  Description of Artificial Sequence: Synthetic coding sequence

SEQ ID NO: 22008 - DNA, 387 bp, Artificial Sequence
  Description of Artificial Sequence: Synthetic coding sequence
atggccgtgggcaccagcgccctgagcaaggagccctggtggaccctgcccgagaacttccacagccccatggtgttccacatggaggaggaccaggaggagctgatcttcggcctggacgacacctacctgagatgcatcgagctgcacagccacaccctgatccagctggagagatgcttcaccgccaccggccagaccagagtgaccgtggtgggcccccccatggccaagcagtggctgctgctgatgttccactgcgtgggcagccaggacagcaagtgccacgccagaggcctgaagatgctggagagagtgagaagccagcccctgaccaacgacgacctggtgaccagcgtgagcctgcccccctacaccggcgactag

SEQ ID NO: 22009 - DNA, 1251 bp, Artificial Sequence
  Description of Artificial Sequence: Synthetic coding sequence
atgagccccagccacgtggtggtgaacgtgagcaccgccagaagcggccccctgaccaccagcagcgcccccgtgagcagagccgagagcctgagacccggcagcagaagctgcaccatgagcatgagccccaccgtgatcatcctggcctgcctgggcttcttcctggaccagagcgtgtgggcccacgtgggcggccaggacaagcccttctgcagcgcctggcccagcgccgtggtgccccagggcggccacgtgaccctgagatgccactgcagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcaaccccagcagcagctggcccagccccaccgagcccagcttcaagaccggcatcgccagacacctgcacgccgtgatcagatacagcgtggccatcatcctgttcaccatcctgcccttcttcctgctgcacagatggtgcagcaagaagaagaacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 22010 - DNA, 915 bp, Artificial Sequence
  Description of Artificial Sequence: Synthetic coding sequence
atgagcctgatggtggtgagcatggcctgcgtgggcttcttcctgctgcagggcgcctggccccacgagggcgtgcacagaaagcccagcctgctggcccaccccggccccctggtgaagagcgaggagaccgtgatcctgcagtgctggagcgacgtgagattcgagcacttcctgctgcacagagagggcaagtacaaggacaccctgcacctgatcggcgagcaccacgacggcgtgagcaaggccaacttcagcatcggccccatgatgcaggacctggccggcacctacagatgctacggcagcgtgacccacagcccctaccagctgagcgcccccagcgaccccctggacatcgtgatcaccggcctgtacgagaagcccagcctgagcgcccagcccggccccaccgtgctggccggcgagagcgtgaccctgagctgcagcagcagaagcagctacgacatgtaccacctgagcagagagggcgaggcccacgagagaagattcagcgccggccccaaggtgaacggcaccttccaggccgacttccccctgggccccgccacccacggcggcacctacagatgcttcggcagcttcagagacagcccctacgagtggagcaacagcagcgaccccctgctggtgagcgtgaccggcaaccccagcaacagctggcccagccccaccgagcccagcagcaagaccggcaaccccagacacctgcacgtgctgatcggcaccagcgtggtgaagatccccttcaccatcctgctgttcttcctgctgcacagatggtgcagcaacaagaagaacgccgccgtgatggaccaggagcccgccggcaacagaaccgtgaacagcgaggacagcgacgagcaggaccaccaggaggtgagctacgcctag

SEQ ID NO: 22011 - DNA, 915 bp, Artificial Sequence; identical to SEQ ID NO: 22010
  Description of Artificial Sequence: Synthetic coding sequence

SEQ ID NO: 22012 - DNA, 867 bp, Artificial Sequence
  Description of Artificial Sequence: Synthetic coding sequence
atggcctgcgtggccttcttcctgctgcagggcgcctggccccacgagggcttcagaagaaagcccagcctgctggcccaccccggccccctggtgaagagcgaggagaccgtgatcctgcagtgctggagcgacgtgatgttcgagcacttcctgctgcacagagagggcaccttcaaccacaccctgagactgatcggcgagcacatcgacggcgtgagcaagggcaacttcagcatcggcagaatgacccaggacctggccggcacctacagatgctacggcagcgtgacccacagcccctaccagctgagcgcccccagcgaccccctggacatcgtgatcaccggcctgtacgagaagcccagcctgagcgcccagcccggccccaccgtgctggccggcgagagcgtgaccctgagctgcagcagcagaagcagctacgacatgtaccacctgagcagagagggcgaggcccacgagagaagactgcccgccggccccaaggtgaacagaaccttccaggccgacttccccctggaccccgccacccacggcggcacctacagatgcttcggcagcttcagagacagcccctacgagtggagcaagagcagcgaccccctgctggtgagcgtgaccggcaacagcagcaacagctggcccagccccaccgagcccagcagcgagaccggcaaccccagacacctgcacgtgctgatcggcaccagcgtggtgaagctgcccttcaccatcctgctgttcttcctgctgcacagatggtgcagcaacaagaagaacgccagcgtgatggaccagggccccgccggcaacagaaccgtgaacagagaggacagcgacgagtag

SEQ ID NO: 22013 - DNA, 666 bp, Artificial Sequence
  Description of Artificial Sequence: Synthetic coding sequence
atgagcctgaccgtggtgagcatggcctgcgtgggcttcttcctgctgcagggcgcctggcccctgatgggcaaccacagaaagcccagcctgctggcccaccccggccccctgctgaagagcggcgagaccgtgatcctgcagtgctggagcgacgtgatgttcgagcacttcttcctgcacagagagggcatcagcgaggaccccagcagactggtgggccagatccacgacggcgtgagcaaggccaacttcagcatcggccccctgatgcccgtgctggccggcacctacagatgctacggcagcgtgccccacagcccctaccagctgagcgcccccagcgaccccctggacatcgtgatcaccggcctgtacgagaagcccagcctgagcgcccagcccggccccaccgtgcaggccggcgagaacgtgaccctgagctgcagcagctggagcagctacgacatctaccacctgagcagagagggcgaggcccacgagagaagactgagagccgtgcccaaggtgaacagaaccttccaggccgacttccccctgggccccgccacccacggcggcacctacagatgcttcggcagcttcagagccctgccctgcgtgtggagcaacagcagcgaccccctgctggtgagcgtgacctag

SEQ ID NO: 22014 - DNA, 1002 bp, Artificial Sequence
  Description of Artificial Sequence: Synthetic coding sequence
atgagcctgaccgtggtgagcatggcctgcgtgggcttcttcctgctgcagggcgcctggcccctgatgggcggccaggacaagcccttcctgagcgccagacccagcaccgtggtgcccagaggcggccacgtggccctgcagtgccactacagaagaggcttcaacaacttcatgctgtacaaggaggacagaagccacgtgcccatcttccacggcagaatcttccaggagagcttcatcatgggccccgtgacccccgcccacgccggcacctacagatgcagaggcagcagaccccacagcctgaccggctggagcacccccagcaaccccctggtgatcatggtgaccggcaaccacagaaagcccagcctgctggcccaccccggccccctgctgaagagcggcgagaccgtgatcctgcagtgctggagcgacgtgatgttcgagcacttcttcctgcacagagagggcatcagcgaggaccccagcagactggtgggccagatccacgacggcgtgagcaaggccaacttcagcatcggccccctgatgcccgtgctggccggcacctacagatgctacggcagcgtgccccacagcccctaccagctgagcgcccccagcgaccccctggacatcgtgatcaccggcctgtacgagaagcccagcctgagcgcccagcccggccccaccgtgcaggccggcgagaacgtgaccctgagctgcagcagctggagcagctacgacatctaccacctgagcagagagggcgaggcccacgagagaagactgagagccgtgcccaaggtgaacagaaccttccaggccgacttccccctgggccccgccacccacggcggcacctacagatgcttcggcagcttcagagccctgccctgcgtgtggagcaacagcagcgaccccctgctggtgagcgtgaccggcaaccccagcagcagctggcccagccccaccgagcccagcagcaagagctag

SEQ ID NO: 22015 - DNA, 5250 bp, Artificial Sequence
  Description of Artificial Sequence: Synthetic coding sequence
atgcaggccatggaccccgccgccgccgacctgtacgaggaggacggcaaggacctggacttctacgacttcgagcccctgcccaccctgcccgaggacgaggagaacgtgagcctggccgacatcctgagcctgagagacagaggcctgagcgagcaggaggcctgggccgtgtgcctggagtgcagcctgagcatgagaagcgtggcccacgccgccatcttccagagcctgtgcatcacccccgacaccctggccttcaacaccagcggcaacgtgtgcttcatggagcagctgagcgacgaccccgagggcgccttcgtgccccccgagttcgacgtgaccggcaacaccttcgaggcccacatctacagcctgggcgccaccctgaaggccgccctggagtacgtggccgagcccaccctggagcccagactgagccaggacctggaggccctgctgagcagaatgcaggccgaggaccccggcgacagacccgacctggagagcatcatcgccctgtgcgaggagaagctgcagctgaccagcagctgcagagtgtgcagaagcctgagcgccgtgggcagaagagtgctgagcatcgagagcttcggcgccctgcaggacgtgagcgagagcagctggagagagagacccgcccccggcaacgccggccccagaagaccccccggcgaccccagcaccgaccccgaggtgctgcccacccccgagggccccgagagcgagaccagcagaggccccagagccagccccaccaaggccctgctgagcacccccgtgagaaacggcgagagccacagcagagagggcctggccggcctggtgctggacgccgagagaaccctgggcgagctggacagagacgccctgagaagaagcagactgagaaaggtgcagaccttccccagactgctgagcgacagccccgaggccaccctgtgcctgcccctgaccagaggcaagagccagctgcccatcagcgagctgttcagccccgaccccagaaaggccttcctggacagaaagaacggcctgagcagcttccaggcccagcccaagtgcagactgtggcccgagcaggagcccgagcaccagctgggcagagtgccctgcgccggcagaagcaccgacagaggccccggcgtgcccggcagccccggccagcccgagaccagccaccccagccagggccccgccgaggcccccgccgaccccagagacgccagcggcgaggcccagacccccagagacgacgagagaatccccgagggcgccagacagctggagagcgccgccgccgagcagtgggtgagcctgcaggacctgctgagccagctgggcagacccttcagagagtacgagctgtgggccctgtgcctggcctgcctgagagccctgcagaccagacccgagcaccccgcctacctgtgcctggacagcgtgctggtggccgaggacggcgccgtgctgttccagcccccccccgccaacggcagctacgacagcttcttcctggcccccgagctggccgaggagagactggtgaccgagaaggccagcgtgtactgcgtggccgccgtgctgtggaccgccgccaagttcagcgtgcccagaaaccacaagctggccctgcccagaagactgaagaccctgctgctggacatggccagaagaagcgcccccgagagacccagcgccgccgaggccatcaaggtgtgcggcagctacctgctgcagagaggcatggacagcagaaagatcctggcccacctgagagccagcatctgccaggtgtaccaggaggaggagaccatcagcctgcagaacgccttcagcgtggtggagctgaagcccagcgtggcccccgcccccgagcccagccccggcttcctgcccgtgaacagcgacaccggcctggtggccgtgcccggccccgtgcccggccagcacccctgcggcgaggaggccacccagctgcccgccgccttcaccagcgaggccacccacttcaagcccatcgtgctggcccagaacgccagcgtggccagagaccagcccgccctggcccaggaggagagcgaggagagaggcggccagagagagggcgagggcgaggagaagctgagcctggaggcccacgccggcagccccagcctgaagacccccgacggccccgtgcccggccccggcccccagggcgccgcccccgagcccctgggcgccagcgtgcagagagacagcgcccagggcagaccctgcccccccccccaggcccccgccaaccagcccgagggcgccagcagcgccgcccccggcagccccgtgcccgccccccccaccaaggccagcgccctgcccgtggagcagggccccgccgagcccatcccccccggcgtggccagcggcggcctgagacccgacgccctgggccccaccaccgcccaccacggccccagacacccccccaagccccccagaagcaaggccaccgagagacccggccaggagcccgagggccccggcgccacccccgccggcgagagagacgaccagagccccgacagcgtgcccgagagacccagacccgccgacagaagactgtgcctgccctgcgtggacgccagccccctgcccggcagaaccgcctgccccagcctgcaggaggccaccagactgatccaggaggagttcgccttcgacggctacctggacaacggcctggaggccctgatcatgggcgagtacatcttcgccctgaaggacctgaccttcgccaccttctgcggcgccatcagcgagaagttctgcgacctgtactgggacgagaagctgctgcagaacctgttcaaggtggtgaacggccaggccagccccagccccagcaccgccgaggaggccggcagccagctggagggcagccagagccccagaagccccagcagcaagagacccagcctgcacagactgggcaaggagaagcccgccatggccagaaccagcagcagagccccctgcagccccaccagcgtgagcgacgtggacagcgacgccctgagcagaggcaacttcgaggtgggcttcagaccccagagaagcgtgaaggccgagagagcccagcagcccgaggccggcgaggacagaagacccgccggcggcgccagcgacgtggaggccgtgaccagactggccagaagcaagggcgtgggccccgccctgagccccggccccgccggcttccagagctgcagccccggctggtgcagcgccttctacgaggccgactgcttcggcgccgacgtgcacaactacgtgaaggacctgggcagacagcaggccgacggcgccctgcccgacgcccagagccccgagctggagcagcagctgatgatggagaagagaaactacagaaagaccctgaagttctaccagaagctgctgcagaaggagaagagaaacaagggcagcgacgtgaagaccatgctgagcaagctgaagggccagctggaggagatgaagagcagagtgcagttcctgagcctggtgaagaagtacctgcaggtgatgtacgccgagagatggggcctggagccctgcaccctgcccgtgatcgtgaacatcgccgccgccccctgcgacaccctggacttcagccccctggacgagagcagcagcctgatcttctacaacgtgaacaagcaccccggcggcagacagaaggccagaatcctgcaggccggcacccccctgggcctgatggcctacctgtacagcagcgacgccttcctggagggctacgtgcagcagttcctgtacaccttcagatacttctgcaccccccacgacttcctgcacttcctgctggacagaatcaacagcaccctgaccagagcccaccaggaccccaccagcaccttcaccaagatctacagaagaagcctgtgcgtgctgcaggcctgggtggaggactgctacgccgtggacttccccagaaacagcggcctgctgggcaagctggaggacttcatcagcagcaagatcctgcccctggacggcagcgccaagcacctgctgggcctgctggaggtgggcatggacagaagagccgagggcaaccccagaggcaccgacctggagaaccccagagaggccgaggaggacgccagacccttcaacgccctgtgcaagagactgagcgaggacggcatcagcagaaagagcttcccctggagactgcccagaggcaacggcctggtgctgcccccccacaaggagagaccctacaccatcgccgccgccctgcccaagccctgcttcctggaggacttctacggcccctgcgccaagaccagcgagaagggcccctacttcctgaccgagtacagcacccaccagctgttcagccagctgaccctgctgcagcaggagctgttccagaagtgccaccccgtgcacttcctgaacagcagagccctgggcgtgatggacaagagcaccgccatccccaaggccagcagcagcgagagcctgagcgccaagacctgcagcctgttcctgcccaactacgtgcaggacaagtacctgctgcagctgctgagaaacgccgacgacgtgagcacctgggtggccgccgagatcgtgaccagccacaccagcaagctgcaggtgaacctgctgagcaagttcctgctgatcgccaagagctgctacgagcagagaaacttcgccaccgccatgcagatcctgagcggcctggagcacctggccgtgagacagagccccgcctggagaatcctgcccgccaagatcgccgaggtgatggaggagctgaaggccgtggaggtgttcctgaagagcgacagcctgtgcctgatggagggcagaagattcagagcccagcccaccctgcccagcgcccacctgctggccatgcacatccagcagctggagaccggcggcttcaccatgaccaacggcgcccacagatggagcaagctgagaaacatcgccaaggtggtgagccaggtgcacgccttccaggagaacccctacaccttcagccccgaccccaagctgcagagctacctgaagcagagaatcgccagattcagcggcgccgacatcagcaccctggccgccgacagcagagccaacttccaccaggtgagcagcgagaagcacagcagaaagatccaggacaagctgagaagaatgaaggccaccttccagtag

SEQ ID NO: 22016 - DNA, 5256 bp, Artificial Sequence
  Description of Artificial Sequence: Synthetic coding sequence
atgcaggccatggaccccgccgccgccgacctgtacgaggaggacggcaaggacctggacttctacgacttcgagcccctgcccaccctgcccgaggacgaggagaacgtgagcctggccgacatcctgagcctgagagacagaggcctgagcgagcaggaggcctgggccgtgtgcctggagtgcagcctgagcatgagaagcgtggcccacgccgccatcttccagagcctgtgcatcacccccgacaccctggccttcaacaccagcggcaacgtgtgcttcatggagcagctgagcgacgaccccgagggcgccttcgtgccccccgagttcgacgtgaccggcaacaccttcgaggcccacatctacagcctgggcgccaccctgaaggccgccctggagtacgtggccgagcccaccctggagcccagactgagccaggacctggaggccctgctgagcagaatgcaggccgaggaccccggcgacagacccgacctggagagcatcatcgccctgtgcgaggagaagctgcagctgaccagcagctgcagagtgtgcagaagcctgagcgccgtgggcagaagagtgctgagcatcgagagcttcggcgccctgcaggacgtgagcgagagcagctggagagagagacccgcccccggcaacgccggccccagaagaccccccggcgaccccagcaccgaccccgaggtgctgcccacccccgagggccccgagagcgagaccagcagaggccccagagccagccccaccaaggccctgctgagcacccccgtgagaaacggcgagagccacagcagagagggcctggccggcctggtgctggacgccgagagaaccctgggcgagctggacagagacgccctgagaagaagcagactgagaaaggtgcagaccttccccagactgctgagcgacagccccgaggccaccctgtgcctgcccctgaccagaggcaagagccagctgcccatcagcgagctgttcagccccgaccccagaaaggccttcctggacagaaagaacggcctgagcagcttccaggcccagcccaagtgcagactgtggcccgagcaggagcccgagcaccagctgggcagagtgccctgcgccggcagaagcaccgacagaggccccggcgtgcccggcagccccggccagcccgagaccagccaccccagccagggccccgccgaggcccccgccgaccccagagacgccagcggcgaggcccagacccccagagacgacgagagaatccccgagggcgccagacagctggagagcgccgccgccgagcagtgggtgagcctgcaggacctgctgagccagctgggcagacccttcagagagtacgagctgtgggccctgtgcctggcctgcctgagagccctgcagaccagacccgagcaccccgcctacctgtgcctggacagcgtgctggtggccgaggacggcgccgtgctgttccagcccccccccgccaacggcagctacgacagcttcttcctggcccccgagctggccgaggagagactggtgaccgagaaggccagcgtgtactgcgtggccgccgtgctgtggaccgccgccaagttcagcgtgcccagaaaccacaagctggccctgcccagaagactgaagaccctgctgctggacatggccagaagaagcgcccccgagagacccagcgccgccgaggccatcaaggtgtgcggcagctacctgctgcagagaggcatggacagcagaaagatcctggcccacctgagagccagcatctgccaggtgtaccaggaggaggagaccatcagcctgcagaacgccttcagcgtggtggagctgaagcccagcgtggcccccgcccccgagcccagccccggcttcctgcccgtgaacagcgacaccggcctggtggccgtgcccggccccgtgcccggccagcacccctgcggcgaggaggccacccagctgcccgccgccttcaccagcgaggccacccacttcaagcccatcgtgctggcccagaacgccagcgtggccagagaccagcccgccctggcccaggaggagagcgaggagagaggcggccagagagagggcgagggcgaggagaagctgagcctggaggcccacgccggcagccccagcctgaagacccccgacggccccgtgcccggccccggcccccagggcgccgcccccgagcccctgggcgccagcgtgcagagagacagcgcccagggcagaccctgcccccccccccaggcccccgccaaccagcccgagggcgccagcagcgccgcccccggcagccccgtgcccgccccccccaccaaggccagcgccctgcccgtggagcagggccccgccgagcccatcccccccggcgtggccagcggcggcctgagacccgacgccctgggccccaccaccgcccaccacggccccagacacccccccaagccccccagaagcaaggccaccgagagacccggccaggagcccgagggccccggcgccacccccgccggcgagagagacgaccagagccccgacagcgtgcccgagagacccagacccgccgacagaagactgtgcctgccctgcgtggacgccagccccctgcccggcagaaccgcctgccccagcctgcaggaggccaccagactgatccaggaggagttcgccttcgacggctacctggacaacggcctggaggccctgatcatggagcccggcgagtacatcttcgccctgaaggacctgaccttcgccaccttctgcggcgccatcagcgagaagttctgcgacctgtactgggacgagaagctgctgcagaacctgttcaaggtggtgaacggccaggccagccccagccccagcaccgccgaggaggccggcagccagctggagggcagccagagccccagaagccccagcagcaagagacccagcctgcacagactgggcaaggagaagcccgccatggccagaaccagcagcagagccccctgcagccccaccagcgtgagcgacgtggacagcgacgccctgagcagaggcaacttcgaggtgggcttcagaccccagagaagcgtgaaggccgagagagcccagcagcccgaggccggcgaggacagaagacccgccggcggcgccagcgacgtggaggccgtgaccagactggccagaagcaagggcgtgggccccgccctgagccccggccccgccggcttccagagctgcagccccggctggtgcagcgccttctacgaggccgactgcttcggcgccgacgtgcacaactacgtgaaggacctgggcagacagcaggccgacggcgccctgcccgacgcccagagccccgagctggagcagcagctgatgatggagaagagaaactacagaaagaccctgaagttctaccagaagctgctgcagaaggagaagagaaacaagggcagcgacgtgaagaccatgctgagcaagctgaagggccagctggaggagatgaagagcagagtgcagttcctgagcctggtgaagaagtacctgcaggtgatgtacgccgagagatggggcctggagccctgcaccctgcccgtgatcgtgaacatcgccgccgccccctgcgacaccctggacttcagccccctggacgagagcagcagcctgatcttctacaacgtgaacaagcaccccggcggcagacagaaggccagaatcctgcaggccggcacccccctgggcctgatggcctacctgtacagcagcgacgccttcctggagggctacgtgcagcagttcctgtacaccttcagatacttctgcaccccccacgacttcctgcacttcctgctggacagaatcaacagcaccctgaccagagcccaccaggaccccaccagcaccttcaccaagatctacagaagaagcctgtgcgtgctgcaggcctgggtggaggactgctacgccgtggacttccccagaaacagcggcctgctgggcaagctggaggacttcatcagcagcaagatcctgcccctggacggcagcgccaagcacctgctgggcctgctggaggtgggcatggacagaagagccgagggcaaccccagaggcaccgacctggagaaccccagagaggccgaggaggacgccagacccttcaacgccctgtgcaagagactgagcgaggacggcatcagcagaaagagcttcccctggagactgcccagaggcaacggcctggtgctgcccccccacaaggagagaccctacaccatcgccgccgccctgcccaagccctgcttcctggaggacttctacggcccctgcgccaagaccagcgagaagggcccctacttcctgaccgagtacagcacccaccagctgttcagccagctgaccctgctgcagcaggagctgttccagaagtgccaccccgtgcacttcctgaacagcagagccctgggcgtgatggacaagagcaccgccatccccaaggccagcagcagcgagagcctgagcgccaagacctgcagcctgttcctgcccaactacgtgcaggacaagtacctgctgcagctgctgagaaacgccgacgacgtgagcacctgggtggccgccgagatcgtgaccagccacaccagcaagctgcaggtgaacctgctgagcaagttcctgctgatcgccaagagctgctacgagcagagaaacttcgccaccgccatgcagatcctgagcggcctggagcacctggccgtgagacagagccccgcctggagaatcctgcccgccaagatcgccgaggtgatggaggagctgaaggccgtggaggtgttcctgaagagcgacagcctgtgcctgatggagggcagaagattcagagcccagcccaccctgcccagcgcccacctgctggccatgcacatccagcagctggagaccggcggcttcaccatgaccaacggcgcccacagatggagcaagctgagaaacatcgccaaggtggtgagccaggtgcacgccttccaggagaacccctacaccttcagccccgaccccaagctgcagagctacctgaagcagagaatcgccagattcagcggcgccgacatcagcaccctggccgccgacagcagagccaacttccaccaggtgagcagcgagaagcacagcagaaagatccaggacaagctgagaagaatgaaggccaccttccagtag

SEQ ID NO: 22017 - DNA, 561 bp, Artificial Sequence
  Description of Artificial Sequence: Synthetic coding sequence
tgagacctgagcaagagcagagagaacctgagcgccgtgatgctgtacaaccccggcctgttccccatcaagggccccatctgcctgagactggagttcgagagacagcagagagaggagctggagaagctggagagcaagagaaagctgatcgaggagatggaggagaagcagaagagcgacaaggccgagctggagagaatgcagcaggaggtggagacccagagaaaggagaccgagatcgtgcagctgcagatcagaaagcaggaggagagcctgaagagaagaagcttccacatcgagaacaagctgaaggacctgctggccgagaaggagaagttcgaggaggagagactgagagagcagcaggagatcgagctgcagaagaagagacaggaggaggagaccttcctgagagtgcaggaggagctgcagagactgaaggagctgaacaacaacgagaaggccgagaagttccagatcttccaggagctggaccagctgcagaaggagaaggacgagcagtacgccaagctggagctggagaagaagagactgtag

SEQ ID NO: 22018 - DNA, 2874 bp, Artificial Sequence
  Description of Artificial Sequence: Synthetic coding sequence
atggccgaccccgccgagtgcagcatcaaggtgatgtgcagattcagacccctgaacgaggccgagatcctgagaggcgacaagttcatccccaagttcaagggcgacgagaccgtggtgatcggccagggcaagccctacgtgttcgacagagtgctgccccccaacaccacccaggagcaggtgtacaacgcctgcgccaagcagatcgtgaaggacgtgctggagggctacaacggcaccatcttcgcctacggccagaccagcagcggcaagacccacaccatggagggcaagctgcacgacccccagctgatgggcatcatccccagaatcgcccacgacatcttcgaccacatctacagcatggacgagaacctggagttccacatcaaggtgagctacttcgagatctacctggacaagatcagagacctgctggacgtgagcaagaccaacctggccgtgcacgaggacaagaacagagtgccctacgtgaagggctgcaccgagagattcgtgagcagccccgaggaggtgatggacgtgatcgacgagggcaaggccaacagacacgtggccgtgaccaacatgaacgagcacagcagcagaagccacagcatcttcctgatcaacatcaagcaggagaacgtggagaccgagaagaagctgagcggcaagctgtacctggtggacctggccggcagcgagaaggtgagcaagaccggcgccgagggcgccgtgctggacgaggccaagaacatcaacaagagcctgagcgccctgggcaacgtgatcagcgccctggccgagggcaccaagacccacgtgccctacagagacagcaagatgaccagaatcctgcaggacagcctgggcggcaactgcagaaccaccatcgtgatctgctgcagccccagcgtgttcaacgaggccgagaccaagagcaccctgatgttcggccagagagccaagaccatcaagaacaccgtgagcgtgaacctggagctgaccgccgaggagtggaagaagaagtacgagaaggagaaggagaagaacaagaccctgaagaacgtgatccagcacctggagatggagctgaacagatggagaaacggcgaggccgtgcccgaggacgagcagatcagcgccaaggaccagaagaacctggagccctgcgacaacacccccatcatcgacaacatcgcccccgtggtggccggcatcagcaccgaggagaaggagaagtacgacgaggagatcagcagcctgtacagacagctggacgacaaggacgacgagatcaaccagcagagccagctggccgagaagctgaagcagcagatgctggaccaggacgagctgctggccagcaccagaagagactacgagaagatccaggaggagctgaccagactgcagatcgagaacgaggccgccaaggacgaggtgaaggaggtgctgcaggccctggaggagctggccgtgaactacgaccagaagagccaggaggtggaggacaagaccagagccaacgagcagctgaccgacgagctggcccagaagaccaccaccctgaccaccacccagagagagctgagccagctgcaggagctgagcaaccaccagaagaagagagccaccgagatcctgaacctgctgctgaaggacctgggcgagatcggcggcatcatcggcaccaacgacgtgaagaccctggccgacgtgaacggcgtgatcgaggaggagttcaccatggccagactgtacatcagcaagatgaagagcgaggtgaagagcctggtgaacagaagcaagcagctggagagcgcccagatggacagcaacagaaagatgaacgccagcgagagagagctggccgcctgccagctgctgatcagccagcacgaggccaagatcaagagcctgaccgactacatgcagaacatggagcagaagagaagacagctggaggagagccaggacagcctgagcgaggagctggccaagctgagagcccaggagaagatgcacgaggtgagcttccaggacaaggagaaggagcacctgaccagactgcaggacgccgaggagatgaagaaggccctggagcagcagatggagagccacagagaggcccaccagaagcagctgagcagactgagagacgagatcgaggagaagcagaagatcatcgacgagatcagagacctgaaccagaagctgcagctggagcaggagaagctgagcagcgactacaacaagctgaagatcgaggaccaggagagagagatgaagctggagaagctgctgctgctgaacgacaagagagagcaggccagagaggacctgaagggcctggaggagaccgtgagcagagagctgcagaccctgcacaacctgagaaagctgttcgtgcaggacctgaccaccagagtgaagaagagcgtggagctggacaacgacgacggcggcggcagcgccgcccagaagcagaagatcagcttcctggagaacaacctggagcagctgaccaaggtgcacaagcagctggtgagagacaacgccgacctgagatgcgagctgcccaagctggagaagagactgagagccaccgccgagagagtgaaggccctggagagcgccctgaaggaggccaaggagaacgccatgagagacagaaagagataccagcaggaggtggacagaatcaaggaggccgtgagagccaagaacatggccagaagagcccacagcgcccagatcgccaagcccatcagacccggccactaccccgccagcagccccaccgccgtgcacgccatcagaggcggcggcggcagcagcagcaacagcacccactaccagaagtag

SEQ ID NO: 22019 - DNA, 2064 bp, Artificial Sequence
  Description of Artificial Sequence: Synthetic coding sequence
atggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgtgttccaggaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcgcctag

SEQ ID NO: 22020 - DNA, 2556 bp, Artificial Sequence
  Description of Artificial Sequence: Synthetic coding sequence
atggcccaggtgctgcacgtgcccgcccccttccccggcacccccggccccgccagcccccccgccttccccgccaaggaccccgaccccccctacagcgtggagaccccctacggctacagactggacctggacttcctgaagtacgtggacgacatcgagaagggccacaccctgagaagagtggccgtgcagagaagacccagactgagcagcctgcccagaggccccggcagctggtggaccagcaccgagagcctgtgcagcaacgccagcggcgacagcagacacagcgcctacagctactgcggcagaggcttctacccccagtacggcgccctggagaccagaggcggcttcaaccccagagtggagagaaccctgctggacgccagaagaagactggaggaccaggccgccacccccaccggcctgggcagcctgacccccagcgccgccggcagcaccgccagcctggtgggcgtgggcctgcccccccccacccccagaagcagcggcctgagcacccccgtgccccccagcgccggccacctggcccacgtgagagagcagatggccggcgccctgagaaagctgagacagctggaggagcaggtgaagctgatccccgtgctgcaggtgaagctgagcgtgctgcaggaggagaagagacagctgaccgtgcagctgaagagccagaagttcctgggccaccccaccgccggcagaggcagaagcgagctgtgcctggacctgcccgacccccccgaggaccccgtggccctggagaccagaagcgtgggcacctgggtgagagagagagacctgggcatgcccgacggcgaggccgccctggccgccaaggtggccgtgctggagacccagctgaagaaggccctgcaggagctgcaggccgcccaggccagacaggccgacccccagccccaggcctggcccccccccgacagccccgtgagagtggacaccgtgagagtggtggagggccccagagaggtggaggtggtggccagcaccgccgccggcgcccccgcccagagagcccagagcctggagccctacggcaccggcctgagagccctggccatgcccggcagacccgagagcccccccgtgttcagaagccaggaggtggtggagaccatgtgccccgtgcccgccgccgccaccagcaacgtgcacatggtgaagaagatcagcatcaccgagagaagctgcgacggcgccgccggcctgcccgaggtgcccgccgagagcagcagcagcccccccggcagcgaggtggccagcctgacccagcccgagaagagcaccggcagagtgcccacccaggagcccacccacagagagcccaccagacaggccgccagccaggagagcgaggaggccggcggcaccggcggcccccccgccggcgtgagaagcatcatgaagagaaaggaggaggtggccgaccccaccgcccacagaagaagcctgcagttcgtgggcgtgaacggcggctacgagagcagcagcgaggacagcagcaccgccgagaacatcagcgacaacgacagcaccgagaacgaggcccccgagcccagagagagagtgcccagcgtggccgaggccccccagctgagacccgccggcaccgccgccgccaagaccagcagacaggagtgccagctgagcagagagagccagcacatccccaccgccgagggcgccagcggcagcaacaccgaggaggagatcagaatggagctgagccccgacctgatcagcgcctgcctggccctggagaagtacctggacaaccccaacgccctgaccgagagagagctgaaggtggcctacaccaccgtgctgcaggagtggctgagactggcctgcagaagcgacgcccaccccgagctggtgagaagacacctggtgaccttcagagccatgagcgccagactgctggactacgtggtgaacatcgccgacagcaacggcaacaccgccctgcactacagcgtgagccacgccaacttccccgtggtgcagcagctgctggacagcggcgtgtgcaaggtggacaagcagaacagagccggctacagccccatcatgctgaccgccctggccaccctgaagacccaggacgacatcgagaccgtgctgcagctgttcagactgggcaacatcaacgccaaggccagccaggccggccagaccgccctgatgctggccgtgagccacggcagagtggacgtggtgaaggccctgctggcctgcgaggccgacgtgaacgtgcaggacgacgacggcagcaccgccctgatgtgcgcctgcgagcacggccacaaggagatcgccggcctgctgctggccgtgcccagctgcgacatcagcctgaccgacagagacggcagcaccgccctgatggtggccctggacgccggccagagcgagatcgccagcatgctgtacagcagaatgaacatcaagtgcagcttcgcccccatgagcgacgacgagagccccaccagcagcagcgccgaggagtag

SEQ ID NO: 22021 - DNA, 2580 bp, Artificial Sequence
  Description of Artificial Sequence: Synthetic coding sequence
atggcccaggtgctgcacgtgcccgcccccttccccggcacccccggccccgccagcccccccgccttccccgccaaggaccccgaccccccctacagcgtggagaccccctacggctacagactggacctggacttcctgaagtacgtggacgacatcgagaagggccacaccctgagaagagtggccgtgcagagaagacccagactgagcagcctgcccagaggccccggcagctggtggaccagcaccgagagcctgtgcagcaacgccagcggcgacagcagacacagcgcctacagctactgcggcagaggcttctacccccagtacggcgccctggagaccagaggcggcttcaaccccagagtggagagaaccctgctggacgccagaagaagactggaggaccaggccgccacccccaccggcctgggcagcctgacccccagcgccgccggcagcaccgccagcctggtgggcgtgggcctgcccccccccacccccagaagcagcggcctgagcacccccgtgccccccagcgccggccacctggcccacgtgagagagcagatggccggcgccctgagaaagctgagacagctggaggagcaggtgaagctgatccccgtgctgcaggtgaagctgagcgtgctgcaggaggagaagagacagctgaccgtgcagctgaagagccagaagttcctgggccaccccaccgccggcagaggcagaagcgagctgtgcctggacctgcccgacccccccgaggaccccgtggccctggagaccagaagcgtgggcacctgggtgagagagagagacctgggcatgcccgacggcgaggccgccctggccgccaaggtggccgtgctggagacccagctgaagaaggccctgcaggagctgcaggccgcccaggccagacaggccgacccccagccccaggcctggcccccccccgacagccccgtgagagtggacaccgtgagagtggtggagggccccagagaggtggaggtggtggccagcaccgccgccggcgcccccgcccagagagcccagagcctggagccctacggcaccggcctgagagccctggccatgcccggcagacccgagagcccccccgtgttcagaagccaggaggtggtggagaccatgtgccccgtgcccgccgccgccaccagcaacgtgcacatggtgaagaagatcagcatcaccgagagaagctgcgacggcgccgccggcctgcccgaggtgcccgccgagagcagcagcagcccccccggcagcgaggtggccagcctgacccagcccgagaagagcaccggcagagtgcccacccaggagcccacccacagagagcccaccagacaggccgccagccaggagagcgaggaggccggcggcaccgccccccccctgagcagcccccccggcggcccccccgccggcgtgagaagcatcatgaagagaaaggaggaggtggccgaccccaccgcccacagaagaagcctgcagttcgtgggcgtgaacggcggctacgagagcagcagcgaggacagcagcaccgccgagaacatcagcgacaacgacagcaccgagaacgaggcccccgagcccagagagagagtgcccagcgtggccgaggccccccagctgagacccgccggcaccgccgccgccaagaccagcagacaggagtgccagctgagcagagagagccagcacatccccaccgccgagggcgccagcggcagcaacaccgaggaggagatcagaatggagctgagccccgacctgatcagcgcctgcctggccctggagaagtacctggacaaccccaacgccctgaccgagagagagctgaaggtggcctacaccaccgtgctgcaggagtggctgagactggcctgcagaagcgacgcccaccccgagctggtgagaagacacctggtgaccttcagagccatgagcgccagactgctggactacgtggtgaacatcgccgacagcaacggcaacaccgccctgcactacagcgtgagccacgccaacttccccgtggtgcagcagctgctggacagcggcgtgtgcaaggtggacaagcagaacagagccggctacagccccatcatgctgaccgccctggccaccctgaagacccaggacgacatcgagaccgtgctgcagctgttcagactgggcaacatcaacgccaaggccagccaggccggccagaccgccctgatgctggccgtgagccacggcagagtggacgtggtgaaggccctgctggcctgcgaggccgacgtgaacgtgcaggacgacgacggcagcaccgccctgatgtgcgcctgcgagcacggccacaaggagatcgccggcctgctgctggccgtgcccagctgcgacatcagcctgaccgacagagacggcagcaccgccctgatggtggccctggacgccggccagagcgagatcgccagcatgctgtacagcagaatgaacatcaagtgcagcttcgcccccatgagcgacgacgagagccccaccagcagcagcgccgaggagtag

SEQ ID NO: 22022 - DNA, 2556 bp, Artificial Sequence; identical to SEQ ID NO: 22020
  Description of Artificial Sequence: Synthetic coding sequence

SEQ ID NO: 22023 - DNA, 2466 bp, Artificial Sequence
  Description of Artificial Sequence: Synthetic coding sequence
atggccaagttcgccctgaaccagaacctgcccgacctgggcggccccagactgtgccccgtgcccgccgccggcggcgccagaagccccagcagcccctacagcgtggagaccccctacggcttccacctggacctggacttcctgaagtacatcgaggagctggagagaggccccgccgccagaagagcccccggcccccccaccagcagaagacccagagcccccagacccggcctggccggcgccagaagccccggcgcctggaccagcagcgagagcctggccagcgacgacggcggcgcccccggcatcctgagccagggcgcccccagcggcctgctgatgcagcccctgagccccagagcccccgtgagaaaccccagagtggagcacaccctgagagagaccagcagaagactggagctggcccagacccacgagagagcccccagccccggcagaggcgtgcccagaagccccagaggcagcggcagaagcagccccgcccccaacctggcccccgccagccccggccccgcccagctgcagctggtgagagagcagatggccgccgccctgagaagactgagagagctggaggaccaggccagaaccctgcccgagctgcaggagcaggtgagagccctgagagccgagaaggccagactgctggccggcagagcccagcccgagcccgacggcgaggccgagaccagacccgacaagctggcccagctgagaagactgaccgagagactggccaccagcgagagaggcggcagagccagagccagccccagagccgacagccccgacggcctggccgccggcagaagcgagggcgccctgcaggtgctggacggcgaggtgggcagcctggacggcaccccccagaccagagaggtggccgccgaggccgtgcccgagaccagagaggccggcgcccaggccgtgcccgagaccagagaggccggcgtggaggccgcccccgagaccgtggaggccgacgcctgggtgaccgaggccctgctgggcctgcccgccgccgccgagagagagctggagctgctgagagccagcctggagcaccagagaggcgtgagcgagctgctgagaggcagactgagagagctggaggaggccagagaggccgccgaggaggccgccgccggcgccagagcccagctgagagaggccaccacccagaccccctggagctgcgccgagaaggccgcccagaccgagagccccgccgaggcccccagcctgacccaggagagcagccccggcagcatggacggcgacagagccgtggcccccgccggcatcctgaagagcatcatgaagaagagagacggcacccccggcgcccagcccagcagcggccccaagagcctgcagttcgtgggcgtgctgaacggcgagtacgagagcagcagcagcgaggacgccagcgacagcgacggcgacagcgagaacggcggcgccgagccccccggcagcagcagcggcagcggcgacgacagcggcggcggcagcgacagcggcacccccggcccccccagcggcggcgacatcagagaccccgagcccgaggccgaggccgagccccagcaggtggcccagggcagatgcgagctgagccccagactgagagaggcctgcgtggccctgcagagacagctgagcagacccagaggcgtggccagcgacggcggcgccgtgagactggtggcccaggagtggttcagagtgagcagccagagaagaagccaggccgagcccgtggccagaatgctggagggcgtgagaagactgggccccgagctgctggcccacgtggtgaacctggccgacggcaacggcaacaccgccctgcactacagcgtgagccacggcaacctggccatcgccagcctgctgctggacaccggcgcctgcgaggtgaacagacagaacagagccggctacagcgccctgatgctggccgccctgaccagcgtgagacaggaggaggaggacatggccgtggtgcagagactgttctgcatgggcgacgtgaacgccaaggccagccagaccggccagaccgccctgatgctggccatcagccacggcagacaggacatggtggccaccctgctggcctgcggcgccgacgtgaacgcccaggacgccgacggcgccaccgccctgatgtgcgccagcgagtacggcagactggacaccgtgagactgctgctgacccagcccggctgcgaccccgccatcctggacaacgagggcaccagcgccctggccatcgccctggaggccgagcaggacgaggtggccgccctgctgcacgcccacctgagcagcggccagcccgacacccagagcgagagcccccccggcagccagaccgccacccccggcgagggcgagtgcggcgacaacggcgagaacccccaggtgcagtag

SEQ ID NO: 22024 - DNA, 633 bp, Artificial Sequence
  Description of Artificial Sequence: Synthetic coding sequence
atggccaccgccagaaccgtggcccccagccccagagtggcccccagagcccccggcatgaccgccgccggcgaccccaccagagcccccctggccctgcccgccgccggcaccagcggcaccctgagccccagaagaagacagagcctgagcagatggcacagaggcggcgagagaagaagcctggtggtgtggagaggcggcggctgccccccccccggcagaagatgccccagaagcatcctgagcctgagctggccccccctgcaggtgagagccgagcccgccagcgagggcggcgtgagaagcgccgccgccgccgccgagcccgcccccagaagcagcgacggcggcgccgtgagactggtggcccaggagtggttcagagtgagcagccagagaagaagccaggccgagcccgtggccagaatgctggagggcgtgagaagactgggccccgagctgctggcccacgtggtgaacctggccgacggcaacggcaacaccgccctgcactacagcgtgagccacggcaacctggccatcgccagcctgctgctggacaccggccagagccagggcagagtgggccaccaggagatgggcggcggcagaggccagggcctgacctag

SEQ ID NO: 22025 - DNA, 402 bp, Artificial Sequence
  Description of Artificial Sequence: Synthetic coding sequence
atgatcacccccctggccagcgccgagaccaacgaggacatggccgtggtgtggaagctgctgagagagggcaacgtgaacatccaggccacccagggcggccagaccgccctgatgctgggcgtgagccacgacagagaggacatggtgcaggccctgctgagctgccaggccgacgtgaacctgcaggaccacgacggcagcagcgccctgatggtggcctgccaccacggcaacgtggacctggtgagactgctgctggcccaccccgcctgcgacagcagcctgaccgacaaggccggcagaaccgccctgagcatcgccctgaagagccccacccacatggagatcgccggcctgctgagagcccacgccgagcagggcagaagcctgggcctgtag

SEQ ID NO: 22026 - DNA, 1104 bp, Artificial Sequence
  Description of Artificial Sequence: Synthetic coding sequence
atggagaagaccgacgagatcagccccagcaccagcctgaagagcatcatgaagaagaaggactacggcttcagagccggcggcaacggcaccaagaagaacctgcagttcgtgggcgtgaacggcggctacgagaccaccagcagcgaggagaccagcggcgaggacagcacccccgaggacctgagcgacagcgaggccgagaagaagtgcgacggccccgaccacaagcacgtgaaggacgcccacctgacctgcgaggccggccagggcatccccgagggcacctgccacgccgcccaggagagcggccccggcgaggaggtgccccacagcaaggccgagagatacaagcccagcgaggagttcctgaacgcctgcagagccctgagccagcacctgcccgagaccggcaccaccaccgaccagctgctgagacagagcctgaacaccatcagccaggagtggttcagagtgagcagcagaaagagcagcagccccgccgtggtggccagctacctgcacgaggtgcagccccacagcccccacttcctgaagctgctggtgaacctggccgaccacaacggcaacaccgccctgcactacagcgtgagccacagcaacttcagcatcgtgaagctgctgctggagaccggcgtgtgcaacgtggaccaccagaacaaggccggctacaccgccgtgatgatcacccccctggccagcgccgagaccaacgaggacatggccgtggtgtggaagctgctgagagagggcaacgtgaacatccaggccacccagggcggccagaccgccctgatgctgggcgtgagccacgacagagaggacatggtgcaggccctgctgagctgccaggccgacgtgaacctgcaggaccacgacggcagcagcgccctgatggtggcctgccaccacggcaacgtggacctggtgagactgctgctggcccaccccgcctgcgacagcagcctgaccgacaaggccggcagaaccgccctgagcatcgccctgaagagccccacccacatggagatcgccggcctgctgagagcccacgccgagcagggcagaagcctgggcctgtag

SEQ ID NO: 22027 - DNA, 1056 bp, Artificial Sequence
  Description of Artificial Sequence: Synthetic coding sequence
atgaagaagaaggactacggcttcagagccggcggcaacggcaccaagaagaacctgcagttcgtgggcgtgaacggcggctacgagaccaccagcagcgaggagaccagcggcgaggacagcacccccgaggacctgagcgacagcgaggccgagaagaagtgcgacggccccgaccacaagcacgtgaaggacgcccacctgacctgcgaggccggccagggcatccccgagggcacctgccacgccgcccaggagagcggccccggcgaggaggtgccccacagcaaggccgagagatacaagcccagcgaggagttcctgaacgcctgcagagccctgagccagcacctgcccgagaccggcaccaccaccgaccagctgctgagacagagcctgaacaccatcagccaggagtggttcagagtgagcagcagaaagagcagcagccccgccgtggtggccagctacctgcacgaggtgcagccccacagcccccacttcctgaagctgctggtgaacctggccgaccacaacggcaacaccgccctgcactacagcgtgagccacagcaacttcagcatcgtgaagctgctgctggagaccggcgtgtgcaacgtggaccaccagaacaaggccggctacaccgccgtgatgatcacccccctggccagcgccgagaccaacgaggacatggccgtggtgtggaagctgctgagagagggcaacgtgaacatccaggccacccagggcggccagaccgccctgatgctgggcgtgagccacgacagagaggacatggtgcaggccctgctgagctgccaggccgacgtgaacctgcaggaccacgacggcagcagcgccctgatggtggcctgccaccacggcaacgtggacctggtgagactgctgctggcccaccccgcctgcgacagcagcctgaccgacaaggccggcagaaccgccctgagcatcgccctgaagagccccacccacatggagatcgccggcctgctgagagcccacgccgagcagggcagaagcctgggcctgtag

SEQ ID NO: 22028 - DNA, 2988 bp, Artificial Sequence
  Description of Artificial Sequence: Synthetic coding sequence
atggagaagaccgacgccaaggaccagagcagccagggcgacgaggagaaggacccccccaagagccacccctacagcgtggagaccccctacggcttccacctggacctggacttcctgaagtacgtggacgacatcgagaagggcaacaccatcaagagaatccccatccacagaagagccaagcaggccaagttcagcaccctgcccagaaacttcagcctgcccgacagcggcgccagaccccccgccgccccccccctgcagaactggagccccgtggtgcccagagaggccagcctgggcacccaggagcagaaccagagcccccccctgggcaacgccccccaggccagcaccagcagaagcgaggtgagctaccacagaaaggccctgctggccgaggccaccagacagctggaggccgccgagcccgaggacgccgagctgaccttcggcagcggcagaccccagctgctgagagccagcagcatgcccgccaccctgctgcacagcagagccagcgaggagcccggcctgagcctgggcccccccgccccccccgccctgccccccctgcagggcgagggcagcgtgtgcgacggcaccttcgagcccgccgagggcctggccggcttccacagcagcagccccagagccagcaccagaatccccgagctggtgcaggagggcgccgagccccccgagggcgtggtgaaggtgcccaaccacctgcccctgcccggcccccccttcagcttccagaacgtgctggtggtgctggaggacaaggaggacgagcacaacgccagagaggccgaggtgctgttcacccccggcagccccacccccagccccccccccctgcccagccccatccccgagaacgagctgctgctggaggagatcgagctgaacatcagcgagatccccccccccccccccgtggaggtggacatgagaagcatcggcatcagagtgaccgaggagagcctgggcctggccagagtggaccccggcagcatcagcagcctgaagcagcaggtgagcgccctggagggcgagctgagcggcagaaccgaggagctggcccaggtgagaaccgccctgcagcagcaggaggaggagatcaaggccagagagcagagaatcagagagctggagttcaccgtggcccagctggagggccagttccaccaggagaacgccaaggacacccagggccagaccgacgtgatggtgaacaccgaccccgtgcacggcctgctgaccagagagagctgcgacaagggcatcgaggtgaacctgctgggcagcatggagagcgagagctggggccacagaggcgaggagaacggcctgctgtggggccccgacggccacaagcagggcaaccagagccccgccgagagagtgctgctgccccagctgagcctgccccagggccccgagcaggtgctgaccagcagcgtgcacagcttcctgagcaccgagctgagaatcgaggaggccggcaccgagcaggagggcggcccccagggcggcaccagaggcgccggcggcttcctgtggggcagcgacagaaagaccccccccgccggcagagaggagaccagcagcaacctgcccggcaaggagcaccccggcagaccccccagcagccccaccgacgccaccatcggccagtacgtgaagaagatccaggagctgctgcaggagcagtggaactgcctggagcacggctaccccgagctggccagcgccatcaagcagcccgccagcaagctgagcagcatccagagccagctgctgagcagcctgaacctgctgctgagcgcctacagcgcccaggcccacccccccaaggagccccccgccagcagcagcagcccccccgtggagatcagccccagcaccagcctgaagagcatcatgaagaagaaggactacggcttcagagccggcggcaacggcaccaagaagaacctgcagttcgtgggcgtgaacggcggctacgagaccaccagcagcgaggagaccagcggcgaggacagcacccccgaggacctgagcgacagcgaggccgagaagaagtgcgacggccccgaccacaagcacgtgaaggacgcccacctgacctgcgaggccggccagggcatccccgagggcacctgccacgccgcccaggagagcggccccggcgaggaggtgccccacagcaaggccgagagatacaagcccagcgaggagttcctgaacgcctgcagagccctgagccagcacctgcccgagaccggcaccaccaccgaccagctgctgagacagagcctgaacaccatcagccaggagtggttcagagtgagcagcagaaagagcagcagccccgccgtggtggccagctacctgcacgaggtgcagccccacagcccccacttcctgaagctgctggtgaacctggccgaccacaacggcaacaccgccctgcactacagcgtgagccacagcaacttcagcatcgtgaagctgctgctggagaccggcgtgtgcaacgtggaccaccagaacaaggccggctacaccgccgtgatgatcacccccctggccagcgccgagaccaacgaggacatggccgtggtgtggaagctgctgagagagggcaacgtgaacatccaggccacccagggcggccagaccgccctgatgctgggcgtgagccacgacagagaggacatggtgcaggccctgctgagctgccaggccgacgtgaacctgcaggaccacgacggcagcagcgccctgatggtggcctgccaccacggcaacgtggacctggtgagactgctgctggcccaccccgcctgcgacagcagcctgaccgacaaggccggcagaaccgccctgagcatcgccctgaagagccccacccacatggagatcgccggcctgctgagagcccacgccgagcagggcagaagcctgggcctgtag

SEQ ID NO: 22029 - DNA, 387 bp, Artificial Sequence
  Description of Artificial Sequence: Synthetic coding sequence
atgatgaccgccgtgagcctgaccaccagaccccaggagagcgtggccttcgaggacgtggccgtgtacttcaccaccaaggagtgggccatcatggtgcccgccgagagagccctgtacagagacgtgatgctggagaactacgaggccgtggccttcgtggtgccccccaccagcaagcccgccctggtgagccacctggagcagggcaaggagagctgcttcacccagccccagggcgtgctgagcagaaacgactggagagccggctggatcggctacctggagctgagaagatacacctacctggccaaggccgtgctgagaagaatcgtgagcaagatcttcagaaacagacagtgctgggaggacagaagaaaggcctag

SEQ ID NO: 22030 - DNA, 387 bp, Artificial Sequence; identical to SEQ ID NO: 22029
  Description of Artificial Sequence: Synthetic coding sequence

SEQ ID NO: 22031 - DNA, 387 bp, Artificial Sequence; identical to SEQ ID NO: 22029
  Description of Artificial Sequence: Synthetic coding sequence

SEQ ID NO: 22032 - DNA, 3090 bp, Artificial Sequence
  Description of Artificial Sequence: Synthetic coding sequence
atgagagagaactacgagaccctggtgagcgtgggcaccgccgagctgctgcccctgagcgccttcctgagccccagcgagcccggcagagccgtgggcggcggcagccacgccgacgagggccaggagcccgccggctgcggcgacccccagggcggccagcccagacacagcctgcacctgaccgccctggtgcagctggtgaaggagatccccgagttcctgttcggcgaggtgaagggcgccatggacagccccgagagcgagagcagaggcgccagcctggacggcgagagagccagccccgaggccgccgccgccagagagccctgccccctgagaggcctgctgagctgcctgcccgacggccccaccagccagccccacctggccaccacccccaccgacagcagctgcagcagcggccccaccggcgacggcgtgcagggcagccccctgcccatcaagaccgccgacaagccctggcccaccagaaaggagggccccggcgccctgggcggcgagcccagcccccccacccacagccccagcagaagaaagagccacagaggccaggagagaggcaccagcgaggccggcatcagccccggcaacagccccctgcagggcctgatcaactgcctgaaggagatcctggtgcccggccccagacaccccgagaccagccccagcttcctgccccccctgcccagcctgggcaccagcagactgaccagagccgacctgggccccggcagccccccctgggccgtgaagaccgaggccgtgagcggcgactgccccctgcagggcctgctgcactgcctgaaggagctgcccgaggcccaggacagacaccccagccccagcggcgtgggcaacagaagactgcaggagaaccccggcgcctggaagagaggcagcggcggccccggctacctgctgaccccccccccccaccccgacctgggcgccggcggcctgctgagcgtgaagatggagaacagctgggtgcagagcccccccggccccgccagctgccagcccggcagacagcccctgagccccagcgccaccggcgacaccagaggcgtgccccagcccagctggggccccgaggcccaggccgccagcgccagcagcagccccctggaggccctggaggcctgcctgaagggcatcccccccaacggcagcagccccagccagctgccccccaccagctgcagccagaacccccagcccggcgacagcagaagccagaagcccgagctgcagccccacagaagccacagcgaggaggccaccagagagcccgtgctgcccctgggcctgcagagctgcgtgagagacggccccagcagacccctggcccccagaggcacccccaccagcttcagcagcagcagcagcaccgactgggacctggacttcggcagccccgtgggcaaccagggccagcaccccggcaagggcagcccccccggcagcagccccctgcagggcctggagaactgcctgaaggagatccccgtgcccgtgctgagacccgcctggccctgcagcagcgccgccgacagaggccccagaagagccgagcccagaaactggaccgccgacaaggagggcctgagagccgaggcctgcgagagcagactgggccagggcagaggcgaggcccccaccagaagcctgcacctggtgagcccccaggtgttcaccagcagctgcgtgcccgcctgccaccagagaggcttcaaggaccccggcgccaccagacccggcgtgtggagatggctgcccgagggcagcgcccccaagcccagccccctgcactgcctggagagcgccctgagaggcatcctgcccgtgagacccctgagattcgcctgcgtgggcggccccagccccagccccagccccggcagcagcagcagcttcagcggcagcgagggcgaggaccccagacccgagcccgacctgtggaagcccctgccccaggagagagacagactgcccagctgcaagccccccgtgcccctgagcccctgccccggcggcacccccgccggcagcagcggcggcagccccggcgaggaccccagaagaaccgagcccagatactgcagcggcctgggcgccggcaccgcccaggacccctgccccgtgagccagctggagaagagacccagagtgagcgaggccagcagaggcctggagctgggccacggcagacccagagtggccgccaagacccacgagagactgctgccccagggcccccccgagctgcccagcgagagccccccccccgagctgcccccccccgaggccgccccccccgtgctgcccgccagcagcctgcagcccccctgccactgcggcaagcccctgcagcaggagctgcacagcctgggcgccgccctggccgagaagctggacagactggccaccgccctggccggcctggcccaggaggtggccaccatgagaacccaggtgaacagactgggcagaagaccccagggccccggccccatgggccaggccagctggatgtggaccctgcccagaggccccagatgggcccacggccccggccacagacacctgccctactggagacagaagggccccaccagacccaagcccaagatcctgagaggccagggcgagagctgcagagccggcgacctgcagggcctgagcagaggcaccgccagaagagccagacccctgccccccgacgccccccccgccgagccccccggcctgcactgcagcagcagccagcagctgctgagcagcacccccagctgccacgccgccccccccgcccaccccctgctggcccacaccggcggccaccagagccccctgccccccctggtgcccgccgccctgcccctgcagggcgccagcccccccgccgccagcgccgacgccgacgtgcccaccagcggcgtggcccccgacggcatccccgagagacccaaggagcccagcagcctgctgggcggcgtgcagagagccctgcaggaggagctgtggggcggcgagcacagagaccccagatggggcgcccactag

SEQ ID NO: 22033 - DNA, 2910 bp, Artificial Sequence
  Description of Artificial Sequence: Synthetic coding sequence
atgagagagaactacgagaccctggtgagcgtgggcaccgccgagctgctgcccctgagcgccttcctgagccccagcgagcccggcagagccgtgggcggcggcagccacgccgacgagggccaggagcccgccggctgcggcgacccccagggcggccagcccagacacagcctgcacctgaccgccctggtgcagctggtgaaggagatccccgagttcctgttcggcgaggtgaagggcgccatggacagccccgagagcgagagcagaggcgccagcctggacggcgagagagccagccccgaggccgccgccgccagagagccctgccccctgagaggcctgctgagctgcctgcccgacggccccaccagccagccccacctggccaccacccccaccgacagcagctgcagcagcggccccaccggcgacggcgtgcagggcagccccctgcccatcaagaccgccgacaagccctggcccaccagaaaggagggccccggcgccctgggcggcgagcccagcccccccacccacagccccagcagaagaaagagccacagaggccaggagagaggcaccagcgaggccggcatcagccccggcaacagccccctgcagggcctgatcaactgcctgaaggagatcctggtgcccggccccagacaccccgagaccagccccagcttcctgccccccctgcccagcctgggcaccagcagactgaccagagccgacctgggccccggcagccccccctgggccgtgaagaccgaggccgtgagcggcgactgccccctgcagggcctgctgcactgcctgaaggagctgcccgaggcccaggacagacaccccagccccagcggcgtgggcaacagaagactgcaggagaaccccggcgcctggaagagaggcagcggcggccccggctacctgctgaccccccccccccaccccgacctgggcgccggcggcctgctgagcgtgaagatggagaacagctgggtgcagagcccccccggccccgccagctgccagcccggcagacagcccctgagccccagcgccaccggcgacaccagaggcgtgccccagcccagctggggccccgaggcccaggccgccagcgccagcagcagccccctggaggccctggaggcctgcctgaagggcatcccccccaacggcagcagccccagccagctgccccccaccagctgcagccagaacccccagcccggcgacagcagaagccagaagcccgagctgcagccccacagaagccacagcgaggaggccaccagagagcccgtgctgcccctgggcctgcagagctgcgtgagagacggccccagcagacccctggcccccagaggcacccccaccagcttcagcagcagcagcagcaccgactgggacctggacttcggcagccccgtgggcaaccagggccagcaccccggcaagggcagcccccccggcagcagccccctgcagggcctggagaactgcctgaaggagatccccgtgcccgtgctgagacccgcctggccctgcagcagcgccgccgacagaggccccagaagagccgagcccagaaactggaccgccgacaaggagggcagcgcccccaagcccagccccctgcactgcctggagagcgccctgagaggcatcctgcccgtgagacccctgagattcgcctgcgtgggcggccccagccccagccccagccccggcagcagcagcagcttcagcggcagcgagggcgaggaccccagacccgagcccgacctgtggaagcccctgccccaggagagagacagactgcccagctgcaagccccccgtgcccctgagcccctgccccggcggcacccccgccggcagcagcggcggcagccccggcgaggaccccagaagaaccgagcccagatactgcagcggcctgggcgccggcaccgcccaggacccctgccccgtgagccagctggagaagagacccagagtgagcgaggccagcagaggcctggagctgggccacggcagacccagagtggccgccaagacccacgagagactgctgccccagggcccccccgagctgcccagcgagagccccccccccgagctgcccccccccgaggccgccccccccgtgctgcccgccagcagcctgcagcccccctgccactgcggcaagcccctgcagcaggagctgcacagcctgggcgccgccctggccgagaagctggacagactggccaccgccctggccggcctggcccaggaggtggccaccatgagaacccaggtgaacagactgggcagaagaccccagggccccggccccatgggccaggccagctggatgtggaccctgcccagaggccccagatgggcccacggccccggccacagacacctgccctactggagacagaagggccccaccagacccaagcccaagatcctgagaggccagggcgagagctgcagagccggcgacctgcagggcctgagcagaggcaccgccagaagagccagacccctgccccccgacgccccccccgccgagccccccggcctgcactgcagcagcagccagcagctgctgagcagcacccccagctgccacgccgccccccccgcccaccccctgctggcccacaccggcggccaccagagccccctgccccccctggtgcccgccgccctgcccctgcagggcgccagcccccccgccgccagcgccgacgccgacgtgcccaccagcggcgtggcccccgacggcatccccgagagacccaaggagcccagcagcctgctgggcggcgtgcagagagccctgcaggaggagctgtggggcggcgagcacagagaccccagatggggcgcccactag

SEQ ID NO: 22034 - DNA, 312 bp, Artificial Sequence
  Description of Artificial Sequence: Synthetic coding sequence
atgagagagaactacgagaccctggtgagcgtgggcaccgccgagctgctgcccctgagcgccttcctgagccccagcgagcccggcagagccgtgggcggcggcagccacgccgacgagggccaggagcccgccggctgcggcgacccccagggcggccagcccagacacagcctgcacctgaccgccctggtgcagctggtgaaggagatccccgagttcctgttcggcgaggtgaagggcgccatggacagccccgagagcgagagcagaggcgccagcctggacggcgagagagccagccccgagtag

SEQ ID NO: 22035 - DNA, 1479 bp, Artificial Sequence
  Description of Artificial Sequence: Synthetic coding sequence
atgcccagcttcctggtgcccagcctggtgagcagccccgtgctgctgaagctgctgttcagccccggccccaagaccatctggagcctgtggcagcagcccatgctgttccaggaggccaccgccttcgagaacatgaccaaggactggaactacctggagggcagccagaaggactgctacagagacaccatgctggacagctacgagaacaccgtgccccagggcagcttcctgcagctgagcatgatgccccagagagccggcaacgacccccccggcgtgagcaacgccagcgagatggagatggagatcagcaacatgagagagaagttcctgatgagcgtgaccaagctggtggagagcaagagctacaacagcaaggtgttcagcaaggagaagtacttccagaccatcaaggaggtgaaggaggccaaggagaagggcaagaagagcagcagagactacagaagagccgccaagtacgacgtgatcagcgtgcagggcaccgagaagctgatcgaggccacccacggcgagagagacagaatcagatactacgtgcacaaggaggagctgttcgacatcctgcacgacacccacctgagcatcggccacggcggcagaaccagaatgctgaaggagctgcagggcaagtacggcaacgtgaccaaggaggtgatcgtgctgtacctgaccctgtgcaagcagtgccaccagaagaaccccgtgcccaagagaggcctggcccccaagcccatgaccttcaaggacatcgacagcacctgccaggtggagatcctggacatgcagagcagcgccgacggcgagttcaagttcatcctgtactaccaggaccacagcaccaagttcatcatcctgagacccctgagaaccaagcaggcccacgaggtggtgagcgtgctgctggacatcttcaccatcctgggcacccccagcgtgctggacagcgacagcggcgtggagttcaccaaccaggtggtgcacgagctgaacgagctgtggcccgacctgaagatcgtgagcggcaagtaccaccccggccagagccagggcagcctggagggcgccagcagagacgtgaagaacatgatcagcacctggatgcagagcaaccacagctgccactgggccaagggcctgagattcatgcagatggtgagaaaccaggccttcgacgtgagcctgcagcagagccccttcgaggccatgttcggctacaaggccaagttcggcctgtacagcagcaacctgcccagagagaccgtggccaccctgcagaccgaggaggagctggagatcgccgaggagcagctggagaacagcctgtggatcagacaggaggagagagccgagatcggcgccgacagaagcgacatggacgacgacatggaccccacccccgaggccagcgagcccagcaccagccagggcaccagcggcctgctgtgctggtag

SEQ ID NO: 22036 - DNA, 1233 bp, Artificial Sequence
  Description of Artificial Sequence: Synthetic coding sequence
atgatgccccagagagccggcaacgacccccccggcgtgagcaacgccagcgagatggagatggagatcagcaacatgagagagaagttcctgatgagcgtgaccaagctggtggagagcaagagctacaacagcaaggtgttcagcaaggagaagtacttccagaccatcaaggaggtgaaggaggccaaggagaagggcaagaagagcagcagagactacagaagagccgccaagtacgacgtgatcagcgtgcagggcaccgagaagctgatcgaggccacccacggcgagagagacagaatcagatactacgtgcacaaggaggagctgttcgacatcctgcacgacacccacctgagcatcggccacggcggcagaaccagaatgctgaaggagctgcagggcaagtacggcaacgtgaccaaggaggtgatcgtgctgtacctgaccctgtgcaagcagtgccaccagaagaaccccgtgcccaagagaggcctggcccccaagcccatgaccttcaaggacatcgacagcacctgccaggtggagatcctggacatgcagagcagcgccgacggcgagttcaagttcatcctgtactaccaggaccacagcaccaagttcatcatcctgagacccctgagaaccaagcaggcccacgaggtggtgagcgtgctgctggacatcttcaccatcctgggcacccccagcgtgctggacagcgacagcggcgtggagttcaccaaccaggtggtgcacgagctgaacgagctgtggcccgacctgaagatcgtgagcggcaagtaccaccccggccagagccagggcagcctggagggcgccagcagagacgtgaagaacatgatcagcacctggatgcagagcaaccacagctgccactgggccaagggcctgagattcatgcagatggtgagaaaccaggccttcgacgtgagcctgcagcagagccccttcgaggccatgttcggctacaaggccaagttcggcctgtacagcagcaacctgcccagagagaccgtggccaccctgcagaccgaggaggagctggagatcgccgaggagcagctggagaacagcctgtggatcagacaggaggagagagccgagatcggcgccgacagaagcgacatggacgacgacatggaccccacccccgaggccagcgagcccagcaccagccagggcaccagcggcctgctgtgctggtag

SEQ ID NO: 22037 - DNA, 2130 bp, Artificial Sequence
  Description of Artificial Sequence: Synthetic coding sequence
atgggccacagaaccgccatgcccgagcccagaggcagcagccagctgagagtgaacgccgccttcgccgccagatacaacagatacagagagagagaggagctgcagagactgaaggacagatacggcgacagagacagcagcagcgacagcagcagcgagagcgacagcagcgacgagagagtggagttcgacccccagcaggagagagacttctacaagaccctgagcctgctgaagaagaaggaccccagaatctaccagaaggacgccaccttctacaacagaaccgccagcagcagcgacagcgaggaggaccccgaggccctggagaagcagaagaaggtgagacccatgtacctgaaggactacgagagaaaggtgatcctggagaaggccggcaagtacgtggacgaggagaacagcgacggcgagaccagcaaccacagactgcaggagaccagcagccagagctacgtggaggagcagaagcagctgaaggagagcttcagagccttcgtggaggacagcgaggacgaggacggcgccggcgagggcggcagcagcctgctgcagaagagagccaagaccagacaggagaaggcccaggaggaggccgactacatcgagtggctgaagggccagaaggagatcagaaaccccgacagcctgaaggagctgacccacctgaaggagtactggaacgaccccgagctggacgagggcgagagattcctgagagactacatcctgaacaagagatacgaggaggaggaggaggaggaggaggacgaggaggagatggaggaggaggagggcgtgcacggcccccccgtgcagctggccgtggacgacagcagcgacgagggcgagctgttcctgaagaagcaggaggacttcgagcagaagtacaacttcagattcgaggagcccgacagcgccagcgtgaagacctaccccagaagcatcgccagcagcgtgagaagaaaggacgagagaagaaaggagaagagagaggagaccagagagagaaagaagagagagaaggccaagaagcaggaggagctgaagcagctgaagaacctgaagagaaaggagatcctggccaagctggagaagctgagaaaggtgaccggcaacgagatgctgggcctggaggagggcgacctggaggacgacttcgaccccgcccagcacgaccagctgatgcagaagtgcttcggcgacgagtactacggcgccgtggaggaggagaagccccagttcgaggaggaggagggcctggaggacgactggaactgggacacctgggacggccccgagcaggagggcgactggagccagcaggagctgcactgcgaggaccccaacttcaacatggacgccgactacgaccccagccagcccagaaagaagaagagagaggcccccctgaccggcaagaagaagagaaagagccccttcgccgccgccgtgggccaggagaagcccgtgttcgagcccggcgacaagaccttcgaggagtacctggacgagtactacagactggactacgaggacatcatcgacgacctgccctgcagattcaagtacagaaccgtggtgccctgcgacttcggcctgagcaccgaggagatcctggccgccgacgacaaggagctgaacagatggtgcagcctgaagaagacctgcatgtacagaagcgagcaggaggagctgagagacaagagagcctacagccagaaggcccagaacagctggaagaagagacaggtgttcaagagcctgtgcagagaggaggccgagacccccgccgaggccaccggcaagccccagagagacgaggccggcccccagagacagctgcccgccctggacggcagcctgatgggccccgagagcccccccgcccaggaggaggaggcccccgtgagcccccacaagaagcccgccccccagaagagaagaagagccaagaaggccagactgctgggccccaccgtgatgctgggcggctgcgagttcagcagacagagactgcaggccttcggcctgaaccccaagagactgcacttcagacagctgggcagacagagaagaaagcagcagggccccaagaacagcagctag

SEQ ID NO: 22038 - DNA, 1749 bp, Artificial Sequence
  Description of Artificial Sequence: Synthetic coding sequence
atgggccacagaaccgccatgcccgagcccagaggcagcagccagctgagagtgaacgccgccttcgccgccagatacaacagatacagagagagagaggagctgcagagactgaaggacagatacggcgacagagacagcagcagcgacagcagcagcgagagcgacagcagcgacgagagagtggagttcgacccccagcaggagagagacttctacaagaccctgagcctgctgaagaagaaggaccccagaatctaccagaaggacgccaccttctacaacagaaccgccagcagcagcgacagcgaggaggaccccgaggccctggagaagcagaagaaggtgagacccatgtacctgaaggactacgagagaaaggtgatcctggagaaggccggcaagtacgtggacgaggagaacagcgacggcgagaccagcaaccacagactgcaggagaccagcagccagagctacgtggaggagcagaagcagctgaaggagagcttcagagccttcgtggaggacagcgaggacgaggacggcgccggcgagggcggcagcagcctgctgcagaagagagccaagaccagacaggagaaggcccaggaggaggccgactacatcgagtggctgaagggccagaaggagatcagaaaccccgacagcctgaaggagctgacccacctgaaggagtactggaacgaccccgagctggacgagggcgagagattcctgagagactacatcctgaacaagagatacgaggaggaggaggaggaggaggaggacgaggaggagatggaggaggaggagggcgtgcacggcccccccgtgcagctggccgtggacgacagcagcgacgagggcgagctgttcctgaagaagcaggaggacttcgagcagaagtacaacttcagattcgaggagcccgacagcgccagcgtgaagacctaccccagaagcatcgccagcagcgtgagaagaaaggacgagagaagaaaggagaagagagaggagaccagagagagaaagaagagagagaaggccaagaagcaggaggagctgaagcagctgaagaacctgaagagaaaggagatcctggccaagctggagaagctgagaaaggtgaccggcaacgagatgctgggcctggaggagggcgacctggaggacgacttcgaccccgcccagcacgaccagctgatgcagaagtgcttcggcgacgagtactacggcgccgtggaggaggagaagccccagttcgaggaggaggagggcctggaggacgactggaactgggacacctgggacggccccgagcaggagggcgactggagccagcaggagctgcactgcgaggaccccaacttcaacatggacgccgactacgaccccagccagcccagaaagaagaagagagaggcccccctgaccggcaagaagaagagaaagagccccttcgccgccgccgtgggccaggagaagcccgtgttcgagcccggcgaggcccaggtgggcagaccctgggtgggcagaggccacagaggcgcctggcacagccccgccgcctggctgtgcctggagcagggcaccagaagaagcagaagcacctggatgagcatcaccggctggaccaccagaaccagcagcaccacctgccccgtggccagcagcaccgcccagtggtgccccgtgaccctggccagcgccctgagaagaagcagcctgctgaccatcagaagctag

SEQ ID NO: 22039 - DNA, 1065 bp, Artificial Sequence
  Description of Artificial Sequence: Synthetic coding sequence
atgcccctggtggtgttctgcggcctgccctacagcggcaagagcagaagagccgaggagctgagagtggccctggccgccgagggcagagccgtgtacgtggtggacgacgccgccgtgctgggcgccgaggaccccgccgtgtacggcgacagcgccagagagaaggccctgagaggcgccctgagagccagcgtggagagaagactgagcagacacgacgtggtgatcctggacagcctgaactacatcaagggcttcagatacgagctgtactgcctggccagagccgccagaacccccctgtgcctggtgtactgcgtgagacccggcggccccatcgccggcccccaggtggccggcgccaacgagaaccccggcagaaacgtgagcgtgagctggagacccagagccgaggaggacggcagagcccaggccgccggcagcagcgtgctgagagagctgcacaccgccgacagcgtggtgaacggcagcgcccaggccgacgtgcccaaggagctggagagagaggagagcggcgccgccgagagccccgccctggtgacccccgacagcgagaagagcgccaagcacggcagcggcgccttctacagccccgagctgctggaggccctgaccctgagattcgaggcccccgacagcagaaacagatgggacagacccctgttcaccctggtgggcctggaggagcccctgcccctggccggcatcagaagcgccctgttcgagaacagagccccccccccccaccagagcacccagagccagcccctggccagcggcagcttcctgcaccagctggaccaggtgaccagccaggtgctggccggcctgatggaggcccagaagagcgccgtgcccggcgacctgctgaccctgcccggcaccaccgagcacctgagattcaccagacccctgaccatggccgagctgagcagactgagaagacagttcatcagctacaccaagatgcaccccaacaacgagaacctgccccagctggccaacatgttcctgcagtacctgagccagagcctgcactag

SEQ ID NO: 22040 - DNA, 162 bp, Artificial Sequence
  Description of Artificial Sequence: Synthetic coding sequence
atggaggccgccggcggcttccaggtgcacttccaccccagcaacggcgacggcagattcatcgagaccagcagcgccgccgacctggaggtgatcagctacagcagcaaggtgagcgtgaccgagagatgcttcatcaaggtgtgcaccgtgctgttctag

SEQ ID NO: 22041 - DNA, 162 bp, Artificial Sequence; identical to SEQ ID NO: 22040
  Description of Artificial Sequence: Synthetic coding sequence

SEQ ID NO: 22042 - DNA, 1041 bp, Artificial Sequence
  Description of Artificial Sequence: Synthetic coding sequence
atggacatgctggaccccggcctggaccccgccgccagcgccaccgccgccgccgccgccagccacgacaagggccccgaggccgaggagggcgtggagctgcaggagggcggcgacggccccggcgccgaggagcagaccgccgtggccatcaccagcgtgcagcaggccgccttcggcgaccacaacatccagtaccagttcagaaccgagaccaacggcggccaggtgacctacagagtggtgcaggtgaccgacggccagctggacggccagggcgacaccgccggcgccgtgagcgtggtgagcaccgccgccttcgccggcggccagcaggccgtgacccaggtgggcgtggacggcgccgcccagagacccggccccgccgccgccagcgtgccccccggccccgccgcccccttccccctggccgtgatccagaaccccttcagcaacggcggcagccccgccgccgaggccgtgagcggcgaggccagattcgcctacttccccgccagcagcgtgggcgacaccaccgccgtgagcgtgcagaccaccgaccagagcctgcaggccggcggccagttctacgtgatgatgaccccccaggacgtgctgcagaccggcacccagagaaccatcgcccccagaacccacccctacagccccaagatcgacggcaccagaacccccagagacgagagaagaagagcccagcacaacgaggtggagagaagaagaagagacaagatcaacaactggatcgtgcagctgagcaagatcatccccgactgcaacgccgacaacagcaagaccggcgccagcaagggcggcatcctgagcaaggcctgcgactacatcagagagctgagacagaccaaccagagaatgcaggagaccttcaaggaggccgagagactgcagatggacaacgagctgctgagacagcagatcgaggagctgaagaacgagaacgccctgctgagagcccagctgcagcagcacaacctggagatggtgggcgagggcaccagacagtag

SEQ ID NO: 22043 - DNA, 531 bp, Artificial Sequence
  Description of Artificial Sequence: Synthetic coding sequence
atggacctgcccgacagcgccagcagagtgttctgcggcagaatcctgagcatggtgaacaccgacgacgtgaacgccatcatcctggcccagaagaacatgctggacagattcgagaagaccaacgagatgctgctgaacttcaacaacctgagcagcgccagactgcagcagatgagcgagagattcctgcaccacaccagaaccctggtggagatgaagagagacctggacagcatcttcagaagaatcagaaccctgaagggcaagctggccagacagcaccccgaggccttcagccacatccccgaggccagcttcctggaggaggaggacgaggaccccatcccccccagcaccaccaccaccatcgccaccagcgagcagagcaccggcagctgcgacaccagccccgacaccgtgagccccagcctgagccccggcttcgaggacctgagccacgtgcagcccggcagccccgccatcaacggcagaagccagaccgacgacgaggagatgaccggcgagtag

SEQ ID NO: 22044 - DNA, 531 bp, Artificial Sequence; identical to SEQ ID NO: 22043
  Description of Artificial Sequence: Synthetic coding sequence

SEQ ID NO: 22045 - DNA, 432 bp, Artificial Sequence
  Description of Artificial Sequence: Synthetic coding sequence
atgagagacgccgacgccgacgccggcggcggcgccgacggcggcgacggcagaggcggccacagctgcagaggcggcgtggacaccgccgccgcccccgccggcggcgccccccccgcccacgcccccggccccggcagagacgccgccagcgccgccagaggcagcagaatgagaccccacatcttcaccctgagcgtgcccttccccacccccctggaggccgagatcgcccacggcagcctggcccccgacgccgagccccaccagagagtggtgggcaaggacctgaccgtgagcggcagaatcctggtggtgagatggaaggccgaggactgcagactgctgagaatcagcgtgatcaacttcctggaccagctgagcctggtggtgagaaccatgcagagattcggcccccccgtgagcagatag

SEQ ID NO: 22046 - DNA, 3747 bp, Artificial Sequence
  Description of Artificial Sequence: Synthetic coding sequence
atggtggtggccctgagatacgtgtggcccctgctgctgtgcagcccctgcctgctgatccagatccccgaggagctgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccaccaacagcagcagccacctggtggccctgcagggccagcccctggtgctggagtgcatcgccgagggcttccccacccccaccatcaagtggctgagacccagcggccccatgcccgccgacagagtgacctaccagaaccacaacaagaccctgcagctgctgaaggtgggcgaggaggacgacggcgagtacagatgcctggccgagaacagcctgggcagcgccagacacgcctactacgtgaccgtggaggccgccccctactggctgcacaagccccagagccacctgtacggccccggcgagaccgccagactggactgccaggtgcagggcagaccccagcccgaggtgacctggagaatcaacggcatccccgtggaggagctggccaaggaccagaagtacagaatccagagaggcgccctgatcctgagcaacgtgcagcccagcgacaccatggtgacccagtgcgaggccagaaacagacacggcctgctgctggccaacgcctacatctacgtggtgcagctgcccgccaagatcctgaccgccgacaaccagacctacatggccgtgcagggcagcaccgcctacctgctgtgcaaggccttcggcgcccccgtgcccagcgtgcagtggctggacgaggacggcaccaccgtgctgcaggacgagagattcttcccctacgccaacggcaccctgggcatcagagacctgcaggccaacgacaccggcagatacttctgcctggccgccaacgaccagaacaacgtgaccatcatggccaacctgaaggtgaaggacgccacccagatcacccagggccccagaagcaccatcgagaagaagggcagcagagtgaccttcacctgccaggccagcttcgaccccagcctgcagcccagcatcacctggagaggcgacggcagagacctgcaggagctgggcgacagcgacaagtacttcatcgaggacggcagactggtgatccacagcctggactacagcgaccagggcaactacagctgcgtggccagcaccgagctggacgtggtggagagcagagcccagctgctggtggtgggcagccccggccccgtgcccagactggtgctgagcgacctgcacctgctgacccagagccaggtgagagtgagctggagccccgccgaggaccacaacgcccccatcgagaagtacgacatcgagttcgaggacaaggagatggcccccgagaagtggtacagcctgggcaaggtgcccggcaaccagaccagcaccaccctgaagctgagcccctacgtgcactacaccttcagagtgaccgccatcaacaagtacggccccggcgagcccagccccgtgagcgagaccgtggtgacccccgaggccgcccccgagaagaaccccgtggacgtgaagggcgagggcaacgagaccaccaacatggtgatcacctggaagcccctgagatggatggactggaacgccccccaggtgcagtacagagtgcagtggagaccccagggcaccagaggcccctggcaggagcagatcgtgagcgaccccttcctggtggtgagcaacaccagcaccttcgtgccctacgagatcaaggtgcaggccgtgaacagccagggcaagggccccgagccccaggtgaccatcggctacagcggcgaggactacccccaggccatccccgagctggagggcatcgagatcctgaacagcagcgccgtgctggtgaagtggagacccgtggacctggcccaggtgaagggccacctgagaggctacaacgtgacctactggagagagggcagccagagaaagcacagcaagagacacatccacaaggaccacgtggtggtgcccgccaacaccaccagcgtgatcctgagcggcctgagaccctacagcagctaccacctggaggtgcaggccttcaacggcagaggcagcggccccgccagcgagttcaccttcagcacccccgagggcgtgcccggccaccccgaggccctgcacctggagtgccagagcaacaccagcctgctgctgagatggcagccccccctgagccacaacggcgtgctgaccggctacgtgctgagctaccaccccctggacgagggcggcaagggccagctgagcttcaacctgagagaccccgagctgagaacccacaacctgaccgacctgagcccccacctgagatacagattccagctgcaggccaccaccaaggagggccccggcgaggccatcgtgagagagggcggcaccatggccctgagcggcatcagcgacttcggcaacatcagcgccaccgccggcgagaactacagcgtggtgagctgggtgcccaaggagggccagtgcaacttcagattccacatcctgttcaaggccctgggcgaggagaagggcggcgccagcctgagcccccagtacgtgagctacaaccagagcagctacacccagtgggacctgcagcccgacaccgactacgagatccacctgttcaaggagagaatgttcagacaccagatggccgtgaagaccaacggcaccggcagagtgagactgccccccgccggcttcgccaccgagggctggttcatcggcttcgtgagcgccatcatcctgctgctgctggtgctgctgatcctgtgcttcatcaagagaagcaagggcggcaagtacagcgtgaaggacaaggaggacacccaggtggacagcgaggccagacccatgaaggacgagaccttcggcgagtacagcgacaacgaggagaaggccttcggcagcagccagcccagcctgaacggcgacatcaagcccctgggcagcgacgacagcctggccgactacggcggcagcgtggacgtgcagttcaacgaggacggcagcttcatcggccagtacagcggcaagaaggagaaggaggccgccggcggcaacgacagcagcggcgccaccagccccatcaaccccgccgtggccctggagtag

SEQ ID NO: 22047 - DNA, 3774 bp, Artificial Sequence
  Description of Artificial Sequence: Synthetic coding sequence
atggtggtggccctgagatacgtgtggcccctgctgctgtgcagcccctgcctgctgatccagatccccgaggagtacgagggccaccacgtgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccaccaacagcagcagccacctggtggccctgcagggccagcccctggtgctggagtgcatcgccgagggcttccccacccccaccatcaagtggctgagacccagcggccccatgcccgccgacagagtgacctaccagaaccacaacaagaccctgcagctgctgaaggtgggcgaggaggacgacggcgagtacagatgcctggccgagaacagcctgggcagcgccagacacgcctactacgtgaccgtggaggccgccccctactggctgcacaagccccagagccacctgtacggccccggcgagaccgccagactggactgccaggtgcagggcagaccccagcccgaggtgacctggagaatcaacggcatccccgtggaggagctggccaaggaccagaagtacagaatccagagaggcgccctgatcctgagcaacgtgcagcccagcgacaccatggtgacccagtgcgaggccagaaacagacacggcctgctgctggccaacgcctacatctacgtggtgcagctgcccgccaagatcctgaccgccgacaaccagacctacatggccgtgcagggcagcaccgcctacctgctgtgcaaggccttcggcgcccccgtgcccagcgtgcagtggctggacgaggacggcaccaccgtgctgcaggacgagagattcttcccctacgccaacggcaccctgggcatcagagacctgcaggccaacgacaccggcagatacttctgcctggccgccaacgaccagaacaacgtgaccatcatggccaacctgaaggtgaaggacgccacccagatcacccagggccccagaagcaccatcgagaagaagggcagcagagtgaccttcacctgccaggccagcttcgaccccagcctgcagcccagcatcacctggagaggcgacggcagagacctgcaggagctgggcgacagcgacaagtacttcatcgaggacggcagactggtgatccacagcctggactacagcgaccagggcaactacagctgcgtggccagcaccgagctggacgtggtggagagcagagcccagctgctggtggtgggcagccccggccccgtgcccagactggtgctgagcgacctgcacctgctgacccagagccaggtgagagtgagctggagccccgccgaggaccacaacgcccccatcgagaagtacgacatcgagttcgaggacaaggagatggcccccgagaagtggtacagcctgggcaaggtgcccggcaaccagaccagcaccaccctgaagctgagcccctacgtgcactacaccttcagagtgaccgccatcaacaagtacggccccggcgagcccagccccgtgagcgagaccgtggtgacccccgaggccgcccccgagaagaaccccgtggacgtgaagggcgagggcaacgagaccaccaacatggtgatcacctggaagcccctgagatggatggactggaacgccccccaggtgcagtacagagtgcagtggagaccccagggcaccagaggcccctggcaggagcagatcgtgagcgaccccttcctggtggtgagcaacaccagcaccttcgtgccctacgagatcaaggtgcaggccgtgaacagccagggcaagggccccgagccccaggtgaccatcggctacagcggcgaggactacccccaggccatccccgagctggagggcatcgagatcctgaacagcagcgccgtgctggtgaagtggagacccgtggacctggcccaggtgaagggccacctgagaggctacaacgtgacctactggagagagggcagccagagaaagcacagcaagagacacatccacaaggaccacgtggtggtgcccgccaacaccaccagcgtgatcctgagcggcctgagaccctacagcagctaccacctggaggtgcaggccttcaacggcagaggcagcggccccgccagcgagttcaccttcagcacccccgagggcgtgcccggccaccccgaggccctgcacctggagtgccagagcaacaccagcctgctgctgagatggcagccccccctgagccacaacggcgtgctgaccggctacgtgctgagctaccaccccctggacgagggcggcaagggccagctgagcttcaacctgagagaccccgagctgagaacccacaacctgaccgacctgagcccccacctgagatacagattccagctgcaggccaccaccaaggagggccccggcgaggccatcgtgagagagggcggcaccatggccctgagcggcatcagcgacttcggcaacatcagcgccaccgccggcgagaactacagcgtggtgagctgggtgcccaaggagggccagtgcaacttcagattccacatcctgttcaaggccctgggcgaggagaagggcggcgccagcctgagcccccagtacgtgagctacaaccagagcagctacacccagtgggacctgcagcccgacaccgactacgagatccacctgttcaaggagagaatgttcagacaccagatggccgtgaagaccaacggcaccggcagagtgagactgccccccgccggcttcgccaccgagggctggttcatcggcttcgtgagcgccatcatcctgctgctgctggtgctgctgatcctgtgcttcatcaagagaagcaagggcggcaagtacagcgtgaaggacaaggaggacacccaggtggacagcgaggccagacccatgaaggacgagaccttcggcgagtacagaagcctggagagcgacaacgaggagaaggccttcggcagcagccagcccagcctgaacggcgacatcaagcccctgggcagcgacgacagcctggccgactacggcggcagcgtggacgtgcagttcaacgaggacggcagcttcatcggccagtacagcggcaagaaggagaaggaggccgccggcggcaacgacagcagcggcgccaccagccccatcaaccccgccgtggccctggagtag

SEQ ID NO: 22048 - DNA, 1338 bp, Artificial Sequence
  Description of Artificial Sequence: Synthetic coding sequence
atgctgctgttcgtggagcaggtggccagcaagggcaccggcctgaaccccaacgccaaggtgtggcaggagatcgcccccggcaacaccgacgccacccccgtgacccacggcaccgagagcagctggcacgagatcgccgccaccagcggcgcccaccccgagggcaacgccgagctgagcgaggacatctgcaaggagtacgaggtgatgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcaagtacctgagagaggaggtgaagaccttccagggcaagcccatcatggccagaatcaaggccatcaacaccttcttcgccaagaacggctacagactgatggacagcagcatctacagccaccccatccagacccaggcccagtacgccagccccgtgttcatgcagcccgtgtacaacccccaccagcagtacagcgtgtacagcatcgtgccccagagctggagccccaaccccaccccctacttcgagacccccctggcccccttccccaacggcagcttcgtgaacggcttcaacagccccggcagctacaagaccaacgccgccgccatgaacatgggcagacccttccagaagaacagagtgaagccccagttcagaagcagcggcggcagcgagcacagcaccgagggcagcgtgagcctgggcgacggccagctgaacagatacagcagcagaaacttccccgccgagagacacaaccccaccgtgaccggccaccaggagcagacctacctgcagaaggagaccagcaccctgcaggtggagcagaacggcgactacggcagaggcagatag

SEQ ID NO: 22049 - DNA, 2568 bp, Artificial Sequence
  Description of Artificial Sequence: Synthetic coding sequence
atggagaactggcccacccccagcgagctggtgaacaccggcttccagagcgtgctgagccagggcaacaagaagccccagaacagaaaggagaaggaggagaaggtggagaagagaagcaacagcgacagcaaggagaacagagagaccaagctgaacggccccggcgagaacgtgagcgaggacgaggcccagagcagcaaccagagaaagagaggctggaagagagacagagagaagagagacgaccaggacgacgtgagcagcgtgagaagcgagggcggcaacatcagaggcagcttcagaggcagaggcagaggcagaggcagaggcagaggcagaggcagaggcaaccccagactgaacttcgactacagctacggctaccaggagcacggcgagagaaccgaccagcccttccagaccgagctgaacaccagcatgatgtactactacgacgacggcaccggcgtgcaggtgtaccccgtggaggaggccctgctgaaggagtacatcaagagacagatcgagtactacttcagcgtggagaacctggagagagacttcttcctgagaggcaagatggacgagcagggcttcctgcccatcagcctgatcgccggcttccagagagtgcaggccctgaccaccaacctgaacctgatcctggaggccctgaaggacagcaccgaggtggagatcgtggacgagaagatgagaaagaagatcgagcccgagaagtggcccatccccggccccccccccagaagcgtgccccccaccgacttcagccagctgatcgactgccccgagttcgtgcccggccaggccttctgcagccacaccgagagcgcccccaacagccccagaatcggcagccccctgagccccaagaagaacagcgagaccagcatcctgcaggccatgagcagaggcctgagcaccagcctgcccgacctggacagcgagccctggatcgaggtgaagaagagacaccagcccgcccccgtgaagctgagagagagcgtgagcgtgcccgagggcagcctgaaccagctgtgcagcagcgaggagcccgagcaggaggagctggacttcctgttcgacgaggagatcgagcagatcggcagaaagaacaccttcaccgactggagcgacaacgacagcgactacgagatcgacgaccaggacctgaacaagatcctgatcgtgacccagacccccccctacgtgaagaagcaccccggcggcgacagaaccggcacccacatgagcagagccaagatcaccagcgagctggccaaggtgatcaacgacggcctgtactactacgagcaggacctgtggatggaggaggacgagaacaagcacaccgccatcaagcaggaggtggagaacttcaagaagctgaacctgatcagcaaggagcagttcgagaacctgacccccgagctgcccttcgagcccaaccaggaggtgcccgtggcccccagccagagcagacaggacctgaccgacgagctggcccagaagctgttcgacgtgagcgagatcaccagcgccgccatggtgcacagcctgcccaccgccgtgcccgagagccccagaatccaccccaccagaacccccaagacccccagaacccccagactgcaggaccccaacaagacccccagattctaccccgtggtgaaggagcccaaggccatcgacgtgaagagccccagaaagagaaagaccagacacagcaccaacccccccctggagtgccacgtgggctgggtgatggacagcagagacagaggccccggcaccagcagcgtgagcaccagcaacgccagccccagcgagggcgcccccctggccggcagctacggctgcaccccccacagcttccccaagttccagcaccccagccacgagctgctgaaggagaacggcttcacccagcaggtgtaccacaagtacagaagaagatgcctgagcgagagaaagagactgggcatcggccagagccaggagatgaacaccctgttcagattctggagcttcttcctgagagaccacttcaacaagaagatgtacgaggagttcagacagctggcctgggaggacgccaaggagaactacagatacggcctggagtgcctgttcagattctacagctacggcctggagaagaagttcagaagagagatcttccaggacttccaggaggagaccaagaaggactacgagagcggccagctgtacggcctggagaagttctgggcctacctgaagtacagccagagcaagacccagagcatcgaccccaagctgcaggagtacctgtgcagcttcaagagactggaggacttcagagtggacccccccatcagcgacgagttcggcagaaagagacacagcagcaccagcggcgaggagagcaacagacacagactgccccccaacagcagcaccaagccccccaacgccgccaagcccaccagcaccagcgagctgcaggtgcccatcaacagccccagaagaaacatcagccccgagagcagcgacaacagccactag

SEQ ID NO: 22050 - DNA, 2745 bp, Artificial Sequence
  Description of Artificial Sequence: Synthetic coding sequence
atggagaactggcccacccccagcgagctggtgaacaccggcttccagagcgtgctgagccagggcaacaagaagccccagaacagaaaggagaaggaggagaaggtggagaagagaagcaacagcgacagcaaggagaacagagagaccaagctgaacggccccggcgagaacgtgagcgaggacgaggcccagagcagcaaccagagaaagagagccaacaagcacaagtgggtgcccctgcacctggacgtggtgagaagcgagagccaggagagacccggcagcagaaacagcagcagatgccagcccgaggccaacaagcccacccacaacaacagaagaaacgacaccagaagctggaagagagacagagagaagagagacgaccaggacgacgtgagcagcgtgagaagcgagggcggcaacatcagaggcagcttcagaggcagaggcagaggcagaggcagaggcagaggcagaggcagaggcaaccccagactgaacttcgactacagctacggctaccaggagcacggcgagagaaccgaccagcccttccagaccgagctgaacaccagcatgatgtactactacgacgacggcaccggcgtgcaggtgtaccccgtggaggaggccctgctgaaggagtacatcaagagacagatcgagtactacttcagcgtggagaacctggagagagacttcttcctgagaggcaagatggacgagcagggcttcctgcccatcagcctgatcgccggcttccagagagtgcaggccctgaccaccaacctgaacctgatcctggaggccctgaaggacagcaccgaggtggagatcgtggacgagaagatgagaaagaagatcgagcccgagaagtggcccatccccggccccccccccagaagcgtgccccccaccgacttcagccagctgatcgactgccccgagttcgtgcccggccaggccttctgcagccacaccgagagcgcccccaacagccccagaatcggcagccccctgagccccaagaagaacagcgagaccagcatcctgcaggccatgagcagaggcctgagcaccagcctgcccgacctggacagcgagccctggatcgaggtgaagaagagacaccagcccgcccccgtgaagctgagagagagcgtgagcgtgcccgagggcagcctgaaccagctgtgcagcagcgaggagcccgagcaggaggagctggacttcctgttcgacgaggagatcgagcagatcggcagaaagaacaccttcaccgactggagcgacaacgacagcgactacgagatcgacgaccaggacctgaacaagatcctgatcgtgacccagacccccccctacgtgaagaagcaccccggcggcgacagaaccggcacccacatgagcagagccaagatcaccagcgagctggccaaggtgatcaacgacggcctgtactactacgagcaggacctgtggatggaggaggacgagaacaagcacaccgccatcaagcaggaggtggagaacttcaagaagctgaacctgatcagcaaggagcagttcgagaacctgacccccgagctgcccttcgagcccaaccaggaggtgcccgtggcccccagccagagcagacagggcggcgtgcagggcgtgctgcacatccccaagaaggacctgaccgacgagctggcccagaagctgttcgacgtgagcgagatcaccagcgccgccatggtgcacagcctgcccaccgccgtgcccgagagccccagaatccaccccaccagaacccccaagacccccagaacccccagactgcaggaccccaacaagacccccagattctaccccgtggtgaaggagcccaaggccatcgacgtgaagagccccagaaagagaaagaccagacacagcaccaacccccccctggagtgccacgtgggctgggtgatggacagcagagacagaggccccggcaccagcagcgtgagcaccagcaacgccagccccagcgagggcgcccccctggccggcagctacggctgcaccccccacagcttccccaagttccagcaccccagccacgagctgctgaaggagaacggcttcacccagcaggtgtaccacaagtacagaagaagatgcctgagcgagagaaagagactgggcatcggccagagccaggagatgaacaccctgttcagattctggagcttcttcctgagagaccacttcaacaagaagatgtacgaggagttcagacagctggcctgggaggacgccaaggagaactacagatacggcctggagtgcctgttcagattctacagctacggcctggagaagaagttcagaagagagatcttccaggacttccaggaggagaccaagaaggactacgagagcggccagctgtacggcctggagaagttctgggcctacctgaagtacagccagagcaagacccagagcatcgaccccaagctgcaggagtacctgtgcagcttcaagagactggaggacttcagagtggacccccccatcagcgacgagttcggcagaaagagacacagcagcaccagcggcgaggagagcaacagacacagactgccccccaacagcagcaccaagccccccaacgccgccaagcccaccagcaccagcgagctgcaggtgcccatcaacagccccagaagaaacatcagccccgagagcagcgacaacagccactag

SEQ ID NO: 22051 - DNA, 846 bp, Artificial Sequence
  Description of Artificial Sequence: Synthetic coding sequence
atggtgcacagcctgcccaccgccgtgcccgagagccccagaatccaccccaccagaacccccaagacccccagaacccccagactgcaggaccccaacaagacccccagattctaccccgtggtgaaggagcccaaggccatcgacgtgaagagccccagaaagagaaagaccagacacagcaccaacccccccctggagtgccacgtgggctgggtgatggacagcagagacagaggccccggcaccagcagcgtgagcaccagcaacgccagccccagcgagggcgcccccctggccggcagctacggctgcaccccccacagcttccccaagttccagcaccccagccacgagctgctgaaggagaacggcttcacccagcaggtgtaccacaagtacagaagaagatgcctgagcgagagaaagagactgggcatcggccagagccaggagatgaacaccctgttcagattctggagcttcttcctgagagaccacttcaacaagaagatgtacgaggagttcagacagctggcctgggaggacgccaaggagaactacagatacggcctggagtgcctgttcagattctacagctacggcctggagaagaagttcagaagagagatcttccaggacttccaggaggagaccaagaaggactacgagagcggccagctgtacggcctggagaagttctgggcctacctgaagtacagccagagcaagacccagagcatcgaccccaagctgcaggagtacctgtgcagcttcaagagactggaggacttcagagtggacaaccaccacgacagactgctgctgctgatcatcaacatctag

SEQ ID NO: 22052 - DNA, 1008 bp, Artificial Sequence
  Description of Artificial Sequence: Synthetic coding sequence
atggagaactggcccacccccagcgagctggtgaacaccggcttccagagcgtgctgagccagggcaacaagaagccccagaacagaaaggagaaggaggagaaggtggagaagagaagcaacagcgacagcaaggagaacagagagaccaagctgaacggccccggcgagaacgtgagcgaggacgaggcccagagcagcaaccagagaaagagagccaacaagcacaagtgggtgcccctgcacctggacgtggtgagaagcgagagccaggagagacccggcagcagaaacagcagcagatgccagcccgaggccaacaagcccacccacaacaacagaagaaacgacaccagaagctggaagagagacagagagaagagagacgaccaggacgacgtgagcagcgtgagaagcgagggcggcaacatcagaggcagcttcagaggcagaggcagaggcagaggcagaggcagaggcagaggcagaggcaaccccagactgaacttcgactacagctacggctaccaggagcacggcgagagaaccgaccagcccttccagaccgagctgaacaccagcatgatgtactactacgacgacggcaccggcgtgcaggtgtaccccgtggaggaggccctgctgaaggagtacatcaagagacagatcgagtactacttcagcgtggagaacctggagagagacttcttcctgagaggcaagatggacgagcagggcttcctgcccatcagcctgatcgccggcttccagagagtgcaggccctgaccaccaacctgaacctgatcctggaggccctgaaggacagcaccgaggtggagatcgtggacgagaagatgagaaagaagatcgagcccgagaagtggcccatccccggccccccccccagaagcgtgccccccaccgacttcagccagctgatcgactgccccgagttcgtgcccggccaggccttctgcagccacaccgtgagagtgatgatcttctag

SEQ ID NO: 22053 - DNA, 1569 bp, Artificial Sequence
  Description of Artificial Sequence: Synthetic coding sequence
atggagaactggcccacccccagcgagctggtgaacaccggcttccagagcgtgctgagccagggcaacaagaagccccagaacagaaaggagaaggaggagaaggtggagaagagaagcaacagcgacagcaaggagaacagagagaccaagctgaacggccccggcgagaacgtgagcgaggacgaggcccagagcagcaaccagagaaagagagccaacaagcacaagtgggtgcccctgcacctggacgtggtgagaagcgagagccaggagagacccggcagcagaaacagcagcagatgccagcccgaggccaacaagcccacccacaacaacagaagaaacgacaccagaagctggaagagagacagagagaagagagacgaccaggacgacgtgagcagcgtgagaagcgagggcggcaacatcagaggcagcttcagaggcagaggcagaggcagaggcagaggcagaggcagaggcagaggcaaccccagactgaacttcgactacagctacggctaccaggagcacggcgagagaaccgaccagcccttccagaccgagctgaacaccagcatgatgtactactacgacgacggcaccggcgtgcaggtgtaccccgtggaggaggccctgctgaaggagtacatcaagagacagatcgagtactacttcagcgtggagaacctggagagagacttcttcctgagaggcaagatggacgagcagggcttcctgcccatcagcctgatcgccggcttccagagagtgcaggccctgaccaccaacctgaacctgatcctggaggccctgaaggacagcaccgaggtggagatcgtggacgagaagatgagaaagaagatcgagcccgagaagtggcccatccccggccccccccccagaagcgtgccccccaccgacttcagccagctgatcgactgccccgagttcgtgcccggccaggccttctgcagccacaccgagagcgcccccaacagccccagaatcggcagccccctgagccccaagaagaacagcgagaccagcatcctgcaggccatgagcagaggcctgagcaccagcctgcccgacctggacagcgagccctggatcgaggtgaagaagagacaccagcccgcccccgtgaagctgagagagagcgtgagcgtgcccgagggcagcctgaaccagctgtgcagcagcgaggagcccgagcaggaggagctggacttcctgttcgacgaggagatcgagcagatcggcagaaagaacaccttcaccgactggagcgacaacgacagcgactacgagatcgacgaccaggacctgaacaagatcctgatcgtgacccagacccccccctacgtgaagaagcaccccggcggcgacagaaccggcacccacatgagcagagccaagatcaccagcgagctggccaaggtgatcaacgacggcctgtactactacgagcaggacctgtggatggaggaggacgagaacaagcacaccgccatcaaggtgatcgtgagcggccagcacctgagcaccgacgccctgttctag

SEQ ID NO: 22054 - DNA, 1077 bp, Artificial Sequence
  Description of Artificial Sequence: Synthetic coding sequence
atggagaactggcccacccccagcgagctggtgaacaccggcttccagagcgtgctgagccagggcaacaagaagccccagaacagaaaggagaaggaggagaaggtggagaagagaagcaacagcgacagcaaggagaacagagagaccaagctgaacggccccggcgagaacgtgagcgaggacgaggcccagagcagcaaccagagaaagagagccaacaagcacaagtgggtgcccctgcacctggacgtggtgagaagcgagagccaggagagacccggcagcagaaacagcagcagatgccagcccgaggccaacaagcccacccacaacaacagaagaaacgacaccagaagctggaagagagacagagagaagagagacgaccaggacgacgtgagcagcgtgagaagcgagggcggcaacatcagaggcagcttcagaggcagaggcagaggcagaggcagaggcagaggcagaggcagaggcaaccccagactgaacttcgactacagctacggctaccaggagcacggcgagagaaccgaccagcccttccagaccgagctgaacaccagcatgatgtactactacgacgacggcaccggcgtgcaggtgtaccccgtggaggaggccctgctgaaggagtacatcaagagacagatcgagtactacttcagcgtggagaacctggagagagacttcttcctgagaggcaagatggacgagcagggcttcctgcccatcagcctgatcgccggcttccagagagtgcaggccctgaccaccaacctgaacctgatcctggaggccctgaaggacagcaccgaggtggagatcgtggacgagaagatgagaaagaagatcgagcccgagaagtggcccatccccggccccccccccagaagcgtgccccccaccgacttcagccagctgatcgactgccccgagttcgtgcccggccaggccttctgcagccacaccggcaacatcttcagcagcagagccaacgacgtgaccgtgggctacctggtgcagttcacctacctgttcatctacttccagttcatctag

SEQ ID NO: 22055 - DNA, 2364 bp, Artificial Sequence
  Description of Artificial Sequence: Synthetic coding sequence
atggagaactggcccacccccagcgagctggtgaacaccggcttccagagcgtgctgagccagggcaacaagaagccccagaacagaaaggagaaggaggagaaggtggagaagagaagcaacagcgacagcaaggagaacagagagaccaagctgaacggccccggcgagaacgtgagcgaggacgaggcccagagcagcaaccagagaaagagagccaacaagcacaagtgggtgcccctgcacctggacgtggtgagaagcgagagccaggagagacccggcagcagaaacagcagcagatgccagcccgaggccaacaagcccacccacaacaacagaagaaacgacaccagaagctggaagagagacagagagaagagagacgaccaggacgacgtgagcagcgtgagaagcgagggcggcaacatcagaggcagcttcagaggcagaggcagaggcagaggcagaggcagaggcagaggcagaggcaaccccagactgaacttcgactacagctacggctaccaggagcacggcgagagaaccgaccagcccttccagaccgagctgaacaccagcatgatgtactactacgacgacggcaccggcgtgcaggtgtaccccgtggaggaggccctgctgaaggagtacatcaagagacagatcgagtactacttcagcgtggagaacctggagagagacttcttcctgagaggcaagatggacgagcagggcttcctgcccatcagcctgatcgccggcttccagagagtgcaggccctgaccaccaacctgaacctgatcctggaggccctgaaggacagcaccgaggtggagatcgtggacgagaagatgagaaagaagatcgagcccgagaagtggcccatccccggccccccccccagaagcgtgccccccaccgacttcagccagctgatcgactgccccgagttcgtgcccggccaggccttctgcagccacaccgagagcgcccccaacagccccagaatcggcagccccctgagccccaagaagaacagcgagaccagcatcctgcaggccatgagcagaggcctgagcaccagcctgcccgacctggacagcgagccctggatcgaggtgaagaagagacaccagcccgcccccgtgaagctgagagagagcgtgagcgtgcccgagggcagcctgaaccagctgtgcagcagcgaggagcccgagcaggaggagctggacttcctgttcgacgaggagatcgagcagatcggcagaaagaacaccttcaccgactggagcgacaacgacagcgactacgagatcgacgaccaggacctgaacaagatcctgatcgtgacccagacccccccctacgtgaagaagcaccccggcggcgacagaaccggcacccacatgagcagagccaagatcaccagcgagctggccaaggtgatcaacgacggcctgtactactacgagcaggacctgtggatggaggaggacgagaacaagcacaccgccatcaagcaggaggtggagaacttcaagaagctgaacctgatcagcaaggagcagttcgagaacctgacccccgagctgcccttcgagcccaaccaggaggtgcccgtggcccccagccagagcagacagggcggcgtgcagggcgtgctgcacatccccaagaaggacctgaccgacgagctggcccagaagctgttcgacgtgagcgagatcaccagcgccgccatggtgcacagcctgcccaccgccgtgcccgagagccccagaatccaccccaccagaacccccaagacccccagaacccccagactgcaggaccccaacaagacccccagattctaccccgtggtgaaggagcccaaggccatcgacgtgaagagccccagaaagagaaagaccagacacagcaccaacccccccctggagtgccacgtgggctgggtgatggacagcagagacagaggccccggcaccagcagcgtgagcaccagcaacgccagccccagcgagggcgcccccctggccggcagctacggctgcaccccccacagcttccccaagttccagcaccccagccacgagctgctgaaggagaacggcttcacccagcaggtgtaccacaagtacagaagaagatgcctgagcgagagaaagagactgggcatcggccagagccaggagatgaacaccctgttcagattctggagcttcttcctgagagaccacttcaacaagaagatgtacgaggagttcagacagctggcctgggaggacgccaaggagaactacagaagcgccgtgtggaccagaaaggtgctgggcctgttcgagatcttcagcatctag

SEQ ID NO: 22056 - DNA, 1476 bp, Artificial Sequence
  Description of Artificial Sequence: Synthetic coding sequence
tgagaggagaaggtggagaagagaagcaacagcgacagcaaggagaacagagagaccaagctgaacggccccggcgagaacgtgagcgaggacgaggcccagagcagcaaccagagaaagagagccaacaagcacaagtgggtgcccctgcacctggacgtggtgagaagcgagagccaggagagacccggcagcagaaacagcagcagatgccagcccgaggccaacaagcccacccacaacaacagaagaaacgacaccagaagctggaagagagacagagagaagagagacgaccaggacgacgtgagcagcgtgagaagcgagggcggcaacatcagaggcagcttcagaggcagaggcagaggcagaggcagaggcagaggcagaggcagaggcaaccccagactgaacttcgactacagctacggctaccaggagcacggcgagagaaccgaccagcccttccagaccgagctgaacaccagcatgatgtactactacgacgacggcaccggcgtgcaggtgtaccccgtggaggaggccctgctgaaggagtacatcaagagacagatcgagtactacttcagcgtggagaacctggagagagacttcttcctgagaggcaagatggacgagcagggcttcctgcccatcagcctgatcgccggcttccagagagtgcaggccctgaccaccaacctgaacctgatcctggaggccctgaaggacagcaccgaggtggagatcgtggacgagaagatgagaaagaagatcgagcccgagaagtggcccatccccggccccccccccagaagcgtgccccccaccgacttcagccagctgatcgactgccccgagttcgtgcccggccaggccttctgcagccacaccgagagcgcccccaacagccccagaatcggcagccccctgagccccaagaagaacagcgagaccagcatcctgcaggccatgagcagaggcctgagcaccagcctgcccgacctggacagcgagccctggatcgaggtgaagaagagacaccagcccgcccccgtgaagctgagagagagcgtgagcgtgcccgagggcagcctgaaccagctgtgcagcagcgaggagcccgagcaggaggagctggacttcctgttcgacgaggagatcgagcagatcggcagaaagaacaccttcaccgactggagcgacaacgacagcgactacgagatcgacgaccaggacctgaacaagatcctgatcgtgacccagacccccccctacgtgaagaagcaccccggcggcgacagaaccggcacccacatgagcagagccaagatcaccagcgagctggccaaggtgatcaacgacggcctgtactactacgagcaggacctgtggatggaggaggacgagaacaagcacaccgccatcaaggtgatcgtgagcggccagcacctgagcaccgacgccctgttctag

SEQ ID NO: 22057 - DNA, 1962 bp, Artificial Sequence
  Description of Artificial Sequence: Synthetic coding sequence
atgctgctgttcgtggagcaggtggccagcaagggcaccggcctgaaccccaacgccaaggtgtggcaggagatcgcccccggcaacaccgacgccacccccgtgacccacggcaccgagagcagctggcacgagatcgccgccaccagcggcgcccaccccgagggcaacgccgagctgagcgaggacatctgcaaggagtacgaggtgatgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcaagtacctgagagaggaggtgaagaccttccagggcaagcccatcatggccagaatcaaggccatcaacaccttcttcgccaagaacggctacagactgatggacagcagcatctacagccaccccatccagacccaggcccagtacgccagccccgtgttcatgcagcccgtgtacaacccccaccagcagtacagcgtgtacagcatcgtgccccagagctggagccccaaccccaccccctacttcgagacccccctggcccccttccccaacggcagcttcgtgaacggcttcaacagccccggcagctacaagaccaacgccgccgccatgaacatgggcagacccttccagaagaacagaagaaccctgttcagaggcagaagaagaagagaggacgacagaatcagcagaccccaccccagcaccgccgagagcaaggcccccacccccaagttcgacctgctggccagcaacttcccccccctgcccggcagcagcagcagaatgcccggcgagctggtgctggagaacagaatgagcgacgtggtgaagggcgtgtacaaggagaaggacaacgaggagctgaccatcagctgccccgtgcccgccgacgagcagaccgagtgcaccagcgcccagcagctgaacatgagcaccagcagcccctgcgccgccgagctgaccgccctgagcaccacccagcaggagaaggacctgatcgaggacagcagcgtgcagaaggacggcctgaaccagaccaccatccccgtgagcccccccagcaccaccaagcccagcagagccagcaccgccagcccctgcaacaacaacatcaacgccgccaccgccgtggccctgcaggagcccagaaagctgagctacgccgaggtgtgccagaagccccccaaggagcccagcagcgtgctggtgcagcccctgagagagctgagaagcaacgtggtgagccccaccaagaacgaggacaacggcgcccccgagaacagcgtggagaagccccacgagaagcccgaggccagagccagcaaggactacagcggcttcagaggcaacatcatccccagaggcgccgccggcaagatcagagagcagagaagacagttcagccacagagccatcccccagggcgtgaccagaagaaacggcaaggagcagtacgtgccccccagaagccccaagtag

SEQ ID NO: 22058 - DNA, 1962 bp, Artificial Sequence
  Description of Artificial Sequence: Synthetic coding sequence
atgctgctgttcgtggagcaggtggccagcaagggcaccggcctgaaccccaacgccaaggtgtggcaggagatcgcccccggcaacaccgacgccacccccgtgacccacggcaccgagagcagctggcacgagatcgccgccaccagcggcgcccaccccgagggcaacgccgagctgagcgaggacatctgcaaggagtacgaggtgatgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcaagtacctgagagaggaggtgaagaccttccagggcaagcccatcatggcccccttccccaacggcagcttcgtgaacggcttcaacagccccggcagctacaagaccaacgccgccgccatgaacatgggcagacccttccagaagaacagagtgaagccccagttcagaagcagcggcggcagcgagcacagcaccgagggcagcgtgagcctgggcgacggccagctgaacagatacagcagcagaaacttccccgccgagagacacaaccccaccgtgaccggccaccaggagcagacctacctgcagaaggagaccagcaccctgcaggtggagcagaacggcgactacggcagaggcagaagaaccctgttcagaggcagaagaagaagagaggacgacagaatcagcagaccccaccccagcaccgccgagagcaaggcccccacccccaagttcgacctgctggccagcaacttcccccccctgcccggcagcagcagcagaatgcccggcgagctggtgctggagaacagaatgagcgacgtggtgaagggcgtgtacaaggagaaggacaacgaggagctgaccatcagctgccccgtgcccgccgacgagcagaccgagtgcaccagcgcccagcagctgaacatgagcaccagcagcccctgcgccgccgagctgaccgccctgagcaccacccagcaggagaaggacctgatcgaggacagcagcgtgcagaaggacggcctgaaccagaccaccatccccgtgagcccccccagcaccaccaagcccagcagagccagcaccgccagcccctgcaacaacaacatcaacgccgccaccgccgtggccctgcaggagcccagaaagctgagctacgccgaggtgtgccagaagccccccaaggagcccagcagcgtgctggtgcagcccctgagagagctgagaagcaacgtggtgagccccaccaagaacgaggacaacggcgcccccgagaacagcgtggagaagccccacgagaagcccgaggccagagccagcaaggactacagcggcttcagaggcaacatcatccccagaggcgccgccggcaagatcagagagcagagaagacagttcagccacagagccatcccccagggcgtgaccagaagaaacggcaaggagcagtacgtgccccccagaagccccaagtag

SEQ ID NO: 22059 - DNA, 1125 bp, Artificial Sequence
  Description of Artificial Sequence: Synthetic coding sequence
atgctgctgttcgtggagcaggtggccagcaagggcaccggcctgaaccccaacgccaaggtgtggcaggagatcgcccccggcaacaccgacgccacccccgtgacccacggcaccgagagcagctggcacgagatcgccgccaccagcggcgcccaccccgagggcaacgccgagctgagcgaggacatctgcaaggagtacgaggtgatgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcaagtacctgagagaggaggtgaagaccttccagggcaagcccatcatggccagaatcaaggccatcaacaccttcttcgccaagaacggctacagactgatggacagcagcatctacagccaccccatccagacccaggcccagtacgccagccccgtgttcatgcagcccgtgtacaacccccaccagcagtacagcgtgtacagcatcgtgccccagagctggagccccaaccccaccccctacttcgagacccccctggcccccttccccaacggcagcttcgtgaacggcttcaacagccccggcagctacaagaccaacgccgccgccatgaacatgggcagacccttccagaagatcgtgtag

SEQ ID NO: 22060 - DNA, 2175 bp, Artificial Sequence
  Description of Artificial Sequence: Synthetic coding sequence
atgctgctgttcgtggagcaggtggccagcaagggcaccggcctgaaccccaacgccaaggtgtggcaggagatcgcccccggcaacaccgacgccacccccgtgacccacggcaccgagagcagctggcacgagatcgccgccaccagcggcgcccaccccgagggcaacgccgagctgagcgaggacatctgcaaggagtacgaggtgatgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcaagtacctgagagaggaggtgaagaccttccagggcaagcccatcatggccagaatcaaggccatcaacaccttcttcgccaagaacggctacagactgatggacagcagcatctacagccaccccatccagacccaggcccagtacgccagccccgtgttcatgcagcccgtgtacaacccccaccagcagtacagcgtgtacagcatcgtgccccagagctggagccccaaccccaccccctacttcgagacccccctggcccccttccccaacggcagcttcgtgaacggcttcaacagccccggcagctacaagaccaacgccgccgccatgaacatgggcagacccttccagaagaacagagtgaagccccagttcagaagcagcggcggcagcgagcacagcaccgagggcagcgtgagcctgggcgacggccagctgaacagatacagcagcagaaacttccccgccgagagacacaaccccaccgtgaccggccaccaggagcagacctacctgcagaaggagaccagcaccctgcaggtggagcagaacggcgactacggcagaggcagaagaaccctgttcagaggcagaagaagaagagaggacgacagaatcagcagaccccaccccagcaccgccgagagcaaggcccccacccccaagttcgacctgctggccagcaacttcccccccctgcccggcagcagcagcagaatgcccggcgagctggtgctggagaacagaatgagcgacgtggtgaagggcgtgtacaaggagaaggacaacgaggagctgaccatcagctgccccgtgcccgccgacgagcagaccgagtgcaccagcgcccagcagctgaacatgagcaccagcagcccctgcgccgccgagctgaccgccctgagcaccacccagcaggagaaggacctgatcgaggacagcagcgtgcagaaggacggcctgaaccagaccaccatccccgtgagcccccccagcaccaccaagcccagcagagccagcaccgccagcccctgcaacaacaacatcaacgccgccaccgccgtggccctgcaggagcccagaaagctgagctacgccgaggtgtgccagaagccccccaaggagcccagcagcgtgctggtgcagcccctgagagagctgagaagcaacgtggtgagccccaccaagaacgaggacaacggcgcccccgagaacagcgtggagaagccccacgagaagcccgaggccagagccagcaaggactacagcggcttcagaggcaacatcatccccagaggcgccgccggcaagatcagagagcagagaagacagttcagccacagagccatcccccagggcgtgaccagaagaaacggcaaggagcagtacgtgccccccagaagccccaagtag

SEQ ID NO: 22061 - DNA, 2193 bp, Artificial Sequence
  Description of Artificial Sequence: Synthetic coding sequence
atgctgctgttcgtggagcaggtggccagcaagggcaccggcctgaaccccaacgccaaggtgtggcaggagatcgcccccggcaacaccgacgccacccccgtgacccacggcaccgagagcagctggcacgagatcgccgccaccagcggcgcccaccccgaggtgagcgtgttcaacaccggcaacgccgagctgagcgaggacatctgcaaggagtacgaggtgatgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcaagtacctgagagaggaggtgaagaccttccagggcaagcccatcatggccagaatcaaggccatcaacaccttcttcgccaagaacggctacagactgatggacagcagcatctacagccaccccatccagacccaggcccagtacgccagccccgtgttcatgcagcccgtgtacaacccccaccagcagtacagcgtgtacagcatcgtgccccagagctggagccccaaccccaccccctacttcgagacccccctggcccccttccccaacggcagcttcgtgaacggcttcaacagccccggcagctacaagaccaacgccgccgccatgaacatgggcagacccttccagaagaacagagtgaagccccagttcagaagcagcggcggcagcgagcacagcaccgagggcagcgtgagcctgggcgacggccagctgaacagatacagcagcagaaacttccccgccgagagacacaaccccaccgtgaccggccaccaggagcagacctacctgcagaaggagaccagcaccctgcaggtggagcagaacggcgactacggcagaggcagaagaaccctgttcagaggcagaagaagaagagaggacgacagaatcagcagaccccaccccagcaccgccgagagcaaggcccccacccccaagttcgacctgctggccagcaacttcccccccctgcccggcagcagcagcagaatgcccggcgagctggtgctggagaacagaatgagcgacgtggtgaagggcgtgtacaaggagaaggacaacgaggagctgaccatcagctgccccgtgcccgccgacgagcagaccgagtgcaccagcgcccagcagctgaacatgagcaccagcagcccctgcgccgccgagctgaccgccctgagcaccacccagcaggagaaggacctgatcgaggacagcagcgtgcagaaggacggcctgaaccagaccaccatccccgtgagcccccccagcaccaccaagcccagcagagccagcaccgccagcccctgcaacaacaacatcaacgccgccaccgccgtggccctgcaggagcccagaaagctgagctacgccgaggtgtgccagaagccccccaaggagcccagcagcgtgctggtgcagcccctgagagagctgagaagcaacgtggtgagccccaccaagaacgaggacaacggcgcccccgagaacagcgtggagaagccccacgagaagcccgaggccagagccagcaaggactacagcggcttcagaggcaacatcatccccagaggcgccgccggcaagatcagagagcagagaagacagttcagccacagagccatcccccagggcgtgaccagaagaaacggcaaggagcagtacgtgccccccagaagccccaagtag

SEQ ID NO: 22062 - DNA, 567 bp, Artificial Sequence
  Description of Artificial Sequence: Synthetic coding sequence
atgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcatcctgaagagaagaagctag

SEQ ID NO: 22063 - DNA, 2172 bp, Artificial Sequence
  Description of Artificial Sequence: Synthetic coding sequence
atgctgctgttcgtggaggtggccagcaagggcaccggcctgaaccccaacgccaaggtgtggcaggagatcgcccccggcaacaccgacgccacccccgtgacccacggcaccgagagcagctggcacgagatcgccgccaccagcggcgcccaccccgagggcaacgccgagctgagcgaggacatctgcaaggagtacgaggtgatgtacagcagcagctgcgagaccaccagaaacaccaccggcatcgaggagagcaccgacggcatgatcctgggccccgaggacctgagctaccagatctacgacgtgagcggcgagagcaacagcgccgtgagcaccgaggacctgaaggagtgcctgaagaagcagctggagttctgcttcagcagagagaacctgagcaaggacctgtacctgatcagccagatggacagcgaccagttcatccccatctggaccgtggccaacatggaggagatcaagaagctgaccaccgaccccgacctgatcctggaggtgctgagaagcagccccatggtgcaggtggacgagaagggcgagaaggtgagacccagccacaagagatgcatcgtgatcctgagagagatccccgagaccacccccatcgaggaggtgaagggcctgttcaagagcgagaactgccccaaggtgatcagctgcgagttcgcccacaacagcaactggtacatcaccttccagagcgacaccgacgcccagcaggccttcaagtacctgagagaggaggtgaagaccttccagggcaagcccatcatggccagaatcaaggccatcaacaccttcttcgccaagaacggctacagactgatggacagcagcatctacagccaccccatccagacccaggcccagtacgccagccccgtgttcatgcagcccgtgtacaacccccaccagcagtacagcgtgtacagcatcgtgccccagagctggagccccaaccccaccccctacttcgagacccccctggcccccttccccaacggcagcttcgtgaacggcttcaacagccccggcagctacaagaccaacgccgccgccatgaacatgggcagacccttccagaagaacagagtgaagccccagttcagaagcagcggcggcagcgagcacagcaccgagggcagcgtgagcctgggcgacggccagctgaacagatacagcagcagaaacttccccgccgagagacacaaccccaccgtgaccggccaccaggagcagacctacctgcagaaggagaccagcaccctgcaggtggagcagaacggcgactacggcagaggcagaagaaccctgttcagaggcagaagaagaagagaggacgacagaatcagcagaccccaccccagcaccgccgagagcaaggcccccacccccaagttcgacctgctggccagcaacttcccccccctgcccggcagcagcagcagaatgcccggcgagctggtgctggagaacagaatgagcgacgtggtgaagggcgtgtacaaggagaaggacaacgaggagctgaccatcagctgccccgtgcccgccgacgagcagaccgagtgcaccagcgcccagcagctgaacatgagcaccagcagcccctgcgccgccgagctgaccgccctgagcaccacccagcaggagaaggacctgatcgaggacagcagcgtgcagaaggacggcctgaaccagaccaccatccccgtgagcccccccagcaccaccaagcccagcagagccagcaccgccagcccctgcaacaacaacatcaacgccgccaccgccgtggccctgcaggagcccagaaagctgagctacgccgaggtgtgccagaagccccccaaggagcccagcagcgtgctggtgcagcccctgagagagctgagaagcaacgtggtgagccccaccaagaacgaggacaacggcgcccccgagaacagcgtggagaagccccacgagaagcccgaggccagagccagcaaggactacagcggcttcagaggcaacatcatccccagaggcgccgccggcaagatcagagagcagagaagacagttcagccacagagccatcccccagggcgtgaccagaagaaacggcaaggagcagtacgtgccccccagaagccccaagtag

SEQ ID NO: 22064 - DNA, 2217 bp, Artificial Sequence
  Description of Artificial Sequence: Synthetic coding sequence
atgaccagcgaccaggacgccaaggtggtggccgagccccagacccagagagtgcaggagggcaaggacagcgcccacctgatgaacggccccatcagccagaccaccagccagaccagcagcatcccccccctgagccaggtgcccgccaccaaggtgagcgagctgaaccccaacgccgaggtgtggggcgcccccgtgctgcacctggaggccagcagcgccgccgacggcgtgagcgccgcctgggaggaggtggccggccaccacgccgacagaggcccccagggcagcgacgccaacggcgacggcgaccagggccacgagaacgccgccctgcccgacccccaggagagcgaccccgccgacatgaacgccctggccctgggccccagcgagtacgacagcctgcccgagaacagcgagaccggcggcaacgagagccagcccgacagccaggaggaccccagagaggtgctgaagaagaccctggagttctgcctgagcagagagaacctggccagcgacatgtacctgatcagccagatggacagcgaccagtacgtgcccatcaccaccgtggccaacctggaccacatcaagaagctgagcaccgacgtggacctgatcgtggaggtgctgagaagcctgcccctggtgcaggtggacgagaagggcgagaaggtgagacccaaccagaacagatgcatcgtgatcctgagagagatcagcgagagcacccccgtggaggaggtggaggccctgttcaagggcgacaacctgcccaagttcatcaactgcgagttcgcctacaacgacaactggttcatcaccttcgagaccgaggccgacgcccagcaggcctacaagtacctgagagaggaggtgaagaccttccagggcaagcccatcaaggccagaatcaaggccaaggccatcgccatcaacaccttcctgcccaagaacggcttcagacccctggacgtgagcctgtacgcccagcagagatacgccaccagcttctacttcccccccatgtacagcccccagcagcagttccccctgtacagcctgatcaccccccagacctggagcgccacccacagctacctggacccccccctggtgacccccttccccaacaccggcttcatcaacggcttcaccagccccgccttcaagcccgccgccagccccctgaccagcctgagacagtacccccccagaagcagaaaccccagcaagagccacctgagacacgccatccccagcgccgagagaggccccggcctgctggagagccccagcatcttcaacttcaccgccgacagactgatcaacggcgtgagaagcccccagaccagacaggccggccagaccagaaccagaatccagaaccccagcgcctacgccaagagagaggccggccccggcagagtggagcccggcagcctggagagcagccccggcctgggcagaggcagaaagaacagcttcggctacagaaagaagagagaggagaagttcaccagcagccagacccagagccccaccccccccaagccccccagccccagcttcgagctgggcctgagcagcttcccccccctgcccggcgccgccggcaacctgaagaccgaggacctgttcgagaacagactgagcagcctgatcatcggccccagcaaggagagaaccctgagcgccgacgccagcgtgaacaccctgcccgtggtggtgagcagagagcccagcgtgcccgccagctgcgccgtgagcgccacctacgagagaagccccagccccgcccacctgcccgacgaccccaaggtggccgagaagcagagagagacccacagcgtggacagactgcccagcgccctgaccgccaccgcctgcaagagcgtgcaggtgaacggcgccgccaccgagctgagaaagcccagctacgccgagatctgccagagaaccagcaaggagccccccagcagccccctgcagccccagaaggagcagaagcccaacaccgtgggctgcggcaaggaggagaagaagctggccgagcccgccgagagatacagagagccccccgccctgaagagcacccccggcgcccccagagaccagagaagacccgccggcggcagacccagccccagcgccatgggcaagagactgagcagagagcagagcaccccccccaagagcccccagtag

SEQ ID NO: 22065 - DNA, 396 bp, Artificial Sequence
  Description of Artificial Sequence: Synthetic coding sequence
atgaccagcgaccaggacgccaaggtggtggccgagccccagacccagagagtgcaggagggcaaggacagcgcccacctgatgaacggccccatcagccagaccaccagccagaccagcagcatcccccccctgagccaggtgcccgccaccaaggtgagcgagctgaaccccaacgccgaggtgtggggcgcccccgtgctgcacctggaggccagcagcgccgccgacggcgtgagcgccgcctgggaggaggtggccggccaccacgccgacagaggcccccagggcagcgacgccaacggcgacggcgaccagggccacgagaacgccgccctgcccgacccccaggagagcgaccccgccgacatgaacgccctggccctgggcccctag

SEQ ID NO: 22066 - DNA, 174 bp, Artificial Sequence
  Description of Artificial Sequence: Synthetic coding sequence
atgaccagcgaccaggacgccaaggtggtggccgagccccagacccagagagtgcaggagggcaaggacagcgcccacctgatgaacggccccatcagccagaccaccagccagaccagcagcatcccccccctgagccaggtgcccgccaccaaggtgagcgagctgaactag

SEQ ID NO: 22067 - DNA, 552 bp, Artificial Sequence
  Description of Artificial Sequence: Synthetic coding sequence
tgaagcttcgagctgggcctgagcagcttcccccccctgcccggcgccgccggcaacctgaagaccgaggacctgttcgagaacagactgagcagcctgatcatcggccccagcaaggagagaaccctgagcgccgacgccagcgtgaacaccctgcccgtggtggtgagcagagagcccagcgtgcccgccagctgcgccgtgagcgccacctacgagagaagccccagccccgcccacctgcccgacgaccccaaggtggccgagaagcagagagagacccacagcgtggacagactgcccagcgccctgaccgccaccgcctgcaagagcgtgcaggtgaacggcgccgccaccgtgagaaccagctgcctgcccagctgcaccaccgccgccagactgtggtgcgagcagaccctgagaacccccgcccccgccagattcctgatcaccagcaacctggtgggcttctacctgagactgagcgtgctgtgcttcctgtacaagatccccctgatcttcgccaacaacttccccctgaccaccctgtag

SEQ ID NO: 22068 - DNA, 1020 bp, Artificial Sequence
  Description of Artificial Sequence: Synthetic coding sequence
tgaagcatcttcaacttcaccgccgacagactgatcaacggcgtgagaagcccccagaccagacaggccggccagaccagaaccagaatccagaaccccagcgcctacgccaagagagaggccggccccggcagagtggagcccggcagcctggagagcagccccggcctgggcagaggcagaaagaacagcttcggctacagaaagaagagagaggagaagttcaccagcagccagacccagagccccaccccccccaagccccccagccccagcttcgagctgggcctgagcagcttcccccccctgcccggcgccgccggcaacctgaagaccgaggacctgttcgagaacagactgagcagcctgatcatcggccccagcaaggagagaaccctgagcgccgacgccagcgtgaacaccctgcccgtggtggtgagcagagagcccagcgtgcccgccagctgcgccgtgagcgccacctacgagagaagccccagccccgcccacctgcccgacgaccccaaggtggccgagaagcagagagagacccacagcgtggacagactgcccagcgccctgaccgccaccgcctgcaagagcgtgcaggtgaacggcgccgccaccgtgagaaccagctgcctgcccagctgcaccaccgccgccagactgtggtgcgagcagaccctgagaacccccgcccccgccagattcctgatcaccagcaacctggagctgagaaagcccagctacgccgagatctgccagagaaccagcaaggagccccccagcagccccctgcagccccagaaggagcagaagcccaacaccgtgggctgcggcaaggaggagaagaagctggccgagcccgccgagagatacagagagccccccgccctgaagagcacccccggcgcccccagagaccagagaagacccgccggcggcagacccagccccagcgccatgggcaagagactgagcagagagcagagcaccccccccaagagcccccagtag

SEQ ID NO: 22069 - DNA, 1293 bp, Artificial Sequence
  Description of Artificial Sequence: Synthetic coding sequence
atggccgaggccgtgctgatcgacctgttcggcctgaagctgaacagccagaagaactgccaccagaccctgctgaagaccctgaacgccgtgcagtaccaccacgccgccaaggccaagttcctgtgcatcatgtgctgcagcaacatcagctacgagagagacggcgagcaggacaactgcgagatcgagaccagcaacggcctgagcgccctgctggaggagttcgagatcgtgagctgccccagcatggccgccaccctgtacaccatcaagcagaagatcgacgagaagaacctgagcagcatcaaggtgatcgtgcccagacacagaaagaccctgatgaaggccttcatcgaccagctgttcaccgacgtgtacaacttcgagttcgaggacctgcaggtgaccttcagaggcggcctgttcaagcagagcatcgagatcaacgtgatcaccgcccaggagctgagaggcatccagaacgagatcgagaccttcctgagaagcctgcccgccctgagaggcaagctgaccatcatcaccagcagcctgatccccgacatcttcatccacggcttcaccaccagaaccggcggcatcagctacatccccaccctgagcagcttcaacctgttcagcagcagcaagagaagagaccccaaggtggtggtgcaggagaacctgagaagactggccaacgccgccggcttcaacgtggagaagttctacagaatcaagacccaccacagcaacgacatctggatcatgggcagaaaggagcccgacagctacgacggcatcaccaccaaccagagaggcgtgaccatcgccgccctgggcgccgactgcatccccatcgtgttcgccgaccccgtgaagaaggcctgcggcgtggcccacgccggctggaagggcaccctgctgggcgtggccatggccaccgtgaacgccatgatcgccgagtacggctgcagcctggaggacatcgtggtggtgctgggccccagcgtgggcccctgctgcttcaccctgcccagagagagcgccgaggccttccacaacctgcaccccgcctgcgtgcagctgttcgacagccccaacccctgcatcgacatcagaaaggccaccagaatcctgctggagcagggcggcatcctgccccagaacatccaggaccagaaccaggacctgaacctgtgcaccagctgccaccccgacaagttcttcagccacgtgagagacggcctgaacttcggcacccagatcggcttcatcagcatcaaggagtag

SEQ ID NO: 22070 - DNA, 495 bp, Artificial Sequence
  Description of Artificial Sequence: Synthetic coding sequence
atggccgaggccgtgctgatcgacctgttcggcctgaagctgaacagccagaagaactgccaccagaccctgctgaagaccctgaacgccgtgcagtaccaccacgccgccaaggccaagttcctgtgcatcatgtgctgcagcaacatcagctacgagagagacggcgagcaggacaactgcgagatcgagaccagcaacggcctgagcgccctgctggaggagttcgagatcgtgagctgccccagcatggccgccaccctgtacaccatcaagcagaagatcgacgagaagaacctgagcagcatcaaggtgatcgtgcccagacacagaaagaccctgatgaaggccttcatcgaccagctgttcaccgacgtgtacaacttcgagttcgaggacctgcaggtgaccttcagaggcggcctgttcaagcagagcatcgagatcaacgtgatcaccgcccaggagctgagaggcatccagaacgagatctag

SEQ ID NO: 22071 - DNA, 1293 bp, Artificial Sequence; identical to SEQ ID NO: 22069
  Description of Artificial Sequence: Synthetic coding sequence

SEQ ID NO: 22072 - DNA, 5472 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggcgagcactgcgagaagtgcctggacggctacatcggcgacagcatcagaggcgccccccagttctgccagccctgcccctgccccctgccccacctggccaacttcgccgagagctgctacagaaagaacggcgccgtgagatgcatctgcaacgagaactacgccggccccaactgcgagagatgcgcccccggctactacggcaaccccctgctgatcggcagcacctgcaagaagtgcgactgcagcggcaacagcgaccccaacctgatcttcgaggactgcgacgaggtgaccggccagtgcagaaactgcctgagaaacaccaccggcttcaagtgcgagagatgcgcccccggctactacggcgacgccagaatcgccaagaactgcgccgtgtgcaactgcggcggcggcccctgcgacagcgtgaccggcgagtgcctggaggagggcttcgagccccccaccggcatggactgccccaccatcagctgcgacaagtgcgtgtgggacctgaccgacgacctgagactggccgccctgagcatcgaggagggcaagagcggcgtgctgagcgtgagcagcggcgccgccgcccacagacacgtgaacgagatcaacgccaccatctacctgctgaagaccaagctgagcgagagagagaaccagtacgccctgagaaagatccagatcaacaacgccgagaacaccatgaagagcctgctgagcgacgtggaggagctggtggagaaggagaaccaggccagcagaaagggccagctggtgcagaaggagagcatggacaccatcaaccacgccagccagctggtggagcaggcccacgacatgagagacaagatccaggagatcaacaacaagatgctgtactacggcgaggagcacgagctgagccccaaggagatcagcgagaagctggtgctggcccagaagatgctggaggagatcagaagcagacagcccttcttcacccagagagagctggtggacgaggaggccgacgaggcctacgagctgctgagccaggccgagagctggcagagactgcacaacgagaccagaaccctgttccccgtggtgctggagcagctggacgactacaacgccaagctgagcgacctgcaggaggccctggaccaggccctgaactacgtgagagacgccgaggacatgaacagagccaccgccgccagacagagagaccacgagaagcagcaggagagagtgagagagcagatggaggtggtgaacatgagcctgagcaccagcgccgacagcctgaccacccccagactgaccctgagcgagctggacgacatcatcaagaacgccagcggcatctacgccgagatcgacggcgccaagagcgagctgcaggtgaagctgagcaacctgagcaacctgagccacgacctggtgcaggaggccatcgaccacgcccaggacctgcagcaggaggccaacgagctgagcagaaagctgcacagcagcgacatgaacggcctggtgcagaaggccctggacgccagcaacgtgtacgagaacatcgtgaactacgtgagcgaggccaacgagaccgccgagttcgccctgaacaccaccgacagaatctacgacgccgtgagcggcatcgacacccagatcatctaccacaaggacgagagcgagaacctgctgaaccaggccagagagctgcaggccaaggccgagagcagcagcgacgaggccgtggccgacaccagcagaagagtgggcggcgccctggccagaaagagcgccctgaagaccagactgagcgacgccgtgaagcagctgcaggccgccgagagaggcgacgcccagcagagactgggccagagcagactgatcaccgaggaggccaacagaaccaccatggaggtgcagcaggccaccgcccccatggccaacaacctgaccaactggagccagaacctgcagcacttcgacagcagcgcctacaacaccgccgtgaacagcgccagagacgccgtgagaaacctgaccgaggtggtgccccagctgctggaccagctgagaaccgtggagcagaagagacccgccagcaacgtgagcgccagcatccagagaatcagagagctgatcgcccagaccagaagcgtggccagcaagatccaggtgagcatgatgttcgacggccagagcgccgtggaggtgcacagcagaaccagcatggacgacctgaaggccttcaccagcctgagcctgtacatgaagccccccgtgaagagacccgagctgaccgagaccgccgaccagttcatcctgtacctgggcagcaagaacgccaagaaggagtacatgggcctggccatcaagaacgacaacctggtgtacgtgtacaacctgggcaccaaggacgtggagatccccctggacagcaagcccgtgagcagctggcccgcctacttcagcatcgtgaagatcgagagagtgggcaagcacggcaaggtgttcctgaccgtgcccagcctgagcagcaccgccgaggagaagttcatcaagaagggcgagttcagcggcgacgacagcctgctggacctggaccccgaggacaccgtgttctacgtgggcggcgtgcccagcaacttcaagctgcccaccagcctgaacctgcccggcttcgtgggctgcctggagctggccaccctgaacaacgacgtgatcagcctgtacaacttcaagcacatctacaacatggaccccagcaccagcgtgccctgcgccagagacaagctggccttcacccagagcagagccgccagctacttcttcgacggcagcggctacgccgtggtgagagacatcaccagaagaggcaagttcggccaggtgaccagattcgacatcgaggtgagaacccccgccgacaacggcctgatcctgctgatggtgaacggcagcatgttcttcagactggagatgagaaacggctacctgcacgtgttctacgacttcggcttcagcggcggccccgtgcacctggaggacaccctgaagaaggcccagatcaacgacgccaagtaccacgagatcagcatcatctaccacaacgacaagaagatgatcctggtggtggacagaagacacgtgaagagcatggacaacgagaagatgaagatccccttcaccgacatctacatcggcggcgccccccccgagatcctgcagagcagagccctgagagcccacctgcccctggacatcaacttcagaggctgcatgaagggcttccagttccagaagaaggacttcaacctgctggagcagaccgagaccctgggcgtgggctacggctgccccgaggacagcctgatcagcagaagagcctacttcaacggccagagcttcatcgccagcatccagaagatcagcttcttcgacggcttcgagggcggcttcaacttcagaaccctgcagcccaacggcctgctgttctactacgccagcggcagcgacgtgttcagcatcagcctggacaacggcaccgtgatcatggacgtgaagggcatcaaggtgcagagcgtggacaagcagtacaacgacggcctgagccacttcgtgatcagcagcgtgagccccaccagatacgagctgatcgtggacaagagcagagtgggcagcaagaaccccaccaagggcaagatcgagcagacccaggccagcgagaagaagttctacttcggcggcagccccatcagcgcccagtacgccaacttcaccggctgcatcagcaacgcctacttcaccagagtggacagagacgtggaggtggaggacttccagagatacaccgagaaggtgcacaccagcctgtacgagtgccccatcgagagcagccccctgttcctgctgcacaagaagggcaagaacctgagcaagcccaaggccagccagaacaagaagggcggcaagagcaaggacgcccccagctgggaccccgtggccctgaagctgcccgagagaaacacccccagaaacagccactgccacctgagcaacagccccagagccatcgagcacgcctaccagtacggcggcaccgccaacagcagacaggagttcgagcacctgaagggcgacttcggcgccaagagccagttcagcatcagactgagaaccagaagcagccacggcatgatcttctacgtgagcgaccaggaggagaacgacttcatgaccctgttcctggcccacggcagactggtgtacatgttcaacgtgggccacaagaagctgaagatcagaagccaggagaagtacaacgacggcctgtggcacgacgtgatcttcatcagagagagaagcagcggcagactggtgatcgacggcctgagagtgctggaggagagcctgccccccaccgaggccacctggaagatcaagggccccatctacctgggcggcgtggcccccggcaaggccgtgaagaacgtgcagatcaacagcatctacagcttcagcggctgcctgagcaacctgcagctgaacggcgccagcatcaccagcgccagccagaccttcagcgtgaccccctgcttcgagggccccatggagaccggcacctacttcagcaccgagggcggctacgtggtgctggacgagagcttcaacatcggcctgaagttcgagatcgccttcgaggtgagacccagaagcagcagcggcaccctggtgcacggccacagcgtgaacggcgagtacctgaacgtgcacatgaagaacggccaggtgatcgtgaaggtgaacaacggcatcagagacttcagcaccagcgtgacccccaagcagagcctgtgcgacggcagatggcacagaatcaccgtgatcagagacagcaacgtggtgcagctggacgtggacagcgaggtgaaccacgtggtgggccccctgaaccccaagcccatcgaccacagagagcccgtgttcgtgggcggcgtgcccgagagcctgctgacccccagactggcccccagcaagcccttcaccggctgcatcagacacttcgtgatcgacggccaccccgtgagcttcagcaaggccgccctggtgagcggcgccgtgagcatcaacagctgccccgccgcctag

SEQ ID NO: 22073 - DNA, 363 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgaggtgcagtgcccctgccactgccaccccgccggcgcccccgccccccccagagccgtgccccacagcagcttcagcctgagcccccccctgagcagcccccagtgcctggagagcttcacctgggccagaagcgtgagaaagctggagatcaagagcttccccctgtag

SEQ ID NO: 22074 - DNA, 1263 bp, Artificial Sequence
  Description of Artificial Sequence: Synthetic coding sequence
atggacaccaagagatgcttcgccaacagattcgacgactaccagggcagcctgctggccggccagtgcgaggaggccgtggcccccctggtgaccgccaccatcgagagaatcctgcaggagctgccccccctgggcggcggcgccgaggccagaggcgccaccgccggcgccagcgcctgccagggcggcctgtacggcggcgtggccggcgtggcctacatgctgtaccacgtgagccagagccccctgttcgccaccgccagagagagatacctgagaagcgccaagagactgatcgacgcctgcgccagagccgaggagtggggcgagcccgacgccgacaccagagccgccttcctgctgggcggcgccggcgtgtacgccgtggccaccctggtgtaccacgccctgggcagaagcgactacgtgcagcccctgggcaagttcagagccctgtgcgccgtgtgcgcccccgtgagcttcctggagtgcggcagcgacgagctgttcgtgggcagagccggctacctgtgcgccgccctggtgctgaagcagaagctggcccaggaggtgctgacccccgcccagatcaagagcatctgccaggccatcctggacagcggcaagcagtacgccatcaagaagagaaagcccttccccctgatgtacagctactacggcaccgagtacctgggcgccgcccacggcctgagcagcatcctgcagatgctgctgagctaccacgagcacctgaagcccagcgacagagagctggtgtggcagagcgtggacttcctgatggagcaggagcagaactgcaactggccccccgagctgggcgagaccatcgagagagagaacgagctggtgcactggtgccacggcgcccccggcatcgcctacctgttcgccaaggcctacctggtgagcaagaagccccagtacctggacacctgcatcagatgcggcgagctgacctggcagaagggcctgctgaagaagggccccggcatctgccacggcgtggccggcagcgcctacgtgttcctgctgctgtacagactgaccggcaacagcaagtacatctacagagcccagagattcgcccagttcctgttcaccgaggagttcaaggccggcagcagagtgctggagagcatctacagcctgtacgagggcttcagcggcaccgtgtgcttcctgatcgacctgctgcagcccaaccaggccgagttccccctgttcagcgtgttcgtgtag

SEQ ID NO: 22075 - DNA, 1167 bp, Artificial Sequence
  Description of Artificial Sequence: Synthetic coding sequence
atggacaccaagagatgcttcgccaacagattcgacgactaccagggcagcctgctggccggccagtgcgaggaggccgtggcccccctggtgaccgccaccatcgagagaatcctgcaggagctgccccccctgggcggcggcgccgaggccagaggcgccaccgccggcgccagcgcctgccagggcggcctgtacggcggcgtggccggcgtggcctacatgctgtaccacgtgagccagagccccctgttcgccaccgccagagagagatacctgagaagcgccaagagactgatcgacgcctgcgccagagccgaggagtggggcgagcccgacgccgacaccagagccgccttcctgctgggcggcgccggcgtgtacgccgtggccaccctggtgtaccacgccctgggcagaagcgactacgtgcagcccctgggcaagttcagagccctgtgcgccgtgtgcgcccccgtgagcttcctggagtgcggcagcgacgagctgttcgtgggcagagccggctacctgtgcgccgccctggtgctgaagcagaagctggcccaggaggtgctgacccccgcccagatcaagagcatctgccaggccatcctggacagcggcaagcagtacgccatcaagaagagaaagcccttccccctgatgtacagctactacggcaccgagtacctgggcgccgcccacggcctgagcagcatcctgcagatgctgctgagctaccacgagcacctgaagcccagcgacagagagctggtgtggcagagcgtggacttcctgatggagcaggagcagaactgcaactggccccccgagctgggcgagaccatcgagagagagaacgagctggtgcactggtgccacggcgcccccggcatcgcctacctgttcgccaaggcctacctggtgagcaagaagccccagtacctggacacctgcatcagatgcggcgagctgacctggcagaagggcctgctgaagaagggccccggcatctgccacggcgtggccggcagcgcctacgtgttcctgctgctgtacagactgaccggcaacagcaagtacatctacagagcccagagcagcttccccgtgaacctgatcaagatggagcacctgctgtacaccagacagcactgcttctag

SEQ ID NO: 22076 - DNA, 243 bp, Artificial Sequence
  Description of Artificial Sequence: Synthetic coding sequence
atgagccagcagaagcagcagagctggaagccccccaacgtgcccaagtgcagccccccccagagaagcaacccctgcctggccccctacagcaccccctgcggcgccccccacagcgagggctgccacagcagcagccagagacccgaggtgcagaagcccagaagagccagacagaagctgagatgcctgagcagaggcaccacctaccactgcaaggaggaggagtgcgagggcgactag

SEQ ID NO: 22077 - DNA, 4410 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 22078 - DNA, 2013 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagccagtacgactacagcgaggacttcctgtgcgactgcagcgagaaggccatcaacagaaactacctgaagcagcccgtggtgaaggagaaggagaagaagaagtacaacgtgagcaagatcagccagagcaagggccagaaggagatcagcgtggagaagaagcacacctggaacgccagcctgttcaacagccagatccacatgatcgcccagagaagagacgccatggcccacagaatcctgagcgccagactgcacaagatcaagggcctgaagaacgagctggccgacatgcaccacaagctggaggccatcctgaccgagaaccagttcctgaagcagctgcagctgagacacctgaaggccatcggcaagtacgagaacagccagaacaacctgccccagatcatggccaagcaccagaacgaggtgaagaacctgagacagctgctgagaaagagccaggagaaggagagaaccctgagcagaaagctgagagagaccgacagccagctgctgaagaccaaggacatcctgcaggccctgcagaagctgagcgaggacaagaacctggccgagagagaggagctgacccacaagctgagcatcatcaccaccaagatggacgccaacgacaagaagatccagagcctggagaagcagctgagactgaactgcagagccttcagcagacagctggccatcgagaccagaaagaccctggccgcccagaccgccaccaagaccctgcaggtggaggtgaagcacctgcagcagaagctgaaggagaaggacagagagctggagatcaagaacatctacagccacagaatcctgaagaacctgcacgacaccgaggactaccccaaggtgagcagcaccaagagcgtgcaggccgacagaaagatcctgcccttcaccagcatgagacaccagggcacccagaagagcgacgtgccccccctgaccaccaagggcaagaaggccaccggcaacatcgaccacaaggagaagagcaccgagatcaaccacgagatcccccactgcgtgaacaagctgcccaagcaggaggacagcaagagaaagtacgaggacctgagcggcgaggagaagcacctggaggtgcagatcctgctggagaacaccggcagacagaaggacaagaaggaggaccaggagaagaagaacatcttcgtgaaggaggagcaggagctgccccccaagatcatcgaggtgatccaccccgagagagagagcaaccaggaggacgtgctggtgagagagaagttcaagagaagcatgcagagaaacggcgtggacgacaccctgggcaagggcaccgccccctacaccaagggccccctgagacagagaagacactacagcttcaccgaggccaccgagaacctgcaccacggcctgcccgccagcggcggccccgccaacgccggcaacatgagatacagccacagcaccggcaagcacctgagcaacagagaggagatggagctggagcacagcgacagcggctacgagcccagcttcggcaagagcagcagaatcaaggtgaaggacaccaccttcagagacaagaagagcagcctgatggaggagctgttcggcagcggctacgtgctgaagaccgaccagagcagccccggcgtggccaagggcagcgaggagcccctgcagagcaaggagagccaccccctgccccccagccaggccagcaccagccacgccttcggcgacagcaaggtgaccgtggtgaacagcatcaagcccagcagccccaccgagggcaagagaaagatcatcatctag

SEQ ID NO: 22079 - DNA, 2013 bp, Artificial Sequence; identical to SEQ ID NO: 22078
  Description of Artificial Sequence: Synthetic coding sequence

SEQ ID NO: 22080 - DNA, 2013 bp, Artificial Sequence; identical to SEQ ID NO: 22078
  Description of Artificial Sequence: Synthetic coding sequence

SEQ ID NO: 22081 - DNA, 282 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagccagtacgactacagcgaggacttcctgtgcgactgcagcgagaaggccatcaacagaaactacctgaagcagcccgtggtgaaggagaagtag

SEQ ID NO: 22082 - DNA, 210 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagccagtacgactacagcgagtag

SEQ ID NO: 22083 - DNA, 570 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagccagtacgactacagcgaggacttcctgtgcgactgcagcgagaaggccatcaacagaaactacctgaagcagcccgtggtgaaggagaaggagaagaagaagtacaacgtgagcaagatcagccagagcaagggccagaaggagatcagcgtggagaagaagcacacctggaacgccagcctgttcaacagccagatccacatgatcgcccagagaagagacgccatggcccacagaatcctgagcgccagactgcacaagatcaagggcctgaagaacgagctggccgacatgcaccacaagctggaggccatcctgaccgagaaccagttcctgaagcagctgcagctgagacacctgaaggccatcggcaagtactag

SEQ ID NO: 22084 - DNA, 192 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagctag

SEQ ID NO: 22085 - DNA, 288 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagccagtacgactacagcgaggacttcctgtgcgactgcagcgagaaggccatcaacagaaactacctgaagcagcccgtggtgaaggagaaggagaagtag

SEQ ID NO: 22086 - DNA, 285 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagccagtacgactacagcgaggacttcctgtgcgactgcagcgagaaggccatcaacagaaactacctgaagcagcccgtggtgaaggagaaggagtag

SEQ ID NO: 22087 - DNA, 327 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagagaagccccggcaccggcgacttcagcagaaacagcaacgccagcaacaagagcgtggactacagcagaagccagtgcagctgcggcagcctgagcagccagtacgactacagcgaggacttcctgtgcgactgcagcgagaaggccatcaacagaaactacctgaagcagcccgtggtgaaggagaaggagaagaagaagtacaacgtgagcaagatcagccagagcaagggctag

SEQ ID NO: 22088 - DNA, 33 bp, Artificial Sequence
  Description of Artificial Sequence: Synthetic coding sequence
atgagcctggccgacctgaccaagaccaactag

SEQ ID NO: 22089 - DNA, 93 bp, Artificial Sequence
  Description of Artificial Sequence: Synthetic coding sequence
atgagcctggccgacctgaccaagaccaacatcgacgagcacttcttcggcgtggccctggagaacaacagaagaagcgccgcctgcaagtag

SEQ ID NO: 22090 - DNA, 429 bp, Artificial Sequence
  Description of Artificial Sequence: Synthetic coding sequence
atgagcttcctgaccgtgccctacaagctgcccgtgagcctgagcgtgggcagctgcgtgatcatcaagggcaccctgatcgacagcagcatcaacgagccccagctgcaggtggacttctacaccgagatgaacgaggacagcgagatcgccttccacctgagagtgcacctgggcagaagagtggtgatgaacagcagagagttcggcatctggatgctggaggagaacctgcactacgtgcccttcgaggacggcaagcccttcgacctgagaatctacgtgtgcctgaacgagtacgaggtgaaggtgaacggcgagtacatctacgccttcgtgcacagaatcccccccagctacgtgaagatgatccaggtgtggagagacgtgagcctggacagcgtgctggtgaacaacggcagaagatag

SEQ ID NO: 22091 - DNA, 1071 bp, Artificial Sequence
  Description of Artificial Sequence: Synthetic coding sequence
atggccttcagcggcagccaggccccctacctgagccccgccgtgcccttcagcggcaccatccagggcggcctgcaggacggcttccagatcaccgtgaacggcgccgtgctgagcagcagcggcaccagattcgccgtggacttccagaccggcttcagcggcaacgacatcgccttccacttcaaccccagattcgaggacggcggctacgtggtgtgcaacaccagacagaagggcagatggggccccgaggagagaaagatgcacatgcccttccagaagggcatgcccttcgacctgtgcttcctggtgcagagcagcgacttcaaggtgatggtgaacggcagcctgttcgtgcagtacttccacagagtgcccttccacagagtggacaccatcagcgtgaacggcagcgtgcagctgagctacatcagcttccagaaccccagaaccgtgcccgtgcagcccgccttcagcaccgtgcccttcagccagcccgtgtgcttcccccccagacccagaggcagaagacagaagccccccagcgtgagacccgccaaccccgcccccatcacccagaccgtgatccacaccgtgcagagcgccagcggccagatgttcagccagacccccgccatcccccccatgatgtacccccaccccgcctaccccatgcccttcatcaccaccatccccggcggcctgtaccccagcaagagcatcatcctgagcggcaccgtgctgcccagcgcccagagattccacatcaacctgtgcagcggcagccacatcgccttccacatgaaccccagattcgacgagaacgccgtggtgagaaacacccagatcaacaacagctggggcagcgaggagagaagcctgcccagaaagatgcccttcgtgagaggccagagcttcagcgtgtggatcctgtgcgaggcccactgcctgaaggtggccgtggacggccagcacgtgttcgagtactaccacagactgagaaacctgcccaccatcaacaagctggaggtgggcggcgacatccagctgacccacgtgcagacctag

SEQ ID NO: 22092 - DNA, 1068 bp, Artificial Sequence
  Description of Artificial Sequence: Synthetic coding sequence
atggccttcagcggcagccaggccccctacctgagccccgccgtgcccttcagcggcaccatccagggcggcctgcaggacggcttccagatcaccgtgaacggcgccgtgctgagcagcagcggcaccagattcgccgtggacttccagaccggcttcagcggcaacgacatcgccttccacttcaaccccagattcgaggacggcggctacgtggtgtgcaacaccagacagaagggcagatggggccccgaggagagaaagatgcacatgcccttccagaagggcatgcccttcgacctgtgcttcctggtgcagagcagcgacttcaaggtgatggtgaacggcagcctgttcgtgcagtacttccacagagtgcccttccacagagtggacaccatcagcgtgaacggcagcgtgcagctgagctacatcagcttccagaaccccagaaccgtgcccgtgcagcccgccttcagcaccgtgcccttcagccagcccgtgtgcttcccccccagacccagaggcagaagacagaagccccccagcgtgagacccgccaaccccgcccccatcacccagaccgtgatccacaccgtgcagagcgccagcggccagatgttcagcacccccgccatcccccccatgatgtacccccaccccgcctaccccatgcccttcatcaccaccatccccggcggcctgtaccccagcaagagcatcatcctgagcggcaccgtgctgcccagcgcccagagattccacatcaacctgtgcagcggcagccacatcgccttccacatgaaccccagattcgacgagaacgccgtggtgagaaacacccagatcaacaacagctggggcagcgaggagagaagcctgcccagaaagatgcccttcgtgagaggccagagcttcagcgtgtggatcctgtgcgaggcccactgcctgaaggtggccgtggacggccagcacgtgttcgagtactaccacagactgagaaacctgcccaccatcaacaagctggaggtgggcggcgacatccagctgacccacgtgcagacctag

SEQ ID NO: 22093 - DNA, 1071 bp, Artificial Sequence
  Description of Artificial Sequence: Synthetic coding sequence
atggccttcagcggctgccaggccccctacctgagccccgccgtgcccttcagcggcaccatccagggcggcctgcaggacggcttccagatcaccgtgaacggcgccgtgctgagctgcagcggcaccagattcgccgtggacttccagaccggcttcagcggcaacgacatcgccttccacttcaaccccagattcgaggacggcggctacgtggtgtgcaacaccagacagaagggcacctggggccccgaggagagaaagatgcacatgcccttccagaagggcatgcccttcgacctgtgcttcctggtgcagagcagcgacttcaaggtgatggtgaacggcagcctgttcgtgcagtacttccacagagtgcccttccacagagtggacaccatcagcgtgaacggcagcgtgcagctgagctacatcagcttccagaaccccagagccgtgcccgtgcagcccgccttcagcaccgtgcccttcagccagcccgtgtgcttcccccccagacccagaggcagaagacagaagccccccagcgtgagacccgccaaccccgcccccatcacccagaccgtgatccacaccgtgcagagcgccagcggccagatgttcagccagacccccgccatcccccccatgatgtacccccaccccgcctaccccatgcccttcatcaccaccatccccggcggcctgtaccccagcaagagcatcatcctgagcggcaccgtgctgcccagcgcccagagattccacatcaacctgtgcagcggcagccacatcgccttccacatgaaccccagattcgacgagaacgccgtggtgagaaacacccagatcaacaacagctggggcagcgaggagagaagcctgcccagaaagatgcccttcgtgagaggccagagcttcagcgtgtggatcctgtgcgaggcccactgcctgaaggtggccgtggacggccagcacgtgttcgagtactaccacagactgagaaacctgcccaccatcaacaagctggaggtgggcggcgacatccagctgacccacgtgcagacctag

SEQ ID NO: 22094 - DNA, 807 bp, Artificial Sequence
  Description of Artificial Sequence: Synthetic coding sequence
atgcacatgcccttccagaagggcatgcccttcgacctgtgcttcctggtgcagagcagcgacttcaaggtgatggtgaacggcagcctgttcgtgcagtacttccacagagtgcccttccacagagtggacaccatcagcgtgaacggcagcgtgcagctgagctacatcagcttccagaaccccagagccgtgcccgtgcagcccgccttcagcaccgtgcccttcagccagcccgtgtgcttcccccccagacccagaggcagaagacagaagccccccagcgtgagacccgccaaccccgcccccatcacccagaccgtgatccacaccgtgcagagcgccagcggccagatgttcagccagacccccgccatcccccccatgatgtacccccaccccgcctaccccatgcccttcatcaccaccatccccggcggcctgtaccccagcaagagcatcatcctgagcggcaccgtgctgcccagcgcccagagattccacatcaacctgtgcagcggcagccacatcgccttccacatgaaccccagattcgacgagaacgccgtggtgagaaacacccagatcaacaacagctggggcagcgaggagagaagcctgcccagaaagatgcccttcgtgagaggccagagcttcagcgtgtggatcctgtgcgaggcccactgcctgaaggtggccgtggacggccagcacgtgttcgagtactaccacagactgagaaacctgcccaccatcaacaagctggaggtgggcggcgacatccagctgacccacgtgcagacctag

SEQ ID NO: 22095 - DNA, 519 bp, Artificial Sequence
  Description of Artificial Sequence: Synthetic coding sequence
atggccggcagcgtggccgacagcgacgccgtggtgaagctggacgacggccacctgaacaacagcctgagcagccccgtgcaggccgacgtgtacttccccagactgatcgtgcccttctgcggccacatcaagggcggcatgagacccggcaagaaggtgctggtgatgggcatcgtggacctgaaccccgagagcttcgccatcagcctgacctgcggcgacagcgaggacccccccgccgacgtggccatcgagctgaaggccgtgttcaccgacagacagctgctgagaaacagctgcatcagcggcgagagaggcgaggagcagagcgccatcccctacttccccttcatccccgaccagcccttcagagtggagatcctgtgcgagcaccccagattcagagtgttcgtggacggccaccagctgttcgacttctaccacagaatccagaccctgagcgccatcgacaccatcaagatcaacggcgacctgcagatcaccaagctgggctag

SEQ ID NO: 22096 - DNA, 1497 bp, Artificial Sequence
  Description of Artificial Sequence: Synthetic coding sequence
atgagcaccttcggctacagaagaggcctgagcaagtacgagagcatcgacgaggacgagctgctggccagcctgagcgccgaggagctgaaggagctggagagagagctggaggacatcgagcccgacagaaacctgcccgtgggcctgagacagaagagcctgaccgagaagacccccaccggcaccttcagcagagaggccctgatggcctactgggagaaggagagccagaagctgctggagaaggagagactgggcgagtgcggcaaggtggccgaggacaaggaggagagcgaggaggaggaggacagcgacgaggaggagagaaccatcgagaccgccaagggcatcaacggcaccgtgaactacgacagcgtgaacagcgacaacagcaagcccaagatcttcaagagccagatcgagaacatcaacctgaccaacggcagcaacggcagaaacaccgagagccccgccgccatccacccctgcggcaaccccaccgtgatcgaggacgccctggacaagatcaagagcaacgaccccgacaccaccgaggtgaacctgaacaacatcgagaacatcaccacccagaccctgaccagattcgccgaggccctgaaggacaacaccgtggtgaagaccttcagcctggccaacacccacgccgacgacagcgccgccatggccatcgccgagatgctgaaggtgaacgagcacatcaccaacgtgaacgtggagagcaacttcatcaccggcaagggcatcctggccatcatgagagccctgcagcacaacaccgtgctgaccgagctgagattccacaaccagagacacatcatgggcagccaggtggagatggagatcgtgaagctgctgaaggagaacaccaccctgctgagactgggctaccacttcgagctgcccggccccagaatgagcatgaccagcatcctgaccagaaacatggacaagcagagacagaagagactgcaggagcagaagcagcaggagggctacgacggcggccccaacctgagaaccaaggtgtggcagagaggcacccccagcagcagcccctacgtgagccccagacacagcccctggagcagccccaagctgcccaagaaggtgcagaccgtgagaagcagacccctgagccccgtggccaccccccccccccccccccccccccccctgcccgagaagaagctgatcaccagaaacatcgccgaggtgatcaagcagcaggagagcgcccagagagccctgcagaacggccagaagaagaagaagggcaagaaggtgaagaagcagcccaacagcatcctgaaggagatcaagaacagcctgagaagcgtgcaggagaagaagatggaggacagcagcagacccagcaccccccagagaagcgcccacgagaacctgatggaggccatcagaggcagcagcatcaagcagctgaagagagtggaggtgcccgaggccctgagatag

SEQ ID NO: 22097 - DNA, 1524 bp, Artificial Sequence
  Description of Artificial Sequence: Synthetic coding sequence
atgagcaccttcggctacagaagaggcctgagcaagtacgagagcatcgacgaggacgagctgctggccagcctgagcgccgaggagctgaaggagctggagagagagctggaggacatcgagcccgacagaaacctgcccgtgggcctgagacagaagagcctgaccgagaagacccccaccggcaccttcagcagagaggccctgatggcctactgggagaaggagagccagaagctgctggagaaggagagactgggcgagtgcggcaaggtggccgaggacaaggaggagagaaccatcgagaccgccaagggcatcaacggcaccgtgaactacgacagcgtgaacagcgacaacagcaagcccaagatcttcaagagccagatcgagaacatcaacctgaccaacggcagcaacggcagaaacaccgagagccccgccgccatccacccctgcggcaaccccaccgtgatcgaggacgccctggacaagatcaagagcaacgaccccgacaccaccgaggtgaacctgaacaacatcgagaacatcaccacccagaccctgaccagattcgccgaggccctgaaggacaacaccgtggtgaagaccttcagcctggccaacacccacgccgacgacagcgccgccatggccatcgccgagatgctgaaggtgaacgagcacatcaccaacgtgaacgtggagagcaacttcatcaccggcaagggcatcctggccatcatgagagccctgcagcacaacaccgtgctgaccgagctgagattccacaaccagagacacatcatgggcagccaggtggagatggagatcgtgaagctgctgaaggagaacaccaccctgctgagactgggctaccacttcgagctgcccggccccagaatgagcatgaccagcatcctgaccagaaacatggacaagcagagacagaagagactgcaggagcagaagcagcaggagggctacgacggcggccccaacctgagaaccaaggtgtggcagagaggcacccccagcagcagcccctacgtgagccccagacacagcccctggagcagccccaagctgcccaagaaggtgcagaccgtgagaagcagacccctgagccccgtggccacccccccccccccccccccccccccccccccccccccccccagcagccagagactgccccccccccccccccccccccccccccccctgcccgagaagaagctgatcaccagaaacatcgccgaggtgatcaagcagcaggagagcgcccagagagccctgcagaacggccagaagaagaagaagggcaagaaggtgaagaagcagcccaacagcatcctgaaggagatcaagaacagcctgagaagcgtgcaggagaagaagatggaggacagcagcagacccagcaccccccagagaagcgcccacgagaacctgatggaggccatcagaggcagcagcatcaagcagctgaagagagtggaggtgcccgaggccctgagatag

SEQ ID NO: 22098 - DNA, 1644 bp, Artificial Sequence
  Description of Artificial Sequence: Synthetic coding sequence
atgagcaccttcggctacagaagaggcctgagcaagtacgagagcatcgacgaggacgagctgctggccagcctgagcgccgaggagctgaaggagctggagagagagctggaggacatcgagcccgacagaaacctgcccgtgggcctgagacagaagagcctgaccgagaagacccccaccggcaccttcagcagagaggccctgatggcctactgggagaaggagagccagaagctgctggagaaggagagactgggcgagtgcggcaaggtggccgaggacaaggaggagagcgaggaggagctgatcttcaccgagagcaacagcgaggtgagcgaggaggtgtacaccgaggaggaggaggaggagagccaggaggaggaggaggaggaggacagcgacgaggaggagagaaccatcgagaccgccaagggcatcaacggcaccgtgaactacgacagcgtgaacagcgacaacagcaagcccaagatcttcaagagccagatcgagaacatcaacctgaccaacggcagcaacggcagaaacaccgagagccccgccgccatccacccctgcggcaaccccaccgtgatcgaggacgccctggacaagatcaagagcaacgaccccgacaccaccgaggtgaacctgaacaacatcgagaacatcaccacccagaccctgaccagattcgccgaggccctgaaggacaacaccgtggtgaagaccttcagcctggccaacacccacgccgacgacagcgccgccatggccatcgccgagatgctgaaggtgaacgagcacatcaccaacgtgaacgtggagagcaacttcatcaccggcaagggcatcctggccatcatgagagccctgcagcacaacaccgtgctgaccgagctgagattccacaaccagagacacatcatgggcagccaggtggagatggagatcgtgaagctgctgaaggagaacaccaccctgctgagactgggctaccacttcgagctgcccggccccagaatgagcatgaccagcatcctgaccagaaacatggacaagcagagacagaagagactgcaggagcagaagcagcaggagggctacgacggcggccccaacctgagaaccaaggtgtggcagagaggcacccccagcagcagcccctacgtgagccccagacacagcccctggagcagccccaagctgcccaagaaggtgcagaccgtgagaagcagacccctgagccccgtggccacccccccccccccccccccccccccccccccccccccccccagcagccagagactgccccccccccccccccccccccccccccccctgcccgagaagaagctgatcaccagaaacatcgccgaggtgatcaagcagcaggagagcgcccagagagccctgcagaacggccagaagaagaagaagggcaagaaggtgaagaagcagcccaacagcatcctgaaggagatcaagaacagcctgagaagcgtgcaggagaagaagatggaggacagcagcagacccagcaccccccagagaagcgcccacgagaacctgatggaggccatcagaggcagcagcatcaagcagctgaagagagtggaggtgcccgaggccctgagatag

SEQ ID NO: 22099 - DNA, 2208 bp, Artificial Sequence
  Description of Artificial Sequence: Synthetic coding sequence
atgctgagactgctgagacccctgctgctgctgctgctgctgcccccccccggcagccccgagccccccggcctgacccagctgagccccggcgcccccccccaggcccccgacctgctgtacgccgacggcctgagagcctacgccgccggcgcctgggcccccgccgtggccctgctgagagaggccctgagaagccaggccgccctgggcagagtgagactggactgcggcgccagctgcgccgccgaccccggcgccgccctgcccgccgtgctgctgggcgcccccgagcccgacagcggccccggccccacccagggcagctgggagagacagctgctgagagccgccctgagaagagccgactgcctgacccagtgcgccgccagaagactgggccccggcggcgccgccagaagagtgggcagcgccctgagagacgccttcagaagaagagagccctacaactacctgcagagagcctactaccagctgaagaagctggacctggccgccgccgccgcccacaccttcttcgtggccaaccccatgcacctgcagatgagagaggacatggccaagtacagaagaatgagcggcgtgagaccccagagcttcagagacctggagacccccccccactgggccgcctacgacaccggcctggagctgctgggcagacaggaggccggcctggccctgcccagactggaggaggccctgcagggcagcctggcccagatggagagctgcagagccgactgcgagggccccgaggagcagcagggcgccgaggaggaggaggacggcgccgccagccagggcggcctgtacgaggccatcgccggccactggatccaggtgctgcagtgcagacagagatgcgtgggcgagaccgccaccagacccggcagaagcttccccgtgcccgacttcctgcccaaccagctgagaagactgcacgaggcccacgcccaggtgggcaacctgagccaggccatcgagaacgtgctgagcgtgctgctgttctaccccgaggacgaggccgccaagagagccctgaaccagtaccaggcccagctgggcgagcccagacccggcctgggccccagagaggacatccagagattcatcctgagaagcctgggcgagaagagacagctgtactacgccatggagcacctgggcaccagcttcaaggaccccgacccctggacccccgccgccctgatccccgaggccctgagagagaagctgagagaggaccaggagaagagaccctgggaccacgagcccgtgaagcccaagcccctgacctactggaaggacgtgctgctgctggagggcgtgaccctgacccaggacagcagacagctgaacggcagcgagagagccgtgctggacggcctgctgacccccgccgagtgcggcgtgctgctgcagctggccaaggacgccgccggcgccggcgccagaagcggctacagaggcagaagaagcccccacaccccccacgagagattcgagggcctgaccgtgctgaaggccgcccagctggccagagccggcaccgtgggcagccagggcgccaagctgctgctggaggtgagcgagagagtgagaaccctgacccaggcctacttcagccccgagagacccctgcacctgagcttcacccacctggtgtgcagaagcgccatcgagggcgagcaggagcagagaatggacctgagccaccccgtgcacgccgacaactgcgtgctggaccccgacaccggcgagtgctggagagagccccccgcctacacctacagagactacagcggcctgctgtacctgaacgacgacttccagggcggcgacctgttcttcaccgagcccaacgccctgaccgtgaccgccagagtgagacccagatgcggcagactggtggccttcagcagcggcgtggagaacccccacggcgtgtgggccgtgaccagaggcagaagatgcgccctggccctgtggcacacctgggcccccgagcacagagagcaggagtggatcgaggccaaggagctgctgcaggagagccaggaggaggaggaggaggaggaggaggagatgcccagcaaggaccccagccccgagccccccagcagaagacaccagagagtgcaggacaagaccggcagagcccccagagtgagagaggagctgtag

SEQ ID NO: 22100 - DNA, 3015 bp, Artificial Sequence
  Description of Artificial Sequence: Synthetic coding sequence
atgcacggcagctgctgcctgggcggcggccagcccctgagcgtgttcgccagcctgcacatgggccccgagggcctggccctgaaggccggcagaggctggtgccccaccttccagagcttccccgagcccacccccagctacggcgcccccggcgtggagttcatgggcctgcaccaggagaacaacgccgtgacccagatccacctgctgcccggccagtgccagctggtgaccctgctggacgacaacagcctgcacctgtggagcctgaaggtgaagggcggcgccagcgagctgcaggaggacgagagcttcaccctgagaggcccccccggcgccgcccccagcgccacccagatcaccgtggtgctgccccacagcagctgcgagctgctgtacctgggcaccgagagcggcaacgtgttcgtggtgcagctgcccgccttcagagccctggaggacagaaccatcagcagcgacgccgtgctgcagagactgcccgaggaggccagacacagaagagtgttcgagatggtggaggccctgcaggagcaccccagagaccccaaccagatcctgatcggctacagcagaggcctggtggtgatctgggacctgcagggcagcagagtgctgtaccacttcctgagcagccagcagctggagaacatctggtggcagagagacggcagactgctggtgagctgccacagcgacggcagctactgccagtggcccgtgagcagcgaggcccagcagcccgagcccctgagaagcctggtgccctacggccccttcccctgcaaggccatcaccagaatcctgtggctgaccaccagacagggcctgcccttcaccatcttccagggcggcatgcccagagccagctacggcgacagacactgcatcagcgtgatccacgacggccagcagaccgccttcgacttcaccagcagagtgatcggcttcaccgtgctgaccgaggccgaccccgccgccaccttcgacgacccctacgccctggtggtgctggccgaggaggagctggtggtgatcgacctgcagaccgccggctggccccccgtgcagctgccctacctggccagcctgcactgcagcgccatcacctgcagccaccacgtgagcaacatccccctgaagctgtgggagagaatcatcgccgccggcagcagacagaacgcccacttcagcaccatggagtggcccatcgacggcggcaccagcctgacccccgcccccccccagagagacctgctgctgaccggccacgaggacggcaccgtgagattctgggacgccagcggcgtgtgcctgagactgctgtacaagctgagcaccgtgagagtgttcctgaccgacaccgaccccaacgagaacttcagcgcccagggcgaggacgagtggccccccctgagaaaggtgggcagcttcgacccctacagcgacgaccccagactgggcatccagaagatcttcctgtgcaagtacagcggctacctggccgtggccggcaccgccggccaggtgctggtgctggagctgaacgacgaggccgccgagcaggccgtggagcaggtggaggccgacctgctgcaggaccaggagggctacagatggaagggccacgagagactggccgccagaagcggccccgtgagattcgagcccggcttccagcccttcgtgctggtgcagtgccagccccccgccgtggtgaccagcctggccctgcacagcgagtggagactggtggccttcggcaccagccacggcttcggcctgttcgaccaccagcagagaagacaggtgttcgtgaagtgcaccctgcaccccagcgaccagctggccctggagggccccctgagcagagtgaagagcctgaagaagagcctgagacagagcttcagaagaatgagaagaagcagagtgagcagcagaaagagacaccccgccggcccccccggcgaggcccaggagggcagcgccaaggccgagagacccggcctgcagaacatggagctggcccccgtgcagagaaagatcgaggccagaagcgccgaggacagcttcaccggcttcgtgagaaccctgtacttcgccgacacctacctgaaggacagcagcagacactgccccagcctgtgggccggcaccaacggcggcaccatctacgccttcagcctgagagtgccccccgccgagagaagaatggacgagcccgtgagagccgagcaggccaaggagatccagctgatgcacagagcccccgtggtgggcatcctggtgctggacggccacagcgtgcccctgcccgagcccctggaggtggcccacgacctgagcaagagccccgacatgcagggcagccaccagctgctggtggtgagcgaggagcagttcaaggtgttcaccctgcccaaggtgagcgccaagctgaagctgaagctgaccgccctggagggcagcagagtgagaagagtgagcgtggcccacttcggcagcagaagagccgaggactacggcgagcaccacctggccgtgctgaccaacctgggcgacatccaggtggtgagcctgcccctgctgaagccccaggtgagatacagctgcatcagaagagaggacgtgagcggcatcgccagctgcgtgttcaccaagtacggccagggcttctacctgatcagccccagcgagttcgagagattcagcctgagcaccaagtggctggtggagcccagatgcctggtggacagcgccgagaccaagaaccacagacccggcaacggcgccggccccaagaaggcccccagcagagccagaaacagcggcacccagagcgacggcgaggagaagcagcccggcctggtgatggagagagccctgctgagcgacgagagagccgccaccggcgtgcacatcgagcccccctggggcgccgccagcgccatggccgagcagagcgagtggctgagcgtgcaggccgccagatag

SEQ ID NO: 22101 - DNA, 2061 bp, Artificial Sequence
  Description of Artificial Sequence: Synthetic coding sequence
atgggccccagaagcagagagagaagagccggcgccgtgcagaacaccaacgacagcagcgccctgagcaagagaagcctggccgccagaggctacgtgcaggaccccttcgccgccctgctggtgcccggcgccgccagaagagcccccctgatccacagaggctactacgtgagagccagagccgtgagacactgcgtgagagccttcctggagcagatcggcgccccccaggccgccctgagagcccagatcctgagcctgggcgccggcttcgacagcctgtacttcagactgaagaccgccggcagactggccagagccgccgtgtgggaggtggacttccccgacgtggccagaagaaaggccgagagaatcggcgagacccccgagctgtgcgccctgaccggccccttcgagagaggcgagcccgccagcgccctgtgcttcgagagcgccgactactgcatcctgggcctggacctgagacagctgcagagagtggaggaggccctgggcgccgccggcctggacgccgccagccccaccctgctgctggccgaggccgtgctgacctacctggagcccgagagcgccgccgccctgatcgcctgggccgcccagagattccccaacgccctgttcgtggtgtacgagcagatgagaccccaggacgccttcggccagttcatgctgcagcacttcagacagctgaacagccccctgcacggcctggagagattccccgacgtggaggcccagagaagaagattcctgcaggccggctggaccgcctgcggcgccgtggacatgaacgagttctaccactgcttcctgcccgccgaggagagaagaagagtggagaacatcgagcccttcgacgagttcgaggagtggcacctgaagtgcgcccactacttcatcctggccgccagcagaggcgacaccctgagccacaccctggtgttccccagcagcgaggccttccccagagtgaaccccgccagccccagcggcgtgttccccgccagcgtggtgagcagcgagggccaggtgcccaacctgaagagatacggccacgccagcgtgttcctgagccccgacgtgatcctgagcgccggcggcttcggcgagcaggagggcagacactgcagagtgagccagttccacctgctgagcagagactgcgacagcgagtggaagggcagccagatcggcagctgcggcaccggcgtgcagtgggacggcagactgtaccacaccatgaccagactgagcgagagcagagtgctggtgctgggcggcagactgagccccgtgagccccgccctgggcgtgctgcagctgcacttcttcaagagcgaggacaacaacaccgaggacctgaaggtgaccatcaccaaggccggcagaaaggacgacagcaccctgtgctgctggagacacagcaccaccgaggtgagctgccagaaccaggagtacctgttcgtgtacggcggcagaagcgtggtggagcccgtgctgagcgactggcacttcctgcacgtgggcaccatggcctgggtgagaatccccgtggagggcgaggtgcccgaggccagacacagccacagcgcctgcacctggcagggcggcgccctgatcgccggcggcctgggcgccagcgaggagcccctgaacagcgtgctgttcctgagacccatcagctgcggcttcctgtgggagagcgtggacatccagccccccatcacccccagatacagccacaccgcccacgtgctgaacggcaagctgctgctggtgggcggcatctggatccacagcagcagcttccccggcgtgaccgtgatcaacctgaccaccggcctgagcagcgagtaccagatcgacaccacctacgtgccctggcccctgatgctgcacaaccacaccagcatcctgctgcccgaggagcagcagctgctgctgctgggcggcggcggcaactgcttcagcttcggcacctacttcaacccccacaccgtgaccctggacctgagcagcctgagcgccggccagtag

SEQ ID NO: 22102 - DNA, 798 bp, Artificial Sequence
  Description of Artificial Sequence: Synthetic coding sequence
atgaccagactgagcgagagcagagtgctggtgctgggcggcagactgagccccgtgagccccgccctgggcgtgctgcagctgcacttcttcaagagcgaggacaacaacaccgaggacctgaaggtgaccatcaccaaggccggcagaaaggacgacagcaccctgtgctgctggagacacagcaccaccgaggtgagctgccagaaccaggagtacctgttcgtgtacggcggcagaagcgtggtggagcccgtgctgagcgactggcacttcctgcacgtgggcaccatggcctgggtgagaatccccgtggagggcgaggtgcccgaggccagacacagccacagcgcctgcacctggcagggcggcgccctgatcgccggcggcctgggcgccagcgaggagcccctgaacagcgtgctgttcctgagacccatcagctgcggcttcctgtgggagagcgtggacatccagccccccatcacccccagatacagccacaccgcccacgtgctgaacggcaagctgctgctggtgggcggcatctggatccacagcagcagcttccccggcgtgaccgtgatcaacctgaccaccggcctgagcagcgagtaccagatcgacaccacctacgtgccctggcccctgatgctgcacaaccacaccagcatcctgctgcccgaggagcagcagctgctgctgctgggcggcggcggcaactgcttcagcttcggcacctacttcaacccccacaccgtgaccctggacctgagcagcctgagcgccggccagtag

SEQ ID NO: 22103 - DNA, 399 bp, Artificial Sequence
  Description of Artificial Sequence: Synthetic coding sequence
atggaccaccacatccccatgcacgccctgcccgaggagatccagaagatgctgcccgaggagaaggtgtgcaagtactgcggcgtgagctacctgatcctgcacgagttcaaggccatggaggagaaggtgaaggccatggagaaggagatgaagttctaccagggcagcgtggacagagagaagagactgcaggagaagctgcacagcctgagccaggagctggagcagtacaagatcgacaacaagagcaagaccgagagaatctacgacgtgggcatgcagctgaagagccagcagaacgagttccagaaggtgaagaagcagctgagccacctgcaggacgagctgaagatcaagtacagacagagctacatcttcagactgtgcttctgctag

SEQ ID NO: 22104 - DNA, 879 bp, Artificial Sequence
  Description of Artificial Sequence: Synthetic coding sequence
atgggcatcgccgagagcacccccgacgagctgcccagcgacgccgaggagcagctgagaagcggcgaccagcagctggagctgagcggcagaagactgagaagactgcccagcgccgtgtgcgccctgagcagactgcagaagctgtacgtgagcggcaccggcctgagagagctgcccgaggagatcgaggagctgagagagctgagaatcctggccctggacttcaacaagctggagagactgcccgacggcctgtgcagactgcccagactgaccagactgtacctgggcggcaacagactgctggccctgcccgccgacttcgcccagctgcagagcctgagatgcctgtggatcgagggcaacttcctgagaagattccccagacccctgctgagactggtggccctgcagagcctgcagatgggcgacaacagactgagagccctgcccgccgagctgcccagaatgaccggcctgagaggcctgtggctgtacggcaacagattcgaggagttcccccccgccctgctgagaatgggcagactgcacatcctggacctggacagaaacagactgggcggcttccccgacctgcaccccctgagagccctgagagtgttcagctacgaccacaaccccgtgaccggcccccccagagtggccgacaccgtgttcctggtgggcgagggcgccgtggagagaatggccgagagagacgagcccacccccagacccccccccagaagacccgccagagccttcgaggacgaggaggaggaggacctgctgatcggcggcgccggcagcagagccctgggcgcccccggcggcagcttcagagccctggaggccgcccccggcctgggcacctag

SEQ ID NO: 22105 - DNA, 1482 bp, Artificial Sequence
  Description of Artificial Sequence: Synthetic coding sequence
atgcacaccctggtgttcctgagcaccagacaggtgctgcagtgccagcccgccgcctgccaggccctgcccctgctgcccagagagctgttccccctgctgttcaaggtggccttcatggacaagaagaccgtggtgctgagagagctggtgcacacctggcccttccccctgctgagcttccagcagctgctgcaggagtgcgcccactgcagcagagccctgctgcaggagagacccagcaccgagagcatgcaggccgtgatcctgggcctgaccgccagactgcacaccagcgagcccggcgccagcacccagcccctgtgcagaaagcacgccctgagagtgctggacatgaccggcctgctggacgacggcgtggagcaggaccccggcaccatgagcatgtgggactgcaccgccgccgtggccagaacctgcatcgcccagcagcagggcggcgccgccgagcccggccccgcccccatccccgtggaggtgagagtggacctgagagtgaacagagccagctacgccttcctgagagaggccctgagaagcagcgtgggcagccccctgagactgtgctgcagagacctgagagccgaggacctgcccatgagaaacaccgtggccctgctgcagctgctggacgccggctgcctgagaagagtggacctgagattcaacaacctgggcctgagaggcctgagcgtgatcatcccccacgtggccagattccagcacctggccagcctgagactgcactacgtgcacggcgacagcagacagcccagcgtggacggcgaggacaacttcagatacttcctggcccagatgggcagattcacctgcctgagagagctgagcatgggcagcagcctgctgagcggcagactggaccagctgctgagcaccctgcagagccccctggagagcctggagctggccttctgcgccctgctgcccgaggacctgagattcctggccagaagcccccacgccgcccacctgaagaagctggacctgagcggcaacgacctgagcggcagccagctggcccccttccagggcctgctgcaggccagcgccgccaccctgctgcacctggagctgaccgagtgccagctggccgacacccagctgctggccaccctgcccatcctgacccagtgcgccagcctgagatacctgggcctgtacggcaaccccctgagcatggccggcctgaaggagctgctgagagacagcgtggcccaggccgagctgagaaccgtggtgcaccccttccccgtggactgctacgagggcctgccctggcccccccccgccagcgtgctgctggaggccagcatcaacgaggagaagttcgccagagtggaggccgagctgcaccagctgctgctggccagcggcagagcccacgtgctgtggaccaccgacatctacggcagactggccgccgactacttcagcctgtag

SEQ ID NO: 22106 - DNA, 1545 bp, Artificial Sequence
  Description of Artificial Sequence: Synthetic coding sequence
atggacaccatgagaagcctgagattcatcagcgccgaggccctggtgagccacccccaggtggccagacagagcctggacagcgtggcccacaacctgtaccccctgctgttcaaggccagctacctgctggagcaggccgaggtgaccagagccgtgctgggcagatggcccctggaggagttcagactgggcgccctgctgggccccggcgccgaccacccccaggacctgagagacagaacctgcagagcctgcctggaggccctggtgagaggcctggccgaccacgtgctgcaggacagaagcagaagaagactgagagtggccgacctgaccggcatcagagacgtgcaggtgcagagatgcccctgcggcagagccctgggcagatggggcagaacccagctgctggccagaacctgctgcgagctgcaggccgagcccctggccgccggcagacccgtggaggtgctggccgacctgttcgtgaccgagggcaacttcgaggccgtggtgcaggccctgagacccgccggccccgcccccctgagagtgcactgccccagcttcagagccgacagcctgagccccagccagctgctgcacgtgctgagactggccggccccggcgccctgagaaagctggaggtggtgcacaacgtgagactgcacgccggccacgtgcagcagctgctggcccaggtgggcttccccagactggccagcctgaccctgcccaccaaggccttcgacgccccccccacctacgccagcacccccgacggcgaggaccccctgctggccagcatcgccagagagctgagcaagatggcccagctgaccgagctgagcgtggccttcagcaccctgaccggcaagatccccaccctgctgggccccctgcagacccccctgagagtgctggacctggccaactgcgccctgaaccacaccgacatggccttcctggccgactgcgcccacgccgcccacctggaggtgctggacctgagcggccacaacctggtgagcctgtaccccagcaccttcttcagactgctgagccaggccagcagaaccctgagaatcctgaccctggaggagtgcggcatcgtggacagccacgtgggcatgctgatcctgggcctgagcccctgccacagactgagacagctgaagttcctgggcaaccccctgagcgccagagccctgagaagactgttcaccgccctgtgcgagctgcccgagctgagatgcatcgagttccccgtgcccaaggactgctaccccgagggcgccgcctacccccaggacgagctggccatgagcaagttcaaccagcagaagtacgacgagatcgccgaggagctgagagccgtgctgctgagagccgacagagaggacatccaggtgagcacccccctgttcggcagcttcgaccccgacatccaggagaccagcaacgagctgggcgccttcctgctgcaggccttcaagaccgccctggagaacttcagcagagccctgaagcagatcgagtag

SEQ ID NO: 22107 - DNA, 1278 bp, Artificial Sequence
  Description of Artificial Sequence: Synthetic coding sequence
atggccatcaagaagcagaagagatgcagaaagatcagacccgtgagcgccttcatcagcggcagcccccaggacatggagagccagctgggcaacctgggcatcccccccggctggttcagcggcctgggcggcagccagcccaccgccagcggcagctgggagggcctgagcgagctgcccacccacggctacaagctgagacaccagacccagggcagacccagaccccccagaaccaccccccccggccccggcagacccagcatgcccgcccccggcaccagacaggagaacggcatggccaccagactggacgagggcctggaggacttcttcagcagaagagtgctggaggagagcagcagctaccccagaaccctgagaaccgtgagacccggcctgagcgaggcccccctgccccccctgcagaagaagagaagaagaggcctgttccacttcagaagacccagaagcttcaagggcgacagaggccccggcagccccaccaccggcctgctgctgccccccccccccccccccccccccacccaggagagcccccccagccccgacccccccagcctgggcaacaacagcagcccctgctggagccccgaggaggagagcagcctgctgcccggcttcggcggcggcagaggccccagcttcagaagaaagatgggccccggccccgaccaggagggcagcacccaggcctggcagaagagaagaagcagcgacgacgccggccccggcagctggaagccccccccccccccccagagcaccaagcccagcttcagcgccatgagaagagccgaggccacctggcacatcgccgaggagagcgcccccaaccacagctgccagagccccagccccgccagccaggacggcgaggaggagaaggagggcaccctgttccccgagagaaccctgcccgccagaaacgccaagctgcaggaccccgccctggccccctggccccccaagcccgtggccgtgcccagaggcagacagcccccccaggagcccggcgtgagagaggaggccgaggccggcgacgccgcccccggcgtgaacaagcccagactgagactgagcagccagcaggaccaggaggagcccgaggtgcagggcccccccgaccccggcagaagaaccgcccccctgaagcccaagagaaccagaagagcccagagctgcgacaagctggagcccgacagaagaagaccccccgaccccaccggcaccagcgagcccggcaccgactag

SEQ ID NO: 22108 - DNA, 4119 bp, Artificial Sequence
  Description of Artificial Sequence: Synthetic coding sequence
atggccaagcccagcgtggagctgaccagagagctgcaggacagcatcagaagatgcctgagccagggcgccgtgctgcagcagcaccacgtgaagctggagaccaagcccaagaagttcgaggacagagtgctggccctgaccagctggagactgcacctgttcctgctgaaggtgcccgccaaggtggagagcagcttcaacgtgctggagatcagagccttcaacaccctgagccagaaccagatcctggtggagaccgagagaggcatggtgagcatgagactgcccagcgccgagagcgtggaccaggtgaccagacacgtgagcagcgccctgagcaaggtgtgccccggccccggctgcctgatcagaagaggcaacgccgacacccccgagggccccagagacaccagccccaacagcgagaccagcaccagcaccacccacagcgtgtgcggcggcttcagcgagacctacgccgccctgtgcgactacaacggcctgcactgcagagaggaggtgcagtgggacgtggacaccatctaccacgccgaggacaacagagagttcaacctgctggacttcagccacctggagagcagagacctggccctgatggtggccgccctggcctacaaccagtggttcaccaagctgtactgcaaggacctgagactgggcagcgaggtgctggagcaggtgctgcacaccctgagcaagagcggcagcctggaggagctggtgctggacaacgccggcctgaagaccgacttcgtgcagaagctggccggcgtgttcggcgagaacggcagctgcgtgctgcacgccctgaccctgagccacaaccccatcgaggacaagggcttcctgagcctgagccagcagctgctgtgcttccccagcggcctgaccaagctgtgcctggccaagaccgccatcagccccagaggcctgcaggccctgggccagaccttcggcgccaaccccgccttcgccagcagcctgagatacctggacctgagcaagaaccccggcctgctggccaccgacgaggccaacgccctgtacagcttcctggcccagcccaacgccctggtgcacctggacctgagcggcaccgactgcgtgatcgacctgctgctgggcgccctgctgcacggctgctgcagccacctgacctacctgaacctggccagaaacagctgcagccacagaaagggcagagaggccccccccgccttcaagcagttcttcagcagcgcctacaccctgagccacgtgaacctgagcgccaccaagctgcccctggaggccctgagagccctgctgcagggcctgagcctgaacagccacctgagcgacctgcacctggacctgagcagctgcgagctgagaagcgccggcgcccaggccctgcaggagcagctgggcgccgtgacctgcgtgggcagcctggacctgagcgacaacggcttcgacagcgacctgctgaccctggtgcccgccctgggcaagaacaagagcctgaagcacctgttcctgggcaagaacttcaacgtgaaggccaagaccctggaggagatcctgcacaagctggtgcagctgatccaggaggaggactgcagcctgcagagcctgagcgtggccgacagcagactgaagctgagaaccagcatcctgatcaacgccctgggcagcaacacctgcctggccaaggtggacctgagcggcaacggcatggaggacatcggcgccaagatgctgagcaaggccctgcagatcaacagcagcctgagaaccatcctgtgggacagaaacaacaccagcgccctgggcttcctggacatcgccagagccctggagagcaaccacaccctgagattcatgagcttccccgtgagcgacatcagccaggcctacagaagcgcccccgagagaaccgaggacgtgtggcagaagatccagtggtgcctggtgagaaacaaccacagccagacctgcccccaggagcaggccttcagactgcagcagggcctggtgaccagcagcgccgagcagatgctgcagagactgtgcggcagagtgcaggaggaggtgagagccctgagactgtgccccctggagcccgtgcaggacgagctgctgtacgccagagacctgatcaaggacgccaagaacagcagagccctgttccccagcctgtacgagctgggccacgtgctggccaacgacggccccgtgagacagagactggagagcgtggccagcgaggtgagcaaggccgtggacaaggagctgcaggtgatcctggagagcatggtgagcctgacccaggagctgtgccccgtggccatgagagtggccgagggccacaacaagatgctgagcaacgtggccgagagagtgaccgtgcccagaaacttcatcagaggcgccctgctggagcaggccggccaggacatccagaacaagctggacgaggtgaagctgagcgtggtgacctacctgaccagcagcatcgtggacgagatcctgcaggagctgtaccacagccacaagagcctggccagacacctgacccagctgagaaccctgagcgacccccccggctgccccggccagggccaggacctgagcagcagaggcagaggcagaaaccacgaccacgaggagaccaccgacgacgagctgggcaccaacatcgacaccatggccatcaagaagcagaagagatgcagaaagatcagacccgtgagcgccttcatcagcggcagcccccaggacatggagagccagctgggcaacctgggcatcccccccggctggttcagcggcctgggcggcagccagcccaccgccagcggcagctgggagggcctgagcgagctgcccacccacggctacaagctgagacaccagacccagggcagacccagaccccccagaaccaccccccccggccccggcagacccagcatgcccgcccccggcaccagacaggagaacggcatggccaccagactggacgagggcctggaggacttcttcagcagaagagtgctggaggagagcagcagctaccccagaaccctgagaaccgtgagacccggcctgagcgaggcccccctgccccccctgcagaagaagagaagaagaggcctgttccacttcagaagacccagaagcttcaagggcgacagaggccccggcagccccaccaccggcctgctgctgccccccccccccccccccccccccacccaggagagcccccccagccccgacccccccagcctgggcaacaacagcagcccctgctggagccccgaggaggagagcagcctgctgcccggcttcggcggcggcagaggccccagcttcagaagaaagatgggcaccgagggcagcgagcccggcgagggcggccccgcccccggcaccgcccagcagcccagagtgcacggcgtggccctgcccggcctggagagagccaagggctggagcttcgacggcaagagagagggccccggccccgaccaggagggcagcacccaggcctggcagaagagaagaagcagcgacgacgccggccccggcagctggaagccccccccccccccccagagcaccaagcccagcttcagcgccatgagaagagccgaggccacctggcacatcgccgaggagagcgcccccaaccacagctgccagagccccagccccgccagccaggacggcgaggaggagaaggagggcaccctgttccccgagagaaccctgcccgccagaaacgccaagctgcaggaccccgccctggccccctggccccccaagcccgtggccgtgcccagaggcagacagcccccccaggagcccggcgtgagagaggaggccgaggccggcgacgccgcccccggcgtgaacaagcccagactgagactgagcagccagcaggaccaggaggagcccgaggtgcagggcccccccgaccccggcagaagaaccgcccccctgaagcccaagagaaccagaagagcccagagctgcgacaagctggagcccgacagaagaagaccccccgaccccaccggcaccagcgagcccggcaccgactag

SEQ ID NO: 22109 - DNA, 555 bp, Artificial Sequence
  Description of Artificial Sequence: Synthetic coding sequence
atgctgaagaagatgggcgaggccgtggccagagtggccagaaaggtgaacgagaccgtggagagcggcagcgacaccctggacctggccgagtgcaagctggtgagcttccccatcggcatctacaaggtgctgagaaacgtgagcggccagatccacctgatcaccctggccaacaacgagctgaagagcctgaccagcaagttcatgaccaccttcagccagctgagagagctgcacctggagggcaacttcctgcacagactgcccagcgaggtgagcgccctgcagcacctgaaggccatcgacctgagcagaaaccagttccaggacttccccgagcagctgaccgccctgcccgccctggagaccatcaacctggaggagaacgagatcgtggacgtgcccgtggagaagctggccgccatgcccgccctgagaagcatcaacctgagattcaaccccctgaacgccgaggtgagagtgatcgccccccccctgatcaagttcgacatgctgatgagccccgagggcgccagagcccccctgccctag

SEQ ID NO: 22110 - DNA, 387 bp, Artificial Sequence
  Description of Artificial Sequence: Synthetic coding sequence
atgctgaagaagatgggcgaggccgtggccagagtggccagaaaggtgaacgagaccgtggagagcggcagcgacaccctggacctggccgagtgcaagctggtgagcttccccatcggcatctacaaggtgctgagaaacgtgagcggccagatccacctgatcaccctggccaacaacgagctgaagagcctgaccagcaagttcatgaccaccttcagccagctgagagacgtgcccgtggagaagctggccgccatgcccgccctgagaagcatcaacctgagattcaaccccctgaacgccgaggtgagagtgatcgccccccccctgatcaagttcgacatgctgatgagccccgagggcgccagagcccccctgccctag

SEQ ID NO: 22111 - DNA, 405 bp, Artificial Sequence
  Description of Artificial Sequence: Synthetic coding sequence
atgctgaagaagatgggcgaggccgtggccagagtggccagaaaggtgaacgagaccgtggagagcggcagcgacaccctggagctgcacctggagggcaacttcctgcacagactgcccagcgaggtgagcgccctgcagcacctgaaggccatcgacctgagcagaaaccagttccaggacttccccgagcagctgaccgccctgcccgccctggagaccatcaacctggaggagaacgagatcgtggacgtgcccgtggagaagctggccgccatgcccgccctgagaagcatcaacctgagattcaaccccctgaacgccgaggtgagagtgatcgccccccccctgatcaagttcgacatgctgatgagccccgagggcgccagagcccccctgccctag

SEQ ID NO: 22112 - DNA, 555 bp, Artificial Sequence; identical to SEQ ID NO: 22109
  Description of Artificial Sequence: Synthetic coding sequence

SEQ ID NO: 22113 - DNA, 387 bp, Artificial Sequence; identical to SEQ ID NO: 22110
  Description of Artificial Sequence: Synthetic coding sequence

SEQ ID NO: 22114 - DNA, 405 bp, Artificial Sequence; identical to SEQ ID NO: 22111
  Description of Artificial Sequence: Synthetic coding sequence

SEQ ID NO: 22115 - DNA, 528 bp, Artificial Sequence
  Description of Artificial Sequence: Synthetic coding sequence
atgctgaagaagatgggcgaggccgtggccagagtggccagaaaggtgaacgagaccgtggagagcggcagcgacaccctggacctggccgagtgcaagctggtgagcttccccatcggcatctacaaggtgctgagaaacgtgagcggccagatccacctgatcaccctggccaacaacgagctgaagagcctgaccagcaagttcatgaccaccttcagccagctgagagagctgcacctggagggcaacttcctgcacagactgcccagcgaggtgagcgccctgcagcacctgaaggccatcgacctgagcagaaaccagttccaggacttccccgagcagctgaccgccctgcccgccctggagaccatcaacctggaggagaacgagatcgtggacgtgcccgtggagaagctggccgccatgcccgccctgagaagcatcaacctgagattcaaccccctgaacgccgaggtgagagtgatcgccccccccctgatcaagttcgacatgctgatgagctag

SEQ ID NO: 22116 - DNA, 1032 bp, Artificial Sequence
  Description of Artificial Sequence: Synthetic coding sequence
atgagcgacgaggacgacctggaggacagcgagcccgaccaggacgacagcgagaaggaggaggacgagaaggagaccgaggagggcgaggactacagaaaggagggcgaggagttccccgaggagtggctgcccacccccctgaccgaggacatgatgaaggagggcctgagcctgctgtgcaagaccggcaacggcctggcccacgcctacgtgaagctggaggtgaaggagagagacctgaccgacatctacctgctgagaagctacatccacctgagatacgtggacatcagcgagaaccacctgaccgacctgagccccctgaactacctgacccacctgctgtggctgaaggccgacggcaacagactgagaagcgcccagatgaacgagctgccctacctgcagatcgccagcttcgcctacaaccagatcaccgacaccgagggcatcagccaccccagactggagaccctgaacctgaagggcaacagcatccacatggtgaccggcctggaccccgagaagctgatcagcctgcacaccgtggagctgagaggcaaccagctggagagcaccctgggcatcaacctgcccaagctgaagaacctgtacctggcccagaacatgctgaagaaggtggagggcctggaggacctgagcaacctgaccaccctgcacctgagagacaaccagatcgacaccctgagcggcttcagcagagagatgaagagcctgcagtacctgaacctgagaggcaacatggtggccaacctgggcgagctggccaagctgagagacctgcccaagctgagagccctggtgctgctggacaacccctgcaccgacgagaccagctacagacaggaggccctggtgcagatgccctacctggagagactggacaaggagttctacgaggaggaggagagagccgaggccgacgtgatcagacagagactgaaggaggagaaggagcaggagcccgagccccagagagacctggagcccgagcagagcctgatctag

SEQ ID NO: 22117 - DNA, 939 bp, Artificial Sequence
  Description of Artificial Sequence: Synthetic coding sequence
atgagcgacgaggacgacctggaggacagcgagcccgaccaggacgacagcgagaaggaggaggacgagaaggagaccgaggagggcgaggactacagaaaggagggcgaggagttccccgaggagtggctgcccacccccctgaccgaggacatgatgaaggagggcctgagcctgctgtgcaagaccggcaacggcctggcccacgcctacgtgaagctggaggtgaaggagagagacctgaccgacatctacctgctgagaagctacatccacctgagatacgtggacatcagcgagaaccacctgaccgacctgagccccctgaactacctgacccacctgctgtggctgaaggccgacggcaacagactgagaagcgcccagatgaacgagctgccctacctgcagatcgccagcttcgcctacaaccagatcaccgacaccgagggcatcagccaccccagactggagaccctgaacctgaagggcaacagcatccacatggtgaccggcctggaccccgagaagctgatcagcctgcacaccgtggagctgagaggcaaccagctggagagcaccctgggcatcaacctgcccaagctgaagaacctgtacctggcccagaacatgctgaagaaggtggagggcctggaggacctgagcaacctgaccaccctgcacctgagagacaaccagatcgacaccctgagcggcttcagcagagagatgaagagcctgcagtacctgaacctgagaagaagcaagaccctggccttcagacccgaccagacccccagaggcagccaccacatgtacgacagagagcagagaatgcccgtgttcgcccccaagctggagatccaccacaacctgagacccagaatctgcagcgtgcccgtgctgtgggccgtgtggggcgccgagtggggcgcctag

SEQ ID NO: 22118 - DNA, 285 bp, Artificial Sequence
  Description of Artificial Sequence: Synthetic coding sequence
atgagcgacgaggacgacctggaggacagcgagcccgaccaggacgacagcgagaaggaggaggacgagaaggagaccgaggagggcgaggactacagaaaggagggcgaggagttccccgaggagtggctgcccacccccctgaccgaggacatgatgaaggagggcctgagcctgctgtgcaagaccggcaacggcctggcccacgcctacgtgaagctggaggtgaaggagagagacctgaccgacatctacctgctgagaagctacatccacctgagatag

SEQ ID NO: 22119 - DNA, 1032 bp, Artificial Sequence; identical to SEQ ID NO: 22116
  Description of Artificial Sequence: Synthetic coding sequence

SEQ ID NO: 22120 - DNA, 1032 bp, Artificial Sequence; identical to SEQ ID NO: 22116
  Description of Artificial Sequence: Synthetic coding sequence

SEQ ID NO: 22121 - DNA, 1032 bp, Artificial Sequence; identical to SEQ ID NO: 22116
  Description of Artificial Sequence: Synthetic coding sequence

SEQ ID NO: 22122 - DNA, 1152 bp, Artificial Sequence
  Description of Artificial Sequence: Synthetic coding sequence
atggagggcagcagcagctacgaggtgcccagcgtggccgccgccgacctggaggagggcgccggccagaccagaagcctgcccgccacccccagcaaggacgtgcacaagggcgtgggcggcatcatcttcagcagcagccccatcctggacctgagcgagagcggcctgtgcagactggaggaggtgttcagaatccccagcctgcagcagctgcacctgcagagaaacgccctgtgcgtgatcccccaggacttcttccagctgctgcccaacctgacctggctggacctgagatacaacagaatcaaggccctgcccagcggcatcggcgcccaccagcacctgaagaccctgctgctggagagaaaccccatcaagatgctgcccgtggagctgggcagcgtgaccaccctgaaggccctgaacctgagacactgccccctggagttccccccccagctggtggtgcagaagggcctggtggccatccagagattcctgagaatgtgggccgtggagcacagcctgcccagaaaccccaccagccaggaggccccccccgtgagagagatgaccctgagagacctgcccagccccggcctggagctgagcggcgaccacgccagcaaccagggcgccgtgaacgcccaggaccccgagggcgccgtgatgaaggagaaggccagcttcctgccccccgtggagaagcccgacctgagcgagctgagaaagagcgccgacagcagcgagaactggcccagcgaggaggagatcagaagattctggaagctgagacaggagatcgtggagcacgtgaaggccgacgtgctgggcgaccagctgctgaccagagagctgccccccaacctgaaggccgccctgaacatcgagaaggagctgcccaagcccagacacgtgttcagaaccagagtgcccagaaagcaggccctgcagagactgcacgagagaaagaccagaatcatgggcgtggtgggcagagcccccacccacatgggcgagggcagacagcccccccccggcgccagctaccccaccagctgccacagaaccaagtggagaagcgagcagaaggactggaagagagccgagagaagaagaagcgagagcagcagaagaagcagactgtag

SEQ ID NO: 22123 - DNA, 510 bp, Artificial Sequence
  Description of Artificial Sequence: Synthetic coding sequence
atggagggcagcagcagctacgaggtgcccagcgtggccgccgccgacctggaggagggcgccggccagaccagaagcctgcccgccacccccagcaaggacgtgcacaagggcgtgggcggcatcatcttcagcagcagccccatcctggacctgagcgagagcggcctgtgcagactggaggaggtgttcagaatccccagcctgcagcagctgcacctgcagagaaacgccctgtgcgtgatcccccaggacttcttccagctgctgcccaacctgacctggctggacctgagatacaacagaatcaaggccctgcccagcggcatcggcgcccaccaggagagaaaccacgccgagagcaccgagcccaagaccctgcccagcggcatccccagcagcgccagatgcgccgagggcatcggcggctaccccgccctgcccgccgacgtgggcagcagaaccctgagcccccagaagagcaacttcagcagaggcagcaccggctag

SEQ ID NO: 22124 - DNA, 1407 bp, Artificial Sequence
  Description of Artificial Sequence: Synthetic coding sequence
atggacatcaacacctacaacaaccagctgcacctgcagagaaacgccctgtgcgtgatcccccaggacttcttccagctgctgcccaacctgacctggctggacctgagatacaacagaatcaaggccctgcccagcggcatcggcgcccaccagcacctgaagaccctgctgctggagagaaaccccatcaagatgctgcccgtggagctgggcagcgtgaccaccctgaaggccctgaacctgagacactgccccctggagttccccccccagctggtggtgcagaagggcctggtggccatccagagattcctgagaatgtgggccgtggagcacagcctgcccagaaaccccaccagccaggaggccccccccgtgagagagatgaccctgagagacctgcccagccccggcctggagctgagcggcgaccacgccagcaaccagggcgccgtgaacgcccaggaccccgagggcgccgtgatgaaggagaaggccagcttcctgccccccgtggagaagcccgacctgagcgagctgagaaagagcgccgacagcagcgagaactggcccagcgaggaggagatcagaagattctggaagctgagacaggagatcgtggagcacgtgaaggccgacgtgctgggcgaccagctgctgaccagagagctgccccccaacctgaaggccgccctgaacatcgagaaggagctgcccaagcccagacacgtgttcagaagaaagaccgccagcagcagaagcatcctgcccgacctgctgagcccctaccagatggccatcagagccaagagactggaggagagcagagccgccgccctgagagagctgcaggagaagcaggccctgatggagcagcagagaagagagaagagagccctgcaggagtggagagagagagcccagagaatgagaaagagaaaggaggagctgagcaagctgctgccccccagaagaagcatggtggccagcaagatccccagcgccaccgacctgatcgacaacagaaaggtgcccctgaacccccccggcaagatgaagcccagcaaggagaagagcccccaggccagcaaggagatgagcgccctgcaggagagaaacctggaggagaagatcaagcagcacgtgctgcagatgagagagcagagaagattccacggccaggcccccctggaggagatgagaaaggccgccgaggacctggagatcgccaccgagctgcaggacgaggtgctgaagctgaagctgggcctgaccctgaacaaggacagaagaagagccgccctgaccggcaacctgagcctgggcctgcccgccgcccagccccagaacaccttcttcaacaccaagtacggcgagagcggcaacgtgagaagataccagtag

SEQ ID NO: 22125 - DNA, 1407 bp, Artificial Sequence; identical to SEQ ID NO: 22124
  Description of Artificial Sequence: Synthetic coding sequence

SEQ ID NO: 22126 - DNA, 1593 bp, Artificial Sequence
  Description of Artificial Sequence: Synthetic coding sequence
atggagggcagcagcagctacgaggtgcccagcgtggccgccgccgacctggaggagggcgccggccagaccagaagcctgcccgccacccccagcaaggacgtgcacaagggcgtgggcggcatcatcttcagcagcagccccatcctggacctgagcgagagcggcctgtgcagactggaggaggtgttcagaatccccagcctgcagcagctgcacctgcagagaaacgccctgtgcgtgatcccccaggacttcttccagctgctgcccaacctgacctggctggacctgagatacaacagaatcaaggccctgcccagcggcatcggcgcccaccagcacctgaagaccctgctgctggagagaaaccccatcaagatgctgcccgtggagctgggcagcgtgaccaccctgaaggccctgaacctgagacactgccccctggagttccccccccagctggtggtgcagaagggcctggtggccatccagagattcctgagaatgtgggccgtggagcacagcctgcccagaaaccccaccagccaggaggccccccccgtgagagagatgaccctgagagacctgcccagccccggcctggagctgagcggcgaccacgccagcaaccagggcgccgtgaacgcccaggaccccgagggcgccgtgatgaaggagaaggccagcttcctgccccccgtggagaagcccgacctgagcgagctgagaaagagcgccgacagcagcgagaactggcccagcgaggaggagatcagaagattctggaagctgagacaggagatcgtggagcacgtgaaggccgacgtgctgggcgaccagctgctgaccagagagctgccccccaacctgaaggccgccctgaacatcgagaaggagctgcccaagcccagacacgtgttcagaagaaagaccgccagcagcagaagcatcctgcccgacctgctgagcccctaccagatggccatcagagccaagagactggaggagagcagagccgccgccctgagagagctgcaggagaagcaggccctgatggagcagcagagaagagagaagagagccctgcaggagtggagagagagagcccagagaatgagaaagagaaaggaggagctgagcaagctgctgccccccagaagaagcatggtggccagcaagatccccagcgccaccgacctgatcgacaacagaaaggtgcccctgaacccccccggcaagatgaagcccagcaaggagaagagcccccaggccagcaaggagatgagcgccctgcaggagagaaacctggaggagaagatcaagcagcacgtgctgcagatgagagagcagagaagattccacggccaggcccccctggaggagatgagaaaggccgccgaggacctggagatcgccaccgagctgcaggacgaggtgctgaagctgaagctgggcctgaccctgaacaaggacagaagaagagccgccctgaccggcaacctgagcctgggcctgcccgccgcccagccccagaacaccttcttcaacaccaagtacggcgagagcggcaacgtgagaagataccagtag

SEQ ID NO: 22127 - DNA, 1593 bp, Artificial Sequence; identical to SEQ ID NO: 22126
  Description of Artificial Sequence: Synthetic coding sequence

SEQ ID NO: 22128 - DNA, 1152 bp, Artificial Sequence
  Description of Artificial Sequence: Synthetic coding sequence
atggagggcagcagcagctacgaggtgcccagcgtggccgccgccgacctggaggagggcgccggccagaccagaagcctgcccgccacccccagcaaggacgtgcacaagggcgtgggcggcatcatcttcagcagcagccccatcctggacctgagcgagagcggcctgtgcagactggaggaggtgttcagaatccccagcctgcagcagctgcacctgcagagaaacgccctgtgcgtgatcccccaggacttcttccagctgctgcccaacctgacctggctggacctgagatacaacagaatcaaggccctgcccagcggcatcggcgcccaccagcacctgaagaccctgctgctggagagaaaccccatcaagatgctgcccgtggagctgggcagcgtgaccaccctgaaggccctgaacctgagacactgccccctggagttccccccccagctggtggtgcagaagggcctggtggccatccagagattcctgagaatgtgggccgtggagcacagcctgcccagaaaccccaccagccaggaggccccccccgtgagagagatgaccctgagagacctgcccagccccggcctggagctgagcggcgaccacgccagcaaccagggcgccgtgaacgcccaggaccccgagggcgccgtgatgaaggagaaggccagcttcctgccccccgtggagaagcccgacctgagcgagctgagaaagagcgccgacagcagcgagaactggcccagcgaggaggagatcagaagattctggaagctgagacaggagatcgtggagcacgtgaaggccgacgtgctgggcgaccagctgctgaccagagagctgccccccaacctgaaggccgccctgaacatcgagaaggagctgcccaagcccagacacgtgttcagaagaaagaccgccagcagcagaagcatcctgcccgacctgctgagcccctaccagatggccatcagagccaagagactggaggagagcagagccgccgccctgagagagctgcaggagaagcaggccctgatggagcagcagagaagacccttcctgctgatcttccccagagtgttccaggccctgaccagaagcagcggcagattcatcctggtgctgctgtag

SEQ ID NO: 22129 - DNA, 1152 bp, Artificial Sequence; identical to SEQ ID NO: 22122
  Description of Artificial Sequence: Synthetic coding sequence

SEQ ID NO: 22130 - DNA, 1107 bp, Artificial Sequence
  Description of Artificial Sequence: Synthetic coding sequence
atgctgcccgtggagctgggcagcgtgaccaccctgaaggccctgaacctgagacactgccccctggagttccccccccagctggtggtgcagaagggcctggtggccatccagagattcctgagaatgtgggccgtggagcacagcctgcccagaaaccccaccagccaggaggccccccccgtgagagagatgaccctgagagacctgcccagccccggcctggagctgagcggcgaccacgccagcaaccagggcgccgtgaacgcccaggaccccgagggcgccgtgatgaaggagaaggccagcttcctgccccccgtggagaagcccgacctgagcgagctgagaaagagcgccgacagcagcgagaactggcccagcgaggaggagatcagaagattctggaagctgagacaggagatcgtggagcacgtgaaggccgacgtgctgggcgaccagctgctgaccagagagctgccccccaacctgaaggccgccctgaacatcgagaaggagctgcccaagcccagacacgtgttcagaagaaagaccgccagcagcagaagcatcctgcccgacctgctgagcccctaccagatggccatcagagccaagagactggaggagagcagagccgccgccctgagagagctgcaggagaagcaggccctgatggagcagcagagaagagagaagagagccctgcaggagtggagagagagagcccagagaatgagaaagagaaaggaggagctgagcaagctgctgccccccagaagaagcatggtggccagcaagatccccagcgccaccgacctgatcgacaacagaaaggtgcccctgaacccccccggcaagatgaagcccagcaaggagaagagcccccaggccagcaaggagatgagcgccctgcaggagagaaacctggaggagaagatcaagcagcacgtgctgcagatgagagagcagagaagattccacggccaggcccccctggaggagatgagaaaggccgccgaggacctggagatcagcagaagatgggagagaggcggcatgagagccggctgcggcgccaccagctggagaccccaccccacctag

SEQ ID NO: 22131 - DNA, 777 bp, Artificial Sequence
  Description of Artificial Sequence: Synthetic coding sequence
tgattcagaaccagcgtgagcacccccagcggcaacaccgacatggacatcaacacctacaacaaccagctgcacctgcagagaaacgccctgtgcgtgatcccccaggacttcttccagctgctgcccaacctgacctggctggacctgagatacaacagaatcaaggccctgcccagcggcatcggcgcccaccagcacctgaagaccctgctgctggagagaaaccccatcaagatgctgcccgtggagctgggcagcgtgaccaccctgaaggccctgaacctgagacactgccccctggagttccccccccagctggtggtgcagaagggcctggtggccatccagagattcctgagaatgtgggccgtggagcacagcctgcccagaaaccccaccagccaggaggccccccccgtgagagagatgaccctgagagacctgcccagccccggcctggagctgagcggcgaccacgccagcaaccagggcgccgtgaacgcccaggaccccgagggcgccgtgatgaaggagaaggccagcttcctgccccccgtggagaagcccgacctgagcgagctgagaaagagcgccgacagcagcgagaactggcccagcgaggaggagatcagaagattctggaagctgagacaggagatcgtggagcacgtgaaggccgacgtgctgggcgaccagctgctgaccagagagctgccccccaacctgaaggccgccctgaacatcgagaaggagctgcccaagcccagacactag

SEQ ID NO: 22132 - DNA, 1104 bp, Artificial Sequence
  Description of Artificial Sequence: Synthetic coding sequence
atggccagcgagctgtgcaagaccatcagcgtggccagactggagaagcacaagaacctgttcctgaactacagaaacctgcaccacttccccctggagctgctgaaggacgagggcctgcagtacctggagagactgtacatgaagagaaacagcctgaccagcctgcccgagaacctggcccagaagctgcccaacctggtggagctgtacctgcacagcaacaacatcgtggtggtgcccgaggccatcggcagcctggtgaagctgcagtgcctggacctgagcgacaacgccctggagatcgtgtgccccgagatcggcagactgagagccctgagacacctgagactggccaacaaccagctgcagttcctgccccccgaggtgggcgacctgaaggagctgcagaccctggacatcagcaccaacagactgctgaccctgcccgagagactgcacatgtgcctgagcctgcagtacctgaccgtggacagaaacagactgtggtacgtgcccagacacctgtgccagctgcccagcctgaacgagctgagcatggccggcaacagactggccttcctgcccctggacctgggcagaagcagagagctgcagtacgtgtacgtggacaacaacatccacctgaagggcctgcccagctacctgtacaacaaggtgatcggctgcagcggctgcggcgcccccatccaggtgagcgaggtgaagctgctgagcttcagcagcggccagagaaccgtgttcctgcccgccgaggtgaaggccatcggcaccgagcacgaccacgtgctgcccctgcaggagctggccatgagaggcctgtaccacacctaccacagcctgctgaaggacctgaacttcctgagccccatcagcctgcccagaagcctgctggagctgctgcactgccccctgggccactgccacagatgcagcgagcccatgttcaccatcgtgtaccccaagctgttccccctgagagagacccccatggccggcctgcaccagtggaagaccaccgtgagcttcgtggcctactgctgcagcacccagtgcctgcagaccttcgacctgctgagctag

SEQ ID NO: 22133 - DNA, 897 bp, Artificial Sequence
  Description of Artificial Sequence: Synthetic coding sequence
atggccagcgagctgtgcaagaccatcagcgtggccagactggagaagcacaagaacctgttcctgaactacagaaacctgcaccacttccccctggagctgctgaaggacgagggcctgcagtacctggagagactgtacatgaagagaaacagcctgaccagcctgcccgagaacctggcccagaagctgcccaacctggtggagctgtacctgcacagcaacaacatcgtggtggtgcccgaggccatcggcagcctggtgaagctgcagtgcctggacctgagcgacaacgccctggagatcgtgtgccccgagatcggcagactgagagccctgagacacctgagactggccaacaaccagctgcagttcctgccccccgacctgggcagaagcagagagctgcagtacgtgtacgtggacaacaacatccacctgaagggcctgcccagctacctgtacaacaaggtgatcggctgcagcggctgcggcgcccccatccaggtgagcgaggtgaagctgctgagcttcagcagcggccagagaaccgtgttcctgcccgccgaggtgaaggccatcggcaccgagcacgaccacgtgctgcccctgcaggagctggccatgagaggcctgtaccacacctaccacagcctgctgaaggacctgaacttcctgagccccatcagcctgcccagaagcctgctggagctgctgcactgccccctgggccactgccacagatgcagcgagcccatgttcaccatcgtgtaccccaagctgttccccctgagagagacccccatggccggcctgcaccagtggaagaccaccgtgagcttcgtggcctactgctgcagcacccagtgcctgcagaccttcgacctgctgagctag

SEQ ID NO: 22134 - DNA, 456 bp, Artificial Sequence
  Description of Artificial Sequence: Synthetic coding sequence
atggccagcgagctgtgcaagaccatcagcgtggccagactggagaagcacaagaacctgttcctgaactacagaaacctgcaccacttccccctggagctgctgaaggacgagggcctgcagtacctggagagactgtacatgaagagaaacagcctgaccagcctgcccgagaacctggcccagaagctgcccaacctggtggagctgtacctgcacagcaacaacatcgtggtggtgcccgaggccatcggcagcctggtgaagctgcagtgcctggacctgagcgacaacgccctggagatcgtgtgccccgagatcggcagactgagagccctgagacacctgagactggccaacaaccagctgcagttcctgccccccgtgccccactgcggccccaagagcagcatggtgtgcgccgcccccagcctgcccgccgcccagccccagtag

SEQ ID NO: 22135 - DNA, 939 bp, Artificial Sequence
  Description of Artificial Sequence: Synthetic coding sequence
atggccagcgagctgtgcaagaccatcagcgtggccagactggagaagcacaagaacctgttcctgaactacagaaacctgcaccacttccccctggagctgctgaaggacgagggcctgcagtacctggagagactgtacatgaagagaaacagcctgaccagcctgcccgagaacctggcccagaagctgcccaacctggtggagctgtacctgcacagcaacaacatcgtggtggtgcccgaggccatcggcagcctggtgaagctgcagtgcctggacctgagcgacaacgccctggagatcgtgtgccccgagatcggcagactgagagccctgagacacctgagactggccaacaaccagctgcagttcctgccccccgaggtgggcgacctgaaggagctgcagaccctggacatcagcaccaacagactgctgaccctgcccgagagactgcacatgtgcctgagcctgcagtacctgaccgtggacagaaacagactgtggtacgtgcccagacacctgtgccagctgcccagcctgaacgagctgagcatggccggcaacagactggccttcctgcccctggacctgggcagaagcagagagctgcagtacgtgtacgtggacaacaacatccacctgaagggcctgcccagctacctgtacaacaaggtgatcggctgcagcggctgcggcgcccccatccaggtgagcgaggtgaagctgctgagcttcagcagcggccagagaaccgtgttcctgcccgccgaggtgaaggccatcggcaccgagcacgaccacgtgctgcccctgcaggagctggccatgagaggcctgtaccacacctaccacagcctgctgaagggcagacagctgctggtgctgtggctgaccgccgccccccccagcgtgtgcagactgctgacctgctag

SEQ ID NO: 22136 - DNA, 513 bp, Artificial Sequence
  Description of Artificial Sequence: Synthetic coding sequence
atggccagcgagctgtgcaagaccatcagcgtggccagactggagaagcacaagaacctgttcctgaactacagaaacctgcaccacttccccctggagctgctgaaggacgagggcctgcagtacctggagagactgtacatgaagagaaacagcctgaccagcctgcccgagaacctggcccagaagctgcccaacctggtggagctgtacctgcacagcaacaacatcgtggtggtgcccgaggccatcggcagcctggtgaagctgcagtgcctggacctgagcgacaacgccctggagatcgtgtgccccgagatcggcagactgagagccctgagacacctgagactggccaacaaccagctgcagttcctgccccccgaggtgggcgacctgaaggagctgcagaccctggacatcagcaccaacagactgctgaccctgcccgagagactgcacatgtgcctgagcctgcagtacctgaccgtggacagaaacagactgtggtag

SEQ ID NO: 22137 - DNA, 672 bp, Artificial Sequence
  Description of Artificial Sequence: Synthetic coding sequence
atgtacagcagcggctggcccgccggcgccgccgagcccagacacggcagaggcagagagctggcccaggccctgggctgcatgcacggcgcccccagccagctggccagcctgagcctggcccactgcagcagcctgaagagcagacccgagctggagcaccaggccagcggcaccaaggacgcctgccccgagccccagggccccagcctgctgaccctgagagccctgcaggagctggacctgaccgcctgcagcaagctgaccgacgccagcctggccaaggtgctgcagttcctgcagctgagacagctgagcctgagcctgctgcccgagctgaccgacaacggcctggtggccgtggccagaggctgccccagcctggagcacctggccctgagccactgcagcagactgagcgacaagggctgggcccaggccgccagcagctggcccagactgcagcacctgaacctgagcagctgcagccagctgatcgagcagaccctggacgccatcggccaggcctgcagacagctgagagtgctggacgtggccacctgccccggcatcaacatggccgccgtgagaagattccaggcccagctgccccaggtgagctgcgtgcagagcagattcgtgggcggcgccgacctgaccctgaccctgtag

SEQ ID NO: 22138 - DNA, 672 bp, Artificial Sequence; identical to SEQ ID NO: 22137
  Description of Artificial Sequence: Synthetic coding sequence

SEQ ID NO: 22139 - DNA, 672 bp, Artificial Sequence; identical to SEQ ID NO: 22137
  Description of Artificial Sequence: Synthetic coding sequence

SEQ ID NO: 22140 - DNA, 672 bp, Artificial Sequence; identical to SEQ ID NO: 22137
  Description of Artificial Sequence: Synthetic coding sequence

SEQ ID NO: 22141 - DNA, 498 bp, Artificial Sequence
  Description of Artificial Sequence: Synthetic coding sequence
atgtacagcagcggctggcccgccggcgccgccgagcccagacacggcagaggcagagagctggcccaggccctgggctgcatgcacggcgcccccagccagctggccagcctgagcctggcccactgcagcagcctgaagagcagacccgagctggagcaccaggccagcggcaccaaggacgcctgccccgagccccagggccccagcctgctgaccctgagagccctgcaggagctggacctgaccgcctgcagcaagctgaccgacgccagcctggccaaggtgctgcagttcctgcagctgagacagctgagcctgagcctgctgcccgagctgaccgacaacggcctggtggccgtggccagaggctgccccagcctggagcacctggccctgagccactgcagcagactgagcgacaagggctgggcccaggccgccagcagctggcccagactgcagcacctgaacctgagcagctgcagccagctgtag

SEQ ID NO: 22142 - DNA, 906 bp, Artificial Sequence
  Description of Artificial Sequence: Synthetic coding sequence
atgggcgccagacagagcagagccagcagcaaggacaagggccccaagagaatgctgttcaccggcagaagacagaagttcagcccctgggacgacgccctgctgagcggcagagaccccagaagcctgctgaagagaggcatgcaccacgtgagcttcagcctggtgaccagaggcatgaccgacatccccgacttcctgtggggcctgagcgaggtgcagaagctgaacctgagccacaaccagctgagagtgctgccccccgaggtgggcaagctgaccagaatcgtggtgctgaacctgtgcggcaacagactgaagagcctgcccagagaggtgagcctgctgcagtgcctgaaggtgctgttcgtgaacatgaactgcctgaccgaggtgcccgccgagctgagcctgtgcagaaagctggaggtgctgagcctgagccacaactgcctgagccagctgcccgcctgcttcgccgacctgagcagactgagaaagctgaacctgagcaacaacttcttcgcccacatccccatgtgcgtgttcagcctgaaggagctgatcttcctgcacgtgggcagcaacagactggagaacatcgccgagagcatccagcacctggccagcctgcagatcttcatcgccgagggcaacaacatccacagcttccccagaagcctgtgcctggtgaccagcctggagctgctgaacctgaacaacaacgacatccagaccctgcccagcgagctgcacctgctgtgcagactggtgagaatcgcctggaaccccatggacaagggcctgcacatcagccacaaccccctgagcaagcccctgcccgagctggtggagggcggcctggagatgctgttcggctacctgaaggacaagaagcacacctag

SEQ ID NO: 22143 - DNA, 1491 bp, Artificial Sequence
  Description of Artificial Sequence: Synthetic coding sequence
atgagccagaccagaaagaagaccagcagcgagggcgagaccaagccccagaccagcaccgtgaacaagttcctgagaggcagcaacgccgagagcagaaaggaggacaacgacctgaagaccagcgacagccagcccagcgactggatccagaagaccgccaccagcgagaccgccaagcccctgagcagcgagatggagtggagaagcagcatggagaagaacgagcacttcctgcagaagctgggcaagaaggccgtgaacaagtgcctggacctgaacaactgcggcctgaccaccgccgacatgaaggagatgggcgaggccttcgagatgatccccgagctggaggagctgaacctgagctggaacagcaaggtgggcggcaacctgcccctgatcctgcagaagttccagaagggcagcaagatccagatgatcgagctggtggactgcagcctgaccagcgaggacggcaccttcctgggccagctgctgcccatgctgcagagcctggaggtgctggacctgagcatcaacagagacatcgtgggcagcctgaacagcatcgcccagggcctgaagagcaccagcaacctgaaggtgctgaagctgcacagctgcggcctgagccagaagagcgtgaagatcctggacgccgccttcagatacctgggcgagctgagaaagctggacctgagctgcaacaaggacctgggcggcggcttcgaggacagccccgcccagctggtgatgctgaagcacctgcaggtgctggacctgcaccagtgcagcctgaccgccgacgacgtgatgagcctgacccaggtgatccccctgctgagcaacctgcaggagctggacctgagcgccaacaagaagatgggcagcagcagcgagaacctgctgagcagactgagattcctgcccgccctgaagagcctggtgatcaacaactgcgccctggagagcgagaccttcaccgccctggccgaggccagcgtgcacctgagcgccctggaggtgttcaacctgagctggaacaagtgcgtgggcggcaacctgaagctgctgctggagaccctgaagctgagcatgagcctgcaggtgctgagactgagcagctgcagcctggtgaccgaggacgtggccctgctggccagcgtgatccagaccggccacctggccaagctgcagaagctggacctgagctacaacgacagcatctgcgacgccggctggaccatgttctgccagaacgtgagattcctgaaggagctgatcgagctggacatcagcctgagacccagcaacttcagagactgcggccagtggttcagacacctgctgtacgccgtgaccaagctgccccagatcaccgagatcggcatgaagagatggatcctgcccgccagccaggaggaggagctggagtgcttcgaccaggacaagaagagaagcatccacttcgaccacggcggcttccagtag

SEQ ID NO: 22144 - DNA, 1659 bp, Artificial Sequence
  Description of Artificial Sequence: Synthetic coding sequence
atgagccagaccagaaagaagaccagcagcgagggcgagaccaagccccagaccagcaccgtgaacaagttcctgagaggcagcaacgccgagagcagaaaggaggacaacgacctgaagaccagcgacagccagcccagcgactggatccagaagaccgccaccagcgagaccgccaagcccctgagcagcgagatggagtggagaagcagcatggagaagaacgagcacttcctgcagaagctgggcaagaaggccgtgaacaagtgcctggacctgaacaactgcggcctgaccaccgccgacatgaaggagatggtggccctgctgcccttcctgcccgacctggaggagctggacatcagctggaacggcttcgtgggcggcaccctgctgagcatcacccagcagatgcacctggtgagcaagctgaagatcctgagactgggcagctgcagactgaccaccgacgacgtgcaggccctgggcgaggccttcgagatgatccccgagctggaggagctgaacctgagctggaacagcaaggtgggcggcaacctgcccctgatcctgcagaagttccagaagggcagcaagatccagatgatcgagctggtggactgcagcctgaccagcgaggacggcaccttcctgggccagctgctgcccatgctgcagagcctggaggtgctggacctgagcatcaacagagacatcgtgggcagcctgaacagcatcgcccagggcctgaagagcaccagcaacctgaaggtgctgaagctgcacagctgcggcctgagccagaagagcgtgaagatcctggacgccgccttcagatacctgggcgagctgagaaagctggacctgagctgcaacaaggacctgggcggcggcttcgaggacagccccgcccagctggtgatgctgaagcacctgcaggtgctggacctgcaccagtgcagcctgaccgccgacgacgtgatgagcctgacccaggtgatccccctgctgagcaacctgcaggagctggacctgagcgccaacaagaagatgggcagcagcagcgagaacctgctgagcagactgagattcctgcccgccctgaagagcctggtgatcaacaactgcgccctggagagcgagaccttcaccgccctggccgaggccagcgtgcacctgagcgccctggaggtgttcaacctgagctggaacaagtgcgtgggcggcaacctgaagctgctgctggagaccctgaagctgagcatgagcctgcaggtgctgagactgagcagctgcagcctggtgaccgaggacgtggccctgctggccagcgtgatccagaccggccacctggccaagctgcagaagctggacctgagctacaacgacagcatctgcgacgccggctggaccatgttctgccagaacgtgagattcctgaaggagctgatcgagctggacatcagcctgagacccagcaacttcagagactgcggccagtggttcagacacctgctgtacgccgtgaccaagctgccccagatcaccgagatcggcatgaagagatggatcctgcccgccagccaggaggaggagctggagtgcttcgaccaggacaagaagagaagcatccacttcgaccacggcggcttccagtag

SEQ ID NO: 22145 - DNA, 1260 bp, Artificial Sequence
  Description of Artificial Sequence: Synthetic coding sequence
atgggcagcagcagagaggccgccagagcccccgccagaagccccgcctgggccagcacccaggccagcacccccggcgccgccctggccgtgcagagagagagccccgagagcggcctgcagaagcactacagcaacctgtgcatggagaagagccagaagatcaaccccttcatcctgcacatcctgcaggaggtggacgaggagatcaagaagggcctggccgccggcatcaccctgaacatcgccggcaacaacagactggtgcccgtggagagagtgaccggcgaggacttctggatcctgagcaagatcctgaagaactgcctgtacatcaacggcctggacgtgggctacaacctgctgtgcgacgtgggcgcctactacgccgccaagctgctgcagaagcagctgaacctgatctacctgaacctgatgttcaacgacatcggccccgagggcggcgagctgatcgccaaggtgctgcacaagaacagaaccctgaagtacctgagaatgaccggcaacaagatcgagaacaagggcggcatgttcttcgccgccatgctgcagatcaacagcagcctggagaagctggacctgggcgactgcgacctggaggagagcaccgtgcacgtgggcagaatgctgaaggagaaccactgcctggtggccctgcacatgtgcaagcacgacatcaagaacagcggcatccagcagctgtgcgacgccctgtacctgaacagcagcctgagatacctggacgtgagctgcaacaagatcacccacgacggcatggtgtacctggccgacgtgctgaagagcaacaccaccctggaggtgatcgacctgagcttcaacagaatcgagaacgccggcgccaactacctgagcgagaccctgaccagccacaacagaagcctgaaggccctgagcgtggtgagcaacaacatcgagggcgagggcctggtggccctgagccagagcatgaagaccaacctgaccttcagccacatctacatctggggcaacaagttcgacgaggccacctgcatcgcctacagcgacctgatccagatgggctgcctgaagcccgacaacaccgacgtggagcccttcgtggtggacggcagagtgtacctggccgaggtgagcaacggcctgaagaagcactactactggaccagcacctacggcgagagctacgaccacagcagcaacgccggcttcgccctggtgcccgtgggccagcagccctag

SEQ ID NO: 22146 - DNA, 1395 bp, Artificial Sequence
  Description of Artificial Sequence: Synthetic coding sequence
atggccgcccagccccccagacccgtgggcgagagaagcatgggcagcagcagagaggccgccagagcccccgccagaagccccgcctgggccagcacccaggccagcacccccggcgccgccctggccgtgcagagagagagccccgagagcggcctgcagaagcactacagcaacctgtgcatggagaagagccagaagatcaaccccttcatcctgcacatcctgcaggaggtggacgaggagatcaagaagggcctggccgccggcatcaccctgaacatcgccggcaacaacagactggtgcccgtggagagagtgaccggcgaggacttctggatcctgagcaagatcctgaagaactgcctgtacatcaacggcctggacgtgggctacaacctgctgtgcgacgtgggcgcctactacgccgccaagctgctgcagaagcagctgaacctgatctacctgaacctgatgttcaacgacatcggccccgagggcggcgagctgatcgccaaggtgctgcacaagaacagaaccctgaagtacctgagaatgaccggcaacaagatcgagaacaagggcggcatgttcttcgccgccatgctgcagatcaacagcagcctggagaagctggacctgggcgactgcgacctgggcatgcagagcgtgatcgccttcgccaccgtgctgacccagaaccaggccatcaaggccatcaacctgaacagacccatcctgtacagcgagcaggaggagagcaccgtgcacgtgggcagaatgctgaaggagaaccactgcctggtggccctgcacatgtgcaagcacgacatcaagaacagcggcatccagcagctgtgcgacgccctgtacctgaacagcagcctgagatacctggacgtgagctgcaacaagatcacccacgacggcatggtgtacctggccgacgtgctgaagagcaacaccaccctggaggtgatcgacctgagcttcaacagaatcgagaacgccggcgccaactacctgagcgagaccctgaccagccacaacagaagcctgaaggccctgagcgtggtgagcaacaacatcgagggcgagggcctggtggccctgagccagagcatgaagaccaacctgaccttcagccacatctacatctggggcaacaagttcgacgaggccacctgcatcgcctacagcgacctgatccagatgggctgcctgaagcccgacaacaccgacgtggagcccttcgtggtggacggcagagtgtacctggccgaggtgagcaacggcctgaagaagcactactactggaccagcacctacggcgagagctacgaccacagcagcaacgccggcttcgccctggtgcccgtgggccagcagccctag

SEQ ID NO: 22147 - DNA, 1299 bp, Artificial Sequence
  Description of Artificial Sequence: Synthetic coding sequence
atggccgcccagccccccagacccgtgggcgagagaagcatgggcagcagcagagaggccgccagagcccccgccagaagccccgcctgggccagcacccaggccagcacccccggcgccgccctggccgtgcagagagagagccccgagagcggcctgcagaagcactacagcaacctgtgcatggagaagagccagaagatcaaccccttcatcctgcacatcctgcaggaggtggacgaggagatcaagaagggcctggccgccggcatcaccctgaacatcgccggcaacaacagactggtgcccgtggagagagtgaccggcgaggacttctggatcctgagcaagatcctgaagaactgcctgtacatcaacggcctggacgtgggctacaacctgctgtgcgacgtgggcgcctactacgccgccaagctgctgcagaagcagctgaacctgatctacctgaacctgatgttcaacgacatcggccccgagggcggcgagctgatcgccaaggtgctgcacaagaacagaaccctgaagtacctgagaatgaccggcaacaagatcgagaacaagggcggcatgttcttcgccgccatgctgcagatcaacagcagcctggagaagctggacctgggcgactgcgacctggaggagagcaccgtgcacgtgggcagaatgctgaaggagaaccactgcctggtggccctgcacatgtgcaagcacgacatcaagaacagcggcatccagcagctgtgcgacgccctgtacctgaacagcagcctgagatacctggacgtgagctgcaacaagatcacccacgacggcatggtgtacctggccgacgtgctgaagagcaacaccaccctggaggtgatcgacctgagcttcaacagaatcgagaacgccggcgccaactacctgagcgagaccctgaccagccacaacagaagcctgaaggccctgagcgtggtgagcaacaacatcgagggcgagggcctggtggccctgagccagagcatgaagaccaacctgaccttcagccacatctacatctggggcaacaagttcgacgaggccacctgcatcgcctacagcgacctgatccagatgggctgcctgaagcccgacaacaccgacgtggagcccttcgtggtggacggcagagtgtacctggccgaggtgagcaacggcctgaagaagcactactactggaccagcacctacggcgagagctacgaccacagcagcaacgccggcttcgccctggtgcccgtgggccagcagccctag

SEQ ID NO: 22148 - DNA, 981 bp, Artificial Sequence
  Description of Artificial Sequence: Synthetic coding sequence
atgaccagagagggctaccaggtgagcttcctggacaacaagagcagcggcagcagccccgagaaggagctgatccccaagcccgacaccttccacctgacccacgacgccagcctgagcaagtgcctggacgtgggcgacagcagccagatccacccctaccagctgcccagcgacgtgggcctggagaactacgacagctgctacagccagaccctgagcctgcacggcagcctgggcaagagaccccagagaagcaagaactaccaggagtacagcatcaagcccagcaacgacatcaagaccaccgccagccacagctgcggcgacctgctgaccagcctgagcaaccccgacagcagcaccggcagactgctgaagctgagcagcgacctgtacgccaccacccacttcaacagcgaccccgccgtgctggtgaacgtggagcagcagctgagcaccagcctggacgacctgacccccgcccacggcagcgtgcccaacaacgccgtgctgggcaacagaaccacccccctgagaaccctgctgctgagccccggcaccagcgagcacagaaagatcttcaccaagagaagcctgagccccagcaagagaggcttcaagtggaaggacaacatcctggccaacctgaacctgaagcacggcttccaggacgccaccggcagcgagcccctgagcagcgacctgggcagcctgcacggcctggccggcaaccacagcccccccatcagcgccagaaccccccacgtggccaccgtgctgagacagctgctggagctggtggacaagcactggaacggcagcggcagcctgctgctgaacaagaagttcctgggcaagttcgaggccaagaccggccagagcgccggcggcaagccccacttcgtgagaaagaacagcaccgtgggcggcagatgctgccacctgaactgcgagtgggccaccgtgacctacctgtag

SEQ ID NO: 22149 - DNA, 2265 bp, Artificial Sequence
  Description of Artificial Sequence: Synthetic coding sequence
atggccgagcagtgggagctggacgaggagggcatcagaagactgggcgccctgaccctggagcagcccgagctggtggagagcctgagcctgcagggcagctacgccggcaagatccacagcatcggcgacgccttcagaaacttcaagaacctgagaagcctggacctgagcagaaacctgatcaccagcctgaagggcatccagtacctgtgcagcctgcaggacctgaacctgtactacaacaacatccccagcctggtggaggtgagcagactgcagcccctgcccttcctgaaggagctggacctgagactgaaccccgtggtgagaaaggacaccgactacagactgttcgccgtgtacaccctgcagaccctggagaagctggacgacagaaccgtgagagagggcgagagaaaggccgccaagctgcacttcagccagctgggcaacagcgagaacttcctgctggaggtggagaagagcagcagagagaagaccatgaagaactgcgtgaccggcgagagcagcgccagcaaggtgagcgccaacgtggacagcagaatcgagatggacagcaacaagggcctgttcatccccttccccaacagagagatcaaggacagcctgagcaccagcgccacccagggcaacggcaccagagaccagaagctggacaccttccccctgggcacccagacccaggaggtggccagaagagagatgcccagcgacaaccaccaggaggacgagttcagacactacagccccagacagagcaccgtgagaagccccgagaagatgaccagagagggctaccaggtgagcttcctggacaacaagagcagcggcagcagccccgagaaggagctgatccccaagcccgacaccttccacctgacccacgacgccagcctgagcaagtgcctggacgtgggcgacagcagccagatccacccctaccagctgcccagcgacgtgggcctggagaactacgacagctgctacagccagaccctgagcctgcacggcagcctgggcaagagaccccagagaagcaagaactaccaggagtacagcatcaagcccagcaacgacatcaagaccaccgccagccacagctgcggcgacctgctgaccagcctgagcaaccccgacagcagcaccggcagactgctgaagctgagcagcgacctgtacgccaccacccacttcaacagcgaccccgccgtgctggtgaacgtggagcagcagctgagcaccagcctggacgacctgacccccgcccacggcagcgtgcccaacaacgccgtgctgggcaacagaaccacccccctgagaaccctgctgctgagccccggcaccagcgagcacagaaagatcttcaccaagagaagcctgagccccagcaagagaggcttcaagtggaaggacaacatcctggccaacctgaacctgaagcacggcttccaggacgccaccggcagcgagcccctgagcagcgacctgggcagcctgcacggcctggccggcaaccacagcccccccatcagcgccagaaccccccacgtggccaccgtgctgagacagctgctggagctggtggacaagcactggaacggcagcggcagcctgctgctgaacaagaagttcctgggccccgccagagacctgctgctgagcctggtggtgcccgcccccagccagcccagatgctgcagccaccccgaggacaccatgaaggccttctgcagaagagagctggagctgaaggaggccgcccagctggtgcccaacgacatggagagcctgaagcagaagctggtgagagtgctggaggagaacctgatcctgagcgagaagatccagcagctggaggagggcgccgccatcagcatcgtgagcggccagcagagccacacctacgacgacctgctgcacaagaaccagcagctgaccatgcaggtggcctgcctgaaccaggagctggcccagctgaagaagctggagaagaccgtggccatcctgcacgagagccagagaagcctggtggtgaccaacgagtacctgctgcagcagctgaacaaggagcccaagggctacagcggcaaggccctgctgccccccgagaagggccaccacctgggcagaagcagccccttcggcaagagcaccctgagcagcagcagccccgtggcccacgagaccggccagtacctgatccagagcgtgctggacgccgcccccgagcccggcctgtag

SEQ ID NO: 22150 - DNA, 1590 bp, Artificial Sequence
  Description of Artificial Sequence: Synthetic coding sequence
atgctgagacccagattcctgccccccgacgacagaaccgtgagagagggcgagagaaaggccgccaagctgcacttcagccagctgggcaacagcgagaacttcctgctggaggtggagaagagcagcagagagaagaccatgaagaactgcgtgaccggcgagagcagcgccagcaaggtgagcgccaacgtggacagcagaatcgagatggacagcaacaagggcctgttcatccccttccccaacagagagatcaaggacagcctgagcaccagcgccacccagggcaacggcaccagagaccagaagctggacaccttccccctgggcacccagacccaggaggtggccagaagagagatgcccagcgacaaccaccaggaggacgagttcagacactacagccccagacagagcaccgtgagaagccccgagaagatgaccagagagggctaccaggtgagcttcctggacaacaagagcagcggcagcagccccgagaaggagctgatccccaagcccgacaccttccacctgacccacgacgccagcctgagcaagtgcctggacgtgggcgacagcagccagatccacccctaccagctgcccagcgacgtgggcctggagaactacgacagctgctacagccagaccctgagcctgcacggcagcctgggcaagagaccccagagaagcaagaactaccaggagtacagcatcaagcccagcaacgacatcaagaccaccgccagccacagctgcggcgacctgctgaccagcctgagcaaccccgacagcagcaccggcagactgctgaagctgagcagcgacctgtacgccaccacccacttcaacagcgaccccgccgtgctggtgaacgtggagcagcagctgagcaccagcctggacgacctgacccccgcccacggcagcgtgcccaacaacgccgtgctgggcaacagaaccacccccctgagaaccctgctgctgagccccggcaccagcgagcacagaaagatcttcaccaagagaagcctgagccccagcaagagaggcttcaagtggaaggacaacatcctggccaacctgaacctgaagcacggcttccaggacgccaccggcagcgaggagagcctgaagcagaagctggtgagagtgctggaggagaacctgatcctgagcgagaagatccagcagctggaggagggcgccgccatcagcatcgtgagcggccagcagagccacacctacgacgacctgctgcacaagaaccagcagctgaccatgcaggtggcctgcctgaaccaggagctggcccagctgaagaagctggagaagaccgtggccatcctgcacgagagccagagaagcctggtggtgaccaacgagtacctgctgcagcagctgaacaaggagcccaagggctacagcggcaaggccctgctgccccccgagaagggccaccacctgggcagaagcagccccttcggcaagagcaccctgagcagcagcagccccgtggcccacgagaccggccagtacctgatccagagcgtgctggacgccgcccccgagcccggcctgtag

SEQ ID NO: 22151 - DNA, 681 bp, Artificial Sequence
  Description of Artificial Sequence: Synthetic coding sequence
atggagggccagtacccctgccagcccgagagcaaggcctggttccccagatgctacagacagagagtgacctgggtggtgtgcaccgtgtggctggagaccaccgtgccccccagcctgcccgagccccccatgtggcccctgagcagcgacagcagctggagcctgtggatcagcaccggcatggcccccgcccccagcagcagcaccagaagcttcagcgagagcctgaagcagaagctggtgagagtgctggaggagaacctgatcctgagcgagaagatccagcagctggaggagggcgccgccatcagcatcgtgagcggccagcagagccacacctacgacgacctgctgcacaagaaccagcagctgaccatgcaggtggcctgcctgaaccaggagctggcccagctgaagaagctggagaagaccgtggccatcctgcacgagagccagagaagcctggtggtgaccaacgagtacctgctgcagcagctgaacaaggagcccaagggctacagcggcaaggccctgctgccccccgagaagggccaccacctgggcagaagcagccccttcggcaagagcaccctgagcagcagcagccccgtggcccacgagaccggccagtacctgatccagagcgtgctggacgccgcccccgagcccggcctgtag

SEQ ID NO: 22152 - DNA, 1902 bp, Artificial Sequence
  Description of Artificial Sequence: Synthetic coding sequence
atgctgagacccagattcctgccccccgacgacagaaccgtgagagagggcgagagaaaggccgccaagctgcacttcagccagctgggcaacagcgagaacttcctgctggaggtggagaagagcagcagagagaagaccatgaagaactgcgtgaccggcgagagcagcgccagcaaggtgagcgccaacgtggacagcagaatcgagatggacagcaacaagggcctgttcatccccttccccaacagagagatcaaggacagcctgagcaccagcgccacccagggcaacggcaccagagaccagaagctggacaccttccccctgggcacccagacccaggaggtggccagaagagagatgcccagcgacaaccaccaggaggacgagttcagacactacagccccagacagagcaccgtgagaagccccgagaagatgaccagagagggctaccaggtgagcttcctggacaacaagagcagcggcagcagccccgagaaggagctgatccccaagcccgacaccttccacctgacccacgacgccagcctgagcaagtgcctggacgtgggcgacagcagccagatccacccctaccagctgcccagcgacgtgggcctggagaactacgacagctgctacagccagaccctgagcctgcacggcagcctgggcaagagaccccagagaagcaagaactaccaggagtacagcatcaagcccagcaacgacatcaagaccaccgccagccacagctgcggcgacctgctgaccagcctgagcaaccccgacagcagcaccggcagactgctgaagctgagcagcgacctgtacgccaccacccacttcaacagcgaccccgccgtgctggtgaacgtggagcagcagctgagcaccagcctggacgacctgacccccgcccacggcagcgtgcccaacaacgccgtgctgggcaacagaaccacccccctgagaaccctgctgctgagccccggcaccagcgagcacagaaagatcttcaccaagagaagcctgagccccagcaagagaggcttcaagtggaaggacaacatcctggccaacctgaacctgaagcacggcttccaggacgccaccggcagcgagcccctgagcagcgacctgggcagcctgcacggcctggccggcaaccacagcccccccatcagcgccagaaccccccacgtggccaccgtgctgagacagctgctggagctggtggacaagcactggaacggcagcggcagcctgctgctgaacaagaagttcctgggccccgccagagacctgctgctgagcctggtggtgcccgcccccagccagcccagatgctgcagccaccccgaggacaccatgaaggccttctgcagaagagagctggagctgaaggaggccgcccagctggtgcccaacgacatggagagcctgaagcagaagctggtgagagtgctggaggagaacctgatcctgagcgagaagatccagcagctggaggagggcgccgccatcagcatcgtgagcggccagcagagccacacctacgacgacctgctgcacaagaaccagcagctgaccatgcaggtggcctgcctgaaccaggagctggcccagctgaagaagctggagaagaccgtggccatcctgcacgagagccagagaagcctggtggtgaccaacgagtacctgctgcagcagctgaacaaggagcccaagggctacagcggcaaggccctgctgccccccgagaagggccaccacctgggcagaagcagccccttcggcaagagcaccctgagcagcagcagccccgtggcccacgagaccggccagtacctgatccagagcgtgctggacgccgcccccgagcccggcctgtag

SEQ ID NO: 22153 - DNA, 5103 bp, Artificial Sequence
  Description of Artificial Sequence: Synthetic coding sequence
atgagcagcgcccagtgccccgccctggtgtgcgtgatgagcagactgagattctggggcccctggcccctgctgatgtggcagctgctgtggctgctggtgaaggaggcccagcccctggagtgggtgaaggaccccctgcagctgaccagcaaccccctgggcccccccgacagctggagcagccacagcagccacttccccagagagagcccccacgcccccaccctgcccgccgacccctgggacttcgaccacctgggccccagcgccagcagcgagatgcccgcccccccccaggagagcaccgagaacctggtgcccttcctggacacctgggacagcgccggcgagcagcccctggagcccgagcagttcctggccagccagcaggacctgaaggacaagctgagcccccaggagagactgcccgtgagccccaagaagctgaagaaggaccccgcccagagatggagcctggccgagatcatcggcatcaccagacagctgagcaccccccagagccagaagcagaccctgcagaacgagtacagcagcaccgacaccccctaccccggcagcctgccccccgagctgagagtgaagagcgacgagccccccggccccagcgagcaggtgggccccagccagttccacctggagcccgagacccagaaccccgagaccctggaggacatccagagcagcagcctgcagcaggaggcccccgcccagctgccccagctgctggaggaggagcccagcagcatgcagcaggaggcccccgccctgccccccgagagcagcatggagagcctgaccctgcccaaccacgaggtgagcgtgcagccccccggcgaggaccaggcctactaccacctgcccaacatcaccgtgaagcccgccgacgtggaggtgaccatcaccagcgagcccaccaacgagaccgagagcagccaggcccagcaggagacccccatccagttccccgaggaggtggagcccagcgccacccagcaggaggcccccatcgagccccccgtgccccccatggagcacgagctgagcatcagcgagcagcagcagcccgtgcagcccagcgagagccccagagaggtggagagcagccccacccagcaggagacccccggccagccccccgagcaccacgaggtgaccgtgagcccccccggccaccaccagacccaccacctggccagccccagcgtgagcgtgaagccccccgacgtgcagctgaccatcgccgccgagcccagcgccgaggtgggcaccagcctggtgcaccaggaggccaccaccagactgagcggcagcggcaacgacgtggagccccccgccatccagcacggcggcccccccctgctgcccgagagcagcgaggaggccggccccctggccgtgcagcaggagaccagcttccagagccccgagcccatcaacaacgagaaccccagccccacccagcaggaggccgccgccgagcacccccagaccgccgaggagggcgagagcagcctgacccaccaggaggcccccgcccagacccccgagttccccaacgtggtggtggcccagccccccgagcacagccacctgacccaggccaccgtgcagcccctggacctgggcttcaccatcacccccgagagcaagaccgaggtggagctgagccccaccatgaaggagacccccacccagccccccaagaaggtggtgccccagctgagagtgtaccagggcgtgaccaaccccacccccggccaggaccaggcccagcaccccgtgagccccagcgtgaccgtgcagctgctggacctgggcctgaccatcacccccgagcccaccaccgaggtgggccacagcaccccccccaagagaaccatcgtgagccccaagcaccccgaggtgaccctgccccaccccgaccaggtgcagacccagcacagccacctgaccagagccaccgtgcagcccctggacctgggcttcaccatcacccccaagagcatgaccgaggtggagcccagcaccgccctgatgaccaccgcccccccccccggccaccccgaggtgaccctgccccccagcgacaagggccaggcccagcacagccacctgacccaggccaccgtgcagcccctggacctggagctgaccatcaccaccaagcccaccaccgaggtgaagcccagccccaccaccgaggagaccagcacccagccccccgacctgggcctggccatcatccccgagcccaccaccgagaccagacacagcaccgccctggagaagaccaccgcccccagacccgacagagtgcagaccctgcacagaagcctgaccgaggtgaccggcccccccaccgagctggagcccgcccaggacagcctggtgcagagcgagagctacacccagaacaaggccctgaccgcccccgaggagcacaaggccagcaccagcaccaacatctgcgagctgtgcacctgcggcgacgagatgctgagctgcatcgacctgaaccccgagcagagactgagacaggtgcccgtgcccgagcccaacacccacaacggcaccttcaccatcctgaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctggacctgagctgcaacaagatccagagcatcgagagacacaccttcgagcccctgcccttcctgaagttcatcaacctgagctgcaacgtgatcaccgagctgagcttcggcaccttccaggcctggcacggcatgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagctacatcctgccctacttcagcgccgtgaacctggacgtgaagagcctgctgctgcccttcatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcatcctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaacaacaacaccaagcacaccaccgccagaaacgccttcgaggagaacgacttcatggagaacaccaacatgcccgagggcaccatcagcgagaacaccaactacaaccacccccacgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcgcccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagaggcatcttcagattcctgccctggagaggctgcagcagcagaagagagagccaggacggcctgagcagcttcggccagcccctgtggttcaaggacatgtacaagcccctgagcgccaccagaatcaacaaccacgcctggaagctgcacaagaagagcagcaacgaggacaagatcctgaacagagaccccggcgacagcgaggcccccaccgaggaggaggagagcgaggccctgccctag

SEQ ID NO: 22154 - DNA, 5103 bp, Artificial Sequence; identical to SEQ ID NO: 22153
  Description of Artificial Sequence: Synthetic coding sequence

SEQ ID NO: 22155 - DNA, 1008 bp, Artificial Sequence
  Description of Artificial Sequence: Synthetic coding sequence
atgaccgagaacgtggtgtgcaccggcgccgtgaacgccgtgaaggaggtgtgggagaagagaatcaagaagctgaacgaggacctgaagagagagaaggagttccagcacaagctggtgagaatctgggaggagagagtgagcctgaccaagctgagagagaaggtgaccagagaggacggcagagtgatcctgaagatcgagaaggaggagtggaagaccctgcccagcagcctgctgaagctgaaccagctgcaggagtggcagctgcacagaaccggcctgctgaagatccccgagttcatcggcagattccagaacctgatcgtgctggacctgagcagaaacaccatcagcgagatcccccccggcatcggcctgctgaccagactgcaggagctgatcctgagctacaacaagatcaagaccgtgcccaaggagctgagcaactgcgccagcctggagaagctggagctggccgtgaacagagacatctgcgacctgccccaggagctgagcaacctgctgaagctgacccacctggacctgagcatgaacgacttcaccaccatccccctggccgtgctgaacatgcccgccctggagtggctggacatgggcagcaacaagctggagcagctgcccgacaccatcgagagaatgcagaacctgcacaccctgtggctgcagagaaacgagatcacctgcctgccccagaccatcagcaacatgaagaacctgggcaccctggtgctgagcaacaacaagctgcaggacatccccgtgtgcatggaggagatggccaacctgagattcgtgaacttcagagacaaccccctgaagctgaaggtgagcctgccccccagcgagggcaccgacgaggaggaggagagagagctgttcggcctgcagttcatgcacacctacatccaggagagcagaagaagagccgaccaccaggtgaacggcagcaccaccctgcccatcagcatcaacaccgacggctag

SEQ ID NO: 22156 - DNA, 1020 bp, Artificial Sequence
  Description of Artificial Sequence: Synthetic coding sequence
atgaccgagaacgtggtgtgcaccggcgccgtgaacgccgtgaaggaggtgtgggagaagagaatcaagaagctgaacgaggacctgaagagagagaaggagttccagcacaagctggtgagaatctgggaggagagagtgagcctgaccaagctgagagagaaggtgaccagagaggacggcagagtgatcctgaagatcgagaaggaggagtggaagaccctgcccagcagcctgctgaagctgaaccagctgcaggagtggcagctgcacagaaccggcctgctgaagatccccgagttcatcggcagattccagaacctgatcgtgctggacctgagcagaaacaccatcagcgagatcccccccggcatcggcctgctgaccagactgcaggagctgatcctgagctacaacaagatcaagaccgtgcccaaggagctgagcaactgcgccagcctggagaagctggagctggccgtgaacagagacatctgcgacctgccccaggagctgagcaacctgctgaagctgacccacctggacctgagcatgaacgacttcaccaccatccccctggccgtgctgaacatgcccgccctggagtggctggacatgggcagcaacaagctggagcagctgcccgacaccatcgagagaatgcagaacctgcacaccctgtggctgcagagaaacgagatcacctgcctgccccagaccatcagcaacatgaagaacctgggcaccctggtgctgagcaacaacaagctgcaggacatccccgtgtgcatggaggagatggccaacctgagattcgtgaacttcagagacaaccccctgaagctgaaggtgagcctgccccccagcgagggcaccgacgaggaggaggagagagagctgttcggcctgcagttcatgcacacctacatccaggagagcagaagaagagccgccctgcagttctgcgtgtgccacggccagatcctgaccatctacacctgcatggccctggagatctag

SEQ ID NO: 22157 - DNA, 1008 bp, Artificial Sequence; identical to SEQ ID NO: 22155
  Description of Artificial Sequence: Synthetic coding sequence

SEQ ID NO: 22158 - DNA, 1020 bp, Artificial Sequence; identical to SEQ ID NO: 22156
  Description of Artificial Sequence: Synthetic coding sequence

SEQ ID NO: 22159 - DNA, 1809 bp, Artificial Sequence
  Description of Artificial Sequence: Synthetic coding sequence
atgagcagactgaagagaatcgccggccaggacctgagagccggcttcaaggccggcggcagagactgcggcaccagcgtgccccagggcctgctgaaggccgccagaaagagcggccagctgaacctgagcggcagaaacctgagcgaggtgccccagtgcgtgtggagaatcaacgtggacatccccgaggaggccaaccagaacctgagcttcggcgccaccgagagatggtgggagcagaccgacctgaccaagctgatcatcagcaacaacaagctgcagagcctgaccgacgacctgagactgctgcccgccctgaccgtgctggacatccacgacaaccagctgaccagcctgcccagcgccatcagagagctggagaacctgcagaagctgaacgtgagccacaacaagctgaagatcctgcccgaggagatcaccaacctgagaaacctgaagtgcctgtacctgcagcacaacgagctgacctgcatcagcgagggcttcgagcagctgagcaacctggaggacctggacctgagcaacaaccacctgaccaccgtgcccgccagcttcagcagcctgagcagcctggtgagactgaacctgagcagcaacgagctgaagagcctgcccgccgagatcaacagaatgaagagactgaagcacctggactgcaacagcaacctgctggagaccatcccccccgagctggccggcatggagagcctggagctgctgtacctgagaagaaacaagctgagattcctgcccgagttccccagctgcagcctgctgaaggagctgcacgtgggcgagaaccagatcgagatgctggaggccgagcacctgaagcacctgaacagcatcctggtgctggacctgagagacaacaagctgaagagcgtgcccgacgagatcatcctgctgagaagcctggagagactggacctgagcaacaacgacatcagcagcctgccctacagcctgggcaacctgcacctgaagttcctggccctggagggcaaccccctgagaaccatcagaagagagatcatcagcaagggcacccaggaggtgctgaagtacctgagaagcaagatcaaggacgacggccccagccagagcgagagcgccaccgagaccgccatgaccctgcccagcgagagcagagtgaacatccacgccatcatcaccctgaagatcctggactacagcgacaagcaggccaccctgatccccgacgaggtgttcgacgccgtgaagagcaacatcgtgaccagcatcaacttcagcaagaaccagctgtgcgagatccccaagagaatggtggagctgaaggagatggtgagcgacgtggacctgagcttcaacaagctgagcttcatcagcctggagctgtgcgtgctgcagaagctgaccttcctggacctgagaaacaacttcctgaacagcctgcccgaggagatggagagcctggtgagactgcagaccatcaacctgagcttcaacagattcaagatgctgcccgaggtgctgtacagaatcttcaccctggagaccatcctgatcagcaacaaccaggtgggcagcgtggacccccagaagatgaagatgatggagaacctgaccaccctggacctgcagaacaacgacctgctgcagatcccccccgagctgggcaactgcgtgaacctgagaaccctgctgctggacggcaaccccttcagagtgcccagagccgccatcctgatgaagggcaccgccgccatcctggagtacctgagagacagaatccccacctag

SEQ ID NO: 22160 - DNA, 651 bp, Artificial Sequence
  Description of Artificial Sequence: Synthetic coding sequence
atgctgcagggcgccaccgagctggtggccgagcccaacagaagagtgctggagaccctggccagcagcctgcacaccctgaagttcagacacctgctgttcagcgacgtggccgcccagcagagcctgagacagctgctgcaccagctgatccaccacggcgccgtgagccaggtgagcctgtacagctggcccgtgcccgagagcgccctgttcatcctgatcctgaccatgagcgccggcttctggcagcccggccccggcggccccccctgcagactgtgcggcgaggccagcagaggcagagcccccagcagagacgagggcagcctgctgctgggcagcagaagacccagaagagacgccgccgagagatgcgccgccgccctgatggccagcagaagaaagagcgaggccaagcagatgcccagagccgcccccgccaccagagtgaccagaagaagcacccaggagagcctgaccgccggcggcaccgacctgaagagagagctgcacccccagcccccccccatgagactgctggcccccagcggccacctgctgctgcagcagcccccccccctgcccctgctgctgcacccccacaccaacggccaccagctggcccagccccacagcctgagcccctag

SEQ ID NO: 22161 - DNA, 2439 bp, Artificial Sequence
  Description of Artificial Sequence: Synthetic coding sequence
atggccgcccccgaggcctggagagccagaagctgctggttctgcgaggtggccgccgccaccaccatggaggccaccagcagagaggccgcccccgccaagagcagcgccagcggccccaacgccccccccgccctgttcgagctgtgcggcagagccgtgagcgcccacatgggcgtgctggagagcggcgtgtgggccctgcccggccccatcctgcagagcatcctgcccctgctgaacatctactacctggagagaatcgaggagaccgccctgaagaagggcctgagcacccaggccatctggagaagactgtgggacgagctgatgaagaccagacccagcagcctggagagcgtgacctgctggagagccaagttcatggaggccttcttcagccacgtgctgagaggcaccatcgacgtgagcagcgacagaagactgtgcgaccagagattcagccccctgctgcacagcagcagacacgtgagacagctgaccatctgcaacatgctgcagggcgccaccgagctggtggccgagcccaacagaagagtgctggagaccctggccagcagcctgcacaccctgaagttcagacacctgctgttcagcgacgtggccgcccagcagagcctgagacagctgctgcaccagctgatccaccacggcgccgtgagccaggtgagcctgtacagctggcccgtgcccgagagcgccctgttcatcctgatcctgaccatgagcgccggcttctggcagcccggccccggcggccccccctgcagactgtgcggcgaggccagcagaggcagagcccccagcagagacgagggcagcctgctgctgggcagcagaagacccagaagagacgccgccgagagatgcgccgccgccctgatggccagcagaagaaagagcgaggccaagcagatgcccagagccgcccccgccaccagagtgaccagaagaagcacccaggagagcctgaccgccggcggcaccgacctgaagagagagctgcacccccccgccaccagccacgaggcccccggcaccaagagaagccccagcgcccccgccgccaccagcagcgccagcagcagcaccagcagctacaagagagcccccgccagcagcgccccccagcccaagcccctgaagagattcaagagagccgccggcaagaagggcgccagaaccagacagggccccggcgccgagagcgaggacctgtacgacttcgtgttcatcgtggccggcgagaaggaggacggcgaggagatggagatcggcgaggtggcctgcggcgccctggacggcagcgaccccagctgcctgggcctgcccgccctggaggccagccagagattcagaagcatcagcaccctggagctgttcaccgtgcccctgagcaccgaggccgccctgaccctgtgccacctgctgagcagctgggtgagcctggagagcctgaccctgagctacaacggcctgggcagcaacatcttcagactgctggacagcctgagagccctgagcggccaggccggctgcagactgagagccctgcacctgagcgacctgttcagccccctgcccatcctggagctgaccagagccatcgtgagagccctgcccctgctgagagtgctgagcatcagagtggaccaccccagccagagagacaaccccggcgtgcccggcaacgccggcccccccagccacatcatcggcgacgaggagatccccgagaactgcctggagcagctggagatgggcttccccagaggcgcccagcccgcccccctgctgtgcagcgtgctgaaggccagcggcagcctgcagcagctgagcctggacagcgccaccttcgccagcccccaggacttcggcctggtgctgcagaccctgaaggagtacaacctggccctgaagagactgagcttccacgacatgaacctggccgactgccagagcgaggtgctgttcctgctgcagaacctgaccctgcaggagatcaccttcagcttctgcagactgttcgagaagagacccgcccagttcctgcccgagatggtggccgccatgaagggcaacagcaccctgaagggcctgagactgcccggcaacagactgggcaacgccggcctgctggccctggccgacgtgttcagcgaggacagcagcagcagcctgtgccagctggacatcagcagcaactgcatcaagcccgacggcctgctggagttcgccaagagactggagagatggggcagaggcgccttcggccacctgagactgttccagaactggctggaccaggacgccgtgaccgccagagaggccatcagaagactgagagccacctgccacgtggtgagcgacagctgggacagcagccaggccttcgccgactacgtgagcaccatgtag

SEQ ID NO: 22162 - DNA, 2088 bp, Artificial Sequence
  Description of Artificial Sequence: Synthetic coding sequence
atggaggccaccagcagagaggccgcccccgccaagagcagcgccagcggccccaacgccccccccgccctgttcgagctgtgcggcagagccgtgagcgcccacatgggcgtgctggagagcggcgtgtgggccctgcccggccccatcctgcagagcatcctgcccctgctgaacatctactacctggagagaatcgaggagaccgccctgaagaagggcctgagcacccaggccatctggagaagactgtgggacgagctgatgaagaccagacccagcagcctggagagcgtgacctgctggagagccaagttcatggaggccttcttcagccacgtgctgagaggcaccatcgacgtgagcagcgacagaagactgtgcgaccagagattcagccccctgctgcacagcagcagacacgtgagacagctgaccatctgcaacatgctgcagggcgccaccgagctggtggccgagcccaacagaagagtgctggagaccctggccagcagcctgcacaccctgaagttcagacacctgctgttcagcgacgtggccgcccagcagagcctgagacagctgctgcaccagctgatccaccacggcgccgtgagccaggtgagcctgtacagctggcccgtgcccgagagcgccctgttcatcctgatcctgaccatgagcgccggcttctggcagcccggccccggcggccccccctgcagactgtgcggcgaggccagcagaggcagagcccccagcagagacgagggcagcctgctgctgggcagcagaagacccagaagagacgccgccgagagatgcgccgccgccctgatggccagcagaagaaagagcgaggccaagcagatgcccagagccgcccccgccaccagagtgaccagaagaagcacccaggagagcctgaccgccggcggcaccgacctgaagagagagctgcacccccccgccaccagccacgaggcccccggcaccaagagaagccccagcgcccccgccgccaccagcagcgccagcagcagcaccagcagctacaagagagcccccgccagcagcgccccccagcccaagcccctgaagagattcaagagagccgccggcaagaagggcgccagaaccagacagggccccggcgccgagagcgaggacctgtacgacttcgtgttcatcgtggccggcgagaaggaggacggcgaggagatggagatcggcgaggtggcctgcggcgccctggacggcagcgaccccagctgcctgggcctgcccgccctggaggccagccagagattcagaagcatcagcaccctggagctgttcaccgtgcccctgagcaccgaggccgccctgaccctgtgccacctgctgagcagctgggtgagcctggagagcctgaccctgagctacaacggcctgggcagcaacatcttcagactgctggacagcctgagagccctgagcggccaggccggctgcagactgagagccctgcacctgagcgacctgttcagccccctgcccatcctggagctgaccagagccatcgtgagagccctgcccctgctgagagtgctgagcatcagagtggaccaccccagccagagacacagctggggcatgctggcctgctggccctggcagatgttcagccagagaatccacccccccctgagcgtgagctggaccagcgtgcccaccgccagcagccagatgggcttctggagcagccccagcggctggagcgccggcgccgtggagcccctggtgacctgcgccagcagcaagaccggctggaccagaatgcagagccagcccggcaagcccagcggcggcagcggcctgcccgccatgtggctggccacccacggcacccaccccagacccagccagatcatgctggccccctgcgacggcgccagaaccagccagagccacgccagataccaccagctggccggcgccgaggcctgggccgcccagaaccccaaccaccagttctacctgagcctgagcgtgaccttcttcctgttcttccccagcagcctggccctgagaagctggagaccctag

SEQ ID NO: 22163 - DNA, 1287 bp, Artificial Sequence
  Description of Artificial Sequence: Synthetic coding sequence
atgagctactacctgagcagcgagaaccacctggaccccggccccatctacatgagagagaacggccagctgcacatggtgaacctggccctggacggcgtgagaagcagcctgcagaagcccagacccttcagactgttccccaagggcttcagcgtggagctgtgcatgaacagagaggacgacaccgccagaaaggagaagaccgaccacttcatcttcacctacaccagagagggcaacctgagatacagcgccaagagcctgttcagcctggtgctgggcttcatcagcgacaacgtggaccacatcgacagcctgatcggcttccccgagcagatcgccgagaagctgttcagcgccgccgaggccagacagaagttcaccgagcccggcgccggcctgagagccctgcagaagttcaccgaggcctacggcagcctggtgctgtgcagcctgtgcctgagaaacagatacctggtgatcagcgagaagctggaggagatcaagagcttcagagagctgacctgcctggacctgagctgctgcaagctgggcgacgagcacgagctgctggagcacctgaccaacgaggccctgagcagcgtgacccagctgcacctgaaggacaactgcctgagcgacgccggcgtgagaaagatgaccgcccccgtgagagtgatgaagagaggcctggagaacctgaccctgctggacctgagctgcaaccccgagatcaccgacgccggcatcggctacctgttcagcttcagaaagctgaactgcctggacatcagcggcaccggcctgaaggacatcaagaccgtgaagcacaagctgcagacccacatcggcctggtgcacagcaaggtgcccctgaaggagttcgaccacagcaactgcaagaccgagggctgggccgaccagatcgtgctgcagtgggagagagtgaccgccgaggccgtgaagcccagagagaccagcgagcccagagccgccgcccagagattctacggcaagagaagcagagccgaggcccccctgaagtgccccctggccgacacccacatgaacagcagcgagaagctgcagttctacaaggagaaggcccccgactgccacggccccgtgctgaagcacgaggccatcagcagccaggagagcaagaagagcaagaagagacccttcgaggagagcgagaccgagcagaacaacagcagccagcccagcaagcagaagtacgtgtgcctggccgtggaggactgggacctgctgaacagctactag

SEQ ID NO: 22164 - DNA, 579 bp, Artificial Sequence
  Description of Artificial Sequence: Synthetic coding sequence
atgagctactacctgagcagcgagaaccacctggaccccggccccatctacatgagagagaacggccagctgcacatggtgaacctggccctggacggcgtgagaagcagcctgcagaagcccagacccttcagactgttccccaagggcttcagcgtggagctgtgcatgaacagagaggacgacaccgccagaaaggagaagaccgaccacttcatcttcacctacaccagagagggcaacctgagatacagcgccaagagcctgttcagcctggtgctgggcttcatcagcgacaacgtggaccacatcgacagcctgatcggcttccccgagcagatcgccgagaagctgttcagcgccgccgaggccagacagaagttcaccgagcccggcgccggcctgagagccctgcagaagttcaccgaggcctacggcagcctggtgctgtgcagcctgtgcctgagaaacagatacctggtgatcagcgagaagctggaggagatcaagagcttcagagagctgacctgcctggacctgagctgctgcaagctgggcgacgagcacgagctgctgtag

SEQ ID NO: 22165 - DNA, 1287 bp, Artificial Sequence; identical to SEQ ID NO: 22163
  Description of Artificial Sequence: Synthetic coding sequence

SEQ ID NO: 22166 - DNA, 720 bp, Artificial Sequence
  Description of Artificial Sequence: Synthetic coding sequence
atgagctactacctgagcagcgagaaccacctggaccccggccccatctacatgagagagaacggccagctgcacatggtgaacctggccctggacggcgtgagaagcagcctgcagaagcccagacccttcagactgttccccaagggcttcagcgtggagctgtgcatgaacagagaggacgacaccgccagaaaggagaagaccgaccacttcatcttcacctacaccagagagggcaacctgagatacagcgccaagagcctgttcagcctggtgctgggcttcatcagcgacaacgtggaccacatcgacagcctgatcggcttccccgagcagatcgccgagaagctgttcagcgccgccgaggccagacagaagttcaccgagcccggcgccggcctgagagccctgcagaagttcaccgaggcctacggcagcctggtgctgtgcagcctgtgcctgagaaacagatacctggtgatcagcgagaagctggaggagatcaagagcttcagagagctgacctgcctggacctgagctgctgcaagctgggcgacgagcacgagctgctggagcacctgaccaacgaggccctgagcagcgtgacccagctgcacctgaaggacaactgcctgagcgacgccggcgtgagaaagatgaccgcccccgtgagagtgatgaagagaggcctggagaacctgaccctgctggactag

SEQ ID NO: 22167 - DNA, 1584 bp, Artificial Sequence
  Description of Artificial Sequence: Synthetic coding sequence
atggagtgcctgtgcgcccacccccccgccggcctgcagcacctgggcctgggccacaacaagctgctgggccccctggagagcctgtacgtgaccgccaaccactggggcagagtgagactgggcctgggcgacgccgtgctgaccgccgccgcctgcgtgttcctgctgttcagcgagcccagaagcatctgcttcctggtgtgcggcagcagactgctggccccctgcagccccggcttcctgacccccagaagaagctgcagccccagcagacccaacctggtgagcctggacctgggcttcaacgacctgaccgacctgcagagcatggtgaccagcctgagaaccctgagacacctgagactgctggtgctgcagggcaaccccctggccctggtgccctactacagaggcctgaccatcgacagcctggcccagctgtgcgtgctggacgacatcaccgtgagccccaacgagaagcacctgttcagaggcctgagcctgaacggcgacctgctggcccaggaggcccagttcgtggtgaccatcggcaacatcagaggcgtgctggacaccagcgtgctggaccccgagcccagacccgagggccccttcatcacctacaactactacgtgacctacgacttcgtgaaggacgaggagggcgagatgaacgagagcgccggcgtgctggccgagatcgtgaagcccagccccagcctggagctgctggtggaggagagccccgaggaggtggtggaggacgtgatcgaggacatcgtggaggaggtgaccgaggaggtggagggcagcctggagagcgaggtggaggagagcggcgagagcgagctgagcgtgatcagcggccccagcaccatcctgcagatgcccagagccagcgccgaggagctggccaagctgagactgagaatcgaccccagactgtgccccagccccggcaccgtgctgttcagcaccgcccacaagccctgggccgaggtgatcccctgcagctacgagatgcagcacagcctgagagacctggtgcccctgaaggccttcctgctggccggcaccaccgtgaccatcgtggaggagaagatcctgagctggcccgtggtgctgcccgccgtggacagccccctgagcgccaagaagggcaagggcgagaaggacaagaagggcaaggagaaggacagaaccggcaagggcgagaaggagcccgccaaggagtggaaggtgctgaagaagaagaaggagccccccaaggagctgagacaggacccccccatcctgcaggtgctgggcagaggcctggtgatcctggagcccctgctggccggcgagcccctggtgagcaccgtgtgcaacttcggcgtggtgagaaccctgaccagcgacagactgaccctggccagagacagcaagaagatcaagaaggtggccaagaaggagaagcccaaggccgtgatccccatctacgagggcgactaccaccccgagcccctgaccgtggaggtgcagatccagctgaaccagtgcagaagcgccgaggaggccctgagaatgttcgccgtgtag

SEQ ID NO: 22168 - DNA, 1971 bp, Artificial Sequence
  Description of Artificial Sequence: Synthetic coding sequence
atggaggccagctacgagagcgagagcgagagcgagagcgaggccggccccggcacccagagacccggcaccggcaccgtgagcgccgccgtgagagagcacctgagaaagctgtgcctgagagagttcccctgcggcgccggcagctggaacaagagcagattcctgccccagacctggagaacctggagagagctggtgcccagagaggaggacgtggtgagccccggcgaggagaccgtggaggccctgctgggcctggtgagaagcagacacagcccctgggccctgctgaacaacagcaacgccgaggacagcttcctgagagagctggccatcagaaaccccctgaccatcaccgacaccttcttctacagctacttcagaagcctgagagtgatcgacaagaaggtgaccctggtggacaaggacctgctgaagttcctgaagctggaggagctggtgctgagcgccaacagaatcaaggaggtggacgccaccaacctgccccccaccctgaaggtgctggagctgtacggcaacgagatcagcagcatggagtgcctgtgcgcccacccccccgccggcctgcagcacctgggcctgggccacaacaagctgctgggccccctggagagcctgtacgtgaccgccaaccactggcccaacctggtgagcctggacctgggcttcaacgacctgaccgacctgcagagcatggtgaccagcctgagaaccctgagacacctgagactgctggtgctgcagggcaaccccctggccctggtgccctactacagaggcctgaccatcgacagcctggcccagctgtgcgtgctggacgacatcaccgtgagccccaacgagaagcacctgttcagaggcctgagcctgaacggcgacctgctggcccaggaggcccagttcgtggtgaccatcggcaacatcagaggcgtgctggacaccagcgtgctggaccccgagcccagacccgagggccccttcatcacctacaactactacgtgacctacgacttcgtgaaggacgaggagggcgagatgaacgagagcgccggcgtgctggccgagatcgtgaagcccagccccagcctggagctgctggtggaggagagccccgaggaggtggtggaggacgtgatcgaggacatcgtggaggaggtgaccgaggaggtggagggcagcctggagagcgaggtggaggagagcggcgagagcgagctgagcgtgatcagcggccccagcaccatcctgcagatgcccagagccagcgccgaggagctggccaagctgagactgagaatcgaccccagactgtgccccagccccggcaccgtgctgttcagcaccgcccacaagccctgggccgaggtgatcccctgcagctacgagatgcagcacagcctgagagacctggtgcccctgaaggccttcctgctggccggcaccaccgtgaccatcgtggaggagaagatcctgagctggcccgtggtgctgcccgccgtggacagccccctgagcgccaagaagggcaagggcgagaaggacaagaagggcaaggagaaggacagaaccggcaagggcgagaaggagcccgccaaggagtggaaggtgctgaagaagaagaaggagccccccaaggagctgagacaggacccccccatcctgcaggtgctgggcagaggcctggtgatcctggagcccctgctggccggcgagcccctggtgagcaccgtgtgcaacttcggcgtggtgagaaccctgaccagcgacagactgaccctggccagagacagcaagaagatcaagaaggtggccaagaaggagaagcccaaggccgtgatccccatctacgagggcgactaccaccccgagcccctgaccgtggaggtgcagatccagctgaaccagtgcagaagcgccgaggaggccctgagaatgttcgccgtgtag

SEQ ID NO: 22169 - DNA, 1416 bp, Artificial Sequence
  Description of Artificial Sequence: Synthetic coding sequence
atggagtgcctgtgcgcccacccccccgccggcctgcagcacctgggcctgggccacaacaagctgctgggccccctggagagcctgtacgtgaccgccaaccactggcccaacctggtgagcctggacctgggcttcaacgacctgaccgacctgcagagcatggtgaccagcctgagaaccctgagacacctgagactgctggtgctgcagggcaaccccctggccctggtgccctactacagaggcctgaccatcgacagcctggcccagctgtgcgtgctggacgacatcaccgtgagccccaacgagaagcacctgttcagaggcctgagcctgaacggcgacctgctggcccaggaggcccagttcgtggtgaccatcggcaacatcagaggcgtgctggacaccagcgtgctggaccccgagcccagacccgagggccccttcatcacctacaactactacgtgacctacgacttcgtgaaggacgaggagggcgagatgaacgagagcgccggcgtgctggccgagatcgtgaagcccagccccagcctggagctgctggtggaggagagccccgaggaggtggtggaggacgtgatcgaggacatcgtggaggaggtgaccgaggaggtggagggcagcctggagagcgaggtggaggagagcggcgagagcgagctgagcgtgatcagcggccccagcaccatcctgcagatgcccagagccagcgccgaggagctggccaagctgagactgagaatcgaccccagactgtgccccagccccggcaccgtgctgttcagcaccgcccacaagccctgggccgaggtgatcccctgcagctacgagatgcagcacagcctgagagacctggtgcccctgaaggccttcctgctggccggcaccaccgtgaccatcgtggaggagaagatcctgagctggcccgtggtgctgcccgccgtggacagccccctgagcgccaagaagggcaagggcgagaaggacaagaagggcaaggagaaggacagaaccggcaagggcgagaaggagcccgccaaggagtggaaggtgctgaagaagaagaaggagccccccaaggagctgagacaggacccccccatcctgcaggtgctgggcagaggcctggtgatcctggagcccctgctggccggcgagcccctggtgagcaccgtgtgcaacttcggcgtggtgagaaccctgaccagcgacagactgaccctggccagagacagcaagaagatcaagaaggtggccaagaaggagaagcccaaggccgtgatccccatctacgagggcgactaccaccccgagcccctgaccgtggaggtgcagatccagctgaaccagtgcagaagcgccgaggaggccctgagaatgttcgccgtgtag

SEQ ID NO: 22170 - DNA, 966 bp, Artificial Sequence
  Description of Artificial Sequence: Synthetic coding sequence
atgagcggcggcaagagcgcccagggccccgaggagggcggcgtgtgcatcaccgaggccctgatcaccaagagaaacctgaccttccccgaggacggcgagctgagcgagaagatgttccacaccctggacgagctgcagaccgtgagactggacagagagggcatcaccaccatcagaaacctggagggcctgcagaacctgcacagcctgtacctgcagggcaacaagatccagcagatcgagaacctggcctgcatccccagcctgagattcctgagcctggccggcaaccagatcagacaggtggagaacctgctggacctgccctgcctgcagttcctggacctgagcgagaacctgatcgagaccctgaagctggacgagttcccccagagcctgctgatcctgaacctgagcggcaacagctgcaccaaccaggacggctacagagagctggtgaccgaggccctgcccctgctgctggacctggacggccagcccgtggtggagagatggatcagcgacgaggaggacgaggccagcagcgacgaggagttccccgagctgagcggccccttctgcagcgagagaggcttcctgaaggagctggagcaggagctgagcagacacagagagcacagacagcagaccgccctgaccgagcacctgctgagaatggagatgcagcccaccctgaccgacctgcccctgctgcccggcgtgcccatggccggcgacagcagccccagcgccacccccgcccagggcgaggagaccgtgcccgaggccgtgagcagcccccaggccagcagccccaccaagaagccctgcagcctgatccccagaggccaccagagcagcttctggggcagaaagggcgccagagccgccaccgcccccaaggccagcgtggccgaggcccccagcaccaccaagaccaccgccaagagaagcaagaagtag

SEQ ID NO: 22171 - DNA, 1752 bp, Artificial Sequence
  Description of Artificial Sequence: Synthetic coding sequence
atggccgccgccgccgtgagcgagagctggcccgagctggagctggccgagagagagagaagaagagagctgctgctgaccggccccggcctggaggagagagtgagagccgccggcggccagctgccccccagactgttcaccctgcccctgctgcactacctggaggtgagcggctgcggcagcctgagagcccccggccccggcctggcccagggcctgccccagctgcacagcctggtgctgagaagaaacgccctgggccccggcctgagccccgagctgggccccctgcccgccctgagagtgctggacctgagcggcaacgccctggaggccctgccccccggccagggcctgggccccgccgagccccccggcctgccccagctgcagagcctgaacctgagcggcaacagactgagagagctgcccgccgacctggccagatgcgcccccagactgcagagcctgaacctgaccggcaactgcctggacagcttccccgccgagctgttcagacccggcgccctgcccctgctgagcgagctggccgccgccgacaactgcctgagagagctgagccccgacatcgcccacctggccagcctgaagaccctggacctgagcaacaaccagctgagcgagatccccgccgagctggccgactgccccaagctgaaggagatcaacttcagaggcaacaagctgagagacaagagactggagaagatggtgagcggctgccagaccagaagcatcctggagtacctgagagtgggcggcagaggcggcggcaagggcaagggcagagccgagggcagcgagaaggaggagagcagaagaaagagaagagagagaaagcagagaagagagggcggcgacggcgaggagcaggacgtgggcgacgccggcagactgctgctgagagtgctgcacgtgagcgagaaccccgtgcccctgaccgtgagagtgagccccgaggtgagagacgtgagaccctacatcgtgggcgccgtggtgagaggcatggacctgcagcccggcaacgccctgaagagattcctgaccagccagaccaagctgcacgaggacctgtgcgagaagagaaccgccgccaccctggccacccacgagctgagagccgtgaagggccccctgctgtactgcgccagacccccccaggacctgaagatcgtgcccctgggcagaaaggaggccaaggccaaggagctggtgagacagctgcagctggaggccgaggagcagagaaagcagaagaagagacagagcgtgagcggcctgcacagatacctgcacctgctggacggcaacgagaactacccctgcctggtggacgccgacggcgacgtgatcagcttcccccccatcaccaacagcgagaagaccaaggtgaagaagaccaccagcgacctgttcctggaggtgaccagcgccaccagcctgcagatctgcaaggacgtgatggacgccctgatcctgaagatggccgagatgaagaagtacaccctggagaacaaggaggagggcagcctgagcgacaccgaggccgacgccgtgagcggccagctgcccgaccccaccaccaaccccagcgccggcaaggacggccccagcctgctggtggtggagcaggtgagagtggtggacctggagggcagcctgaaggtggtgtaccccagcaaggccgacctggccaccgcccccccccacgtgaccgtggtgagatag

SEQ ID NO: 22172 - DNA, 1515 bp, Artificial Sequence
  Description of Artificial Sequence: Synthetic coding sequence
atgctgagactggtggccgcctgccccgagagctgcgtggtgtgcaccaaggacgtgaccctgtgccaccagctgacctacatcgtggccgcccccatgaccaccagagtgctgatcatcaccgacggctacctgagcagcatcgagagcaccaacctgagcctgctgttcaacctggccctgctgagcctgagcagaaacggcatcgaggacgtgcaggaggacgccctgcacggcctgaccatgctgagaaccctgctgctggagcacaaccagatcagcagcagcagcctgaccgaccacaccttcagcaagctgcacagcctgcaggtgctggtgctgagcaacaacgccctgagaaccctgagaggcagctggttcagaaacaccagcggcctgaccagactgcagctggacggcaaccagatcaccaacctgaccgacagcagcttcggcggcaccaacctgcacagcctgagatacctggacctgagcaacaacttcatcagctacatcggcaaggacgccttcagacccctgccccagctgcaggaggtggacctgagcagaaacagactggcccacatgcccgacgtgttcacccccctgaagcagctgatcctgctgagcctggacaagaaccagtggagctgcacctgcgacctgcaccccctggccagattcctgagaaactacatcaagagcagcgcccacaccctgagaaacgccaaggacctgaactgccagcccagcaccgccgccgtggccgccgcccagagcgtgctgagactgagcgagaccaactgcgacagcaaggcccccaacttcaccctggtgctgaaggacagaagccccctgctgcccggccccgacgtggccctgctgaccgtgctgggcttcgccggcgccgtgggcctgacctgcctgggcctggtggtgttcaactggaagctgcaccagggcaaggccaacgagcacaccagcgagaacctgtgctgcagaaccttcgacgagcccctgtgcgcccacgaggccagaaactaccacaccaagggctactgcaactgccacctgacccaggagaacgagatcaaggtgatgagcaccgtgggcagcagaaaggagatgcccctgctgcaggagaacagccaccaggccaccagcgccagcgagagcgccaccctggacggcagcttcagaaacctgaagaagaaggacagaggcgtgggcagcaccctgttctgccaggacggcagactgctgcacagcgagtgcagcgagccccccggcaacatgagagccttcaacgaggccggcctgctgaccacctacaaccccagaaaggtgcagaagctgtggaacctggagcccggcgaggtgcagccccagaccctgcagcaccacatcatcagaaccgaggacatcagcagcgacatcttcagaagaagatacgccacccccgccagcgccctggccggcgagagcctggagaagagactgaccaacgagagctag

SEQ ID NO: 22173 - DNA, 1533 bp, Artificial Sequence
  Description of Artificial Sequence: Synthetic coding sequence
atgctgagactggtggccgcctgccccgagagctgcgtggtgtgcaccaaggacgtgaccctgtgccaccagctgacctacatcgtggccgcccccatgaccaccagagtgctgatcatcaccgacggctacctgagcagcatcgagagcaccaacctgagcctgctgttcaacctggccctgctgagcctgagcagaaacggcatcgaggacgtgcaggaggacgccctgcacggcctgaccatgctgagaaccctgctgctggagcacaaccagatcagcagcagcagcctgaccgaccacaccttcagcaagctgcacagcctgcaggtgctggtgctgagcaacaacgccctgagaaccctgagaggcagctggttcagaaacaccagcggcctgaccagactgcagctggacggcaaccagatcaccaacctgaccgacagcagcttcggcggcaccaacctgcacagcctgagatacctggacctgagcaacaacttcatcagctacatcggcaaggacgccttcagacccctgccccagctgcaggaggtggacctgagcagaaacagactggcccacatgcccgacgtgttcacccccctgaagcagctgatcctgctgagcctggacaagaaccagtggagctgcacctgcgacctgcaccccctggccagattcctgagaaactacatcaagagcagcgcccacaccctgagaaacgccaaggacctgaactgccagcccagcaccgccgccgtggccgccgcccagagcgtgctgagactgagcgagaccaactgcgacagcaaggcccccaacttcaccctggtgctgaaggacagaagccccctgctgcccggccccgacgtggccctgctgaccgtgctgggcttcgccggcgccgtgggcctgacctgcctgggcctggtggtgttcaactggaagctgcaccagggcaaggccaacgagcacaccagcgagaacctgtgctgcagaaccttcgacgagcccctgtgcgcccacgaggccagaaactaccacaccaagggctactgcaactgccacctgacccaggagaacgagatcaaggtgatgagcaccgtgggcagcagaaaggagatgcccctgctgcaggagaacagccaccaggccaccagcgccagcgagagcgccaccctggacggcagcttcagaaacctgaagaagaaggacagaggcgtgggcagcaccctgttctgccaggacggcagactgctgcacagcgagtgcagcgagccccccggcaacatgagagccttcaacgaggccggcctgctgaccacctacaaccccagaaaggtgcagaagctgtggaacctggagcccggcgaggtgcagccccagaccctgcagcaccacatcatcagaaccgaggacatcagcagcgacatcttcagaagaagatacgccacccccgccagcgccctggccggcgagagcctggagaagagactgaccaacgagagctggcagccccccatcgagtag

SEQ ID NO: 22174 - DNA, 1629 bp, Artificial Sequence
  Description of Artificial Sequence: Synthetic coding sequence
atggacctgggctgggacagaagcagaggccccagaagaagcaccagcagcgtgagagtgagagagctgagctggcagggcctgcacaacccctgcccccagagcaagggccccggcagccagagagacagactgggcgagcagctggtggaggagtacctgagccccgccagactgcaggccctggccagagtggacgacctgagactggtgagaaccctggagatgtgcgtggacaccagagagggcagcctgggcaacttcggcgtgcacctgcccaacctggaccagctgaagctgaacggcagccacctgggcagcctgagagacctgggcaccagcctgggccacctgcaggtgctgtggctggccagatgcggcctggccgacctggacggcatcgccagcctgcccgccctgaaggagctgtacgccagctacaacaacatcagcgacctgagccccctgtgcctgctggagcagctggaggtgctggacctggagggcaacagcgtggaggacctgggccaggtgagatacctgcagctgtgccccagactggccatgctgaccctggagggcaacctggtgtgcctgcagcccgcccccggccccaccaacaaggtgcccagaggctacaactacagagccgaggtgagaaagctgatcccccagctgcaggtgctggacgaggtgcccgccgcccacaccggcccccccgccccccccagactgagccaggactggctggccgtgaaggaggccatcaagaagggcaacggcctgccccccctggactgccccagaggcgcccccatcagaagactggaccccgagctgagcctgcccgagacccagagcagagccagcagaccctggcccttcagcctgctggtgagaggcggccccctgcccgagggcctgctgagcgaggacctggcccccgaggacaacaccagcagcctgacccacggcgccggccaggtgctgtgcggcaaccccaccaagggcctgagagagagaagacaccagtgccaggccagagagccccccgagcagctgccccagcacagacccggcgaccccgccgccagcaccagcacccccgagcccgaccccgccgacagcagcgacttcctggccctggccggcctgagagcctggagagagcacggcgtgagacccctgccctacagacaccccgagagccagcaggagggcgccgtggccccctggggccccagaagagtgcccgaggagcaggtgcaccaggccgagcccaagacccccagcagcccccccagcctggccagcgagcccagcggcaccagcagccagcacctggtgcccagcccccccaagcaccccagacccagagacagcggcagcagcagccccagatggagcaccgacctgcagagcagaggcagaagactgagagtgctgggcagctggggccccggcctgggcgacggcgtggccgccgtgcccgtgctgagagccctggaggtggccagcagactgagccccagagcccagggctgccccggccccaagcccgcccccgacgccgccgccagaccccccagagccgccgagctgagccaccccagccccgtgcccacctag

SEQ ID NO: 22175 - DNA, 720 bp, Artificial Sequence
  Description of Artificial Sequence: Synthetic coding sequence
atgggcaacagcgccctgagagcccacgtggagaccgcccagaagaccggcgtgttccagctgaaggacagaggcctgaccgagttccccgccgacctgcagaagctgaccagcaacctgagaaccatcgacctgagcaacaacaagatcgagagcctgccccccctgctgatcggcaagttcaccctgctgaagagcctgagcctgaacaacaacaagctgaccgtgctgcccgacgagatctgcaacctgaagaagctggagaccctgagcctgaacaacaaccacctgagagagctgcccagcaccttcggccagctgagcgccctgaagaccctgagcctgagcggcaaccagctgggcgccctgcccccccagctgtgcagcctgagacacctggacgtgatggacctgagcaagaaccagatcagaagcatccccgacagcgtgggcgagctgcaggtgatcgagctgaacctgaaccagaaccagatcagccagatcagcgtgaagatcagctgctgccccagactgaagatcctgagactggaggagaactgcctggagctgagcatgctgccccagagcatcctgagcgacagccagatctgcctgctggccgtggagggcaacctgttcgagatcaagaagctgagagagctggagggctacgacaagtacatggagagattcaccgccaccaagaagaagttcgcctag

SEQ ID NO: 22176 - DNA, 720 bp, Artificial Sequence; identical to SEQ ID NO: 22175
  Description of Artificial Sequence: Synthetic coding sequence

SEQ ID NO: 22177 - DNA, 1116 bp, Artificial Sequence
  Description of Artificial Sequence: Synthetic coding sequence
atggaggaggccggcgccgccgtggtgaccgccggcgaggccgagctgaactggagcagactgagcgtgagcaccgagaccctggagagcgagctggaggccagaggcgaggagagaagaggcgccagagaggccctgctgagactgctgctgccccacaacagactggtgagcctgcccagagccctgggcagcggcttcccccacctgcagctgctggacgtgagcggcaacgccctgaccgccctgggccccgagctgctggccctgagaggcctgagaaccctgctggccaagaacaacagactgggcggccccagcgccctgcccaagggcctggcccagagccccctgtgcagaagcctgcaggtgctgaacctgagcggcaactgcttccaggaggtgcccgccagcctgctggagctgagagccctgcagaccctgagcctgggcggcaaccagctgcagagcatccccgccgagatcgagaacctgcagagcctggagtgcctgtacctgggcggcaacttcatcaaggagatcccccccgagctgggcaacctgcccagcctgaactacctggtgctgtgcgacaacaagatccagagcatccccccccagctgagccagctgcacagcctgagaagcctgagcctgcacaacaacctgctgacctacctgcccagagagatcctgaacctgatccacctggaggagctgagcctgagaggcaaccccctggtggtgagattcgtgagagacctgacctacgacccccccaccctgctggagctggccgccagaaccatcaagatcagaaacatcagctacaccccctacgacctgcccggcaacctgctgagatacctgggcagcgccagcaactgccccaaccccaagtgcggcggcgtgtacttcgactgctgcgtgagacagatcaagttcgtggacttctgcggcaagtacagactgcccctgatgcactacctgtgcagccccgagtgcagcagcccctgcagcagcgccagccacagcagcaccagccagagcgagagcgacagcgaggacgaggccagcgtggccgccagaagaatgcagaaggtgctgctgggctag

SEQ ID NO: 22178 - DNA, 780 bp, Artificial Sequence
  Description of Artificial Sequence: Synthetic coding sequence
atggacccccccgccgagaagcccggcgaggccggcggcctgcagatcaccccccagctgctgaagagcagaaccggcgagttcagcctggagagcatcctgctgctgaagctgagaggcctgggcctggccgacctgggctgcctgggcgagtgcctgggcctggagtggctggacctgagcggcaacgccctgacccacctgggccccctggccagcctgagacagctggccgtgctgaacgtgagcaacaacagactgaccggcctggagcccctggccacctgcgagaacctgcagagcctgaacgccgccggcaacctgctggccacccccggccagctgcagtgcctggccggcctgccctgcctggagtacctgagactgagagaccccctggccagactgagcaaccccctgtgcgccaaccccagctactgggccgccgtgagagagctgctgcccggcctgaaggtgatcgacggcgagagagtgatcggcagaggcagcgagttctaccagctgtgcagagacctggacagcagcctgagacccagcagcagccccggccccagagccaccgaggcccagccctgggtggagcccggctactgggagagctggcccagcagaagcagcagcatcctggaggaggcctgcagacagttccaggacaccctgcaggagtgctgggacctggacagacaggccagcgacagcctggcccaggccgagcaggtgctgagcagcgccggccccaccagcagcttcgtgttctag

SEQ ID NO: 22179 - DNA, 780 bp, Artificial Sequence; identical to SEQ ID NO: 22178
  Description of Artificial Sequence: Synthetic coding sequence

SEQ ID NO: 22180 - DNA, 780 bp, Artificial Sequence; identical to SEQ ID NO: 22178
  Description of Artificial Sequence: Synthetic coding sequence

SEQ ID NO: 22181 - DNA, 1746 bp, Artificial Sequence
  Description of Artificial Sequence: Synthetic coding sequence
atgcagaagccccccctgctgctgagaagacccctgccccccaagttcaccaagctgagcctgcacgagaagaagacccacaccgccaagaccggcaagatcgagagcctgcacgtggccttcaccgaggacgagaccaccagcatcaagatggacagaaccagattccccgacgtgctgagaaaccagagcctgacccccatcaacatccagaacatcttcctggaccactgcgtgcaggagagagtgaccgccatcagcagcccccagaagagcaccaagcacgtgagagagcagatccccgacaccgccaccggcagcatcttcttcccccactgcaacagcgccagcaccagaatcttcggcaagcagaccaacaagatggagagcagcagaaagttcaagaccatgaaggacgtgtacaccgagaagagactggagaacatcctgatcctgagcagcaagttcagcaagcccaagagcacccccggcagcgtgatcgcccagaagctggagaagatgcaccccaagcaccagcccctgcccgagagccccggctacacctaccagcacatcagcagagacctgagcgccaccgtgcccagccccccccccatgaccgtgagcatgaagcccgagggccagtggcccgagcacttcaagagcaccgccaccctgaccctgagagtgaccgagttccccggcttcgtgagcctgcccacccccgtgctgcccagaaagccccacagacagagcgtgatcgagaccctggtgaccgagaacggcaacatcgagagcgtgcccaagcagatcccccccagaccccccgagggcctgaccaagaccgagaagatcgagagcgagatccacgtggtgagaggcgagggcttcaagaccgtggccgccaccagatacgagaccatcaccgccatgaccaacctggccatcgtgaactgccaggtgtacggcagaaacgccctgaacctgaagggcttcttcatcctgaactgccccgacctgacccccctggccttccagctgatctacctgaacctgagcttcaacgacctgcactacttccccaccgagatcctgtgcctgaagaacctgcagatcctgaagctgagaaacaaccccatcaaggagatccccagcgagatccagcagctggagttcctgagaatcttcaccatcgccttcaacctgatcaccgtgctgcccatcggcctgttcagcctgagctacctggaggagctggacgtgagctacaacgagctgaccttcatccccaacgagatccagaagctgagaagcctggagaagctgaccgtggacggcaacgagctgagcttcttcccccacggcatcctgaagctgaacctgaccaagatccagttcgagaacaacttcacccacccctgcttctggagagacaactacctgaacaacccccagcagctgacccagatcatcagcctgttcatcgtgcagaacaagctgcacaagttctacgacaagatccccgtggaggtgcagaagctgctgaagtggtggggcgcccagttcctgaccgagctggcccccctgagcatctacagcagcagaaaggccatcaccgagggctacatcgccgtggagctgcccaagttcgaggagagcaagaacatcaccgagggcctgctgacccagaagagatacgaggaggtgatggtgaagtgcatcaacgccaccaccgtgaccagctag

SEQ ID NO: 22182 - DNA, 576 bp, Artificial Sequence
  Description of Artificial Sequence: Synthetic coding sequence
atgaccgagagactgctgatcaaggccctgagcggcggcaagaacaccaagatcatcaccctgaacggcaagaagatgaccaagatgcccagcgccctgggcaagctgcccggcctgaagaccctggtgctgcagaacaacctgatccccaaggtgtgccccgagctgtgcaacctgacccagttccaggacctgaagctgagagagttctactgcgagggcaaccccctgttcctgcagcagcccgtgatcagcacccagcaggagaacgtgtggagcctgcaggagatcaccagcagattcgtgatgaaccagctggccgagaacaaccccttcctgatggacgacatcgagagatacccccaggtgagaagcatgatcagccagggcaagacctgcgccatctgcggccagtacttcatcaccgtgtggctggagtgcgtgagattcgtgcccccccccaaggactggaagatcagcaagaacctgaagctggtgcccctgcaggtgctgatctgcagctacaagtgcttcacccagagagaccccaacctgttcggcatcgcccaggtgtag

SEQ ID NO: 22183 - DNA, 153 bp, Artificial Sequence
  Description of Artificial Sequence: Synthetic coding sequence
atgaccgagagactgctgatcaaggccctgagcggcggcaagaacaccaagatcatcaccctgaacggcaagaagatgaccaagatgcccagcgccctgggcaagctgcccggcctgaagaccctggtgctgcagaacaacctgatcccctag

SEQ ID NO: 22184 - DNA, 1044 bp, Artificial Sequence
  Description of Artificial Sequence: Synthetic coding sequence
atgaccgagagactgctgatcaaggccctgagcggcggcaagaacaccaagatcatcaccctgaacggcaagaagatgaccaagatgcccagcgccctgggcaagctgcccggcctgaagaccctggtgctgcagaacaacctgatccccaaggtgtgccccgagctgtgcaacctgacccagctgaccaccctgaacctgggcaacaacctgctggaggaggtgcccgaggagatgaagtacctgaccagcctgaagaacctgcacctgagcggcaacagaatctgcagattcgcccccggcgcctgcgacggcctgcagaacctgatcctgctgaacctgaacaacaaccacctgacccagctgccccaggaggtgagcagactgaagagcctgacctacatgagcatcaactacaaccagctggccagcatccccagagagctgtgcttcctggagaacctggtggagctgcagctgaactacaaccagctgatctgcatccccgaggagatcaagttcctgaagaagctgcagaagctgctgctggccagaaacaacatcggcgtgctgcccgaggagctgtgcgacctgaagaagctgagaatcctggacatcgccggcaacatcatccagatcttccccagcggcttccaggacctgaagctgagagagttctactgcgagggcaaccccctgttcctgcagcagcccgtgatcagcacccagcaggagaacgtgtggagcctgcaggagatcaccagcagattcgtgatgaaccagctggccgagaacaaccccttcctgatggacgacatcgagagatacccccaggtgagaagcatgatcagccagggcaagacctgcgccatctgcggccagtacttcatcaccgtgtggctggagtgcgtgagattcgtgcccccccccaaggactggaagatcagcaagaacctgaagctggtgcccctgcaggtgctgatctgcagctacaagtgcttcacccagagagaccccaacctgttcggcatcgcccaggtgtag

SEQ ID NO: 22185 - DNA, 1680 bp, Artificial Sequence
  Description of Artificial Sequence: Synthetic coding sequence
atgagcagcgagcagagcgcccccggcgccagccccagagcccccagacccggcacccagaagagcagcggcgccgtgaccaagaagggcgagagagccgccaaggagaagcccgccaccgtgctgccccccgtgggcgaggaggagcccaagagccccgaggagtaccagtgcagcggcgtgctggagaccgacttcgccgagctgtgcaccagatggggctacaccgacttccccaaggtggtgaacagacccagaccccacccccccttcgtgcccagcgccagcctgagcgagaaggccaccctggacgaccccagactgagcggcagctgcagcctgaacagcctggagagcaagtacgtgttcttcagacccaccatccaggtggagctggagcaggaggacagcaagagcgtgaaggagatctacatcagaggctggaaggtggaggagagaatcctgggcgtgttcagcaagtgcctgccccccctgacccagctgcaggccatcaacctgtggaaggtgggcctgaccgacaagaccctgaccaccttcatcgagctgctgcccctgtgcagcagcaccctgagaaaggtgagcctggagggcaaccccctgcccgagcagagctaccacaagctgatggccctggacagcaccatcgcccacctgagcctgagaaacaacaacatcgacgacagaggcgcccagctgctgggccaggccctgagcaccctgcacagctgcaacagaaccctggtgagcctgaacctgggcttcaaccacatcggcgacgagggcgccggctacatcgccgacggcctgagactgaacagaagcctgctgtggctgagcctggcccacaacagaatccaggacaagggcgccctgaagctggccgaggtgctgagagccttcgagctgacccacaccgaggtggtggagagaagaagactgctgctggagaagggcacccaggagagaagcagaagccccagcagcagcagacacggcgacagcaagaccgacagagagaagagccagatggtgggcatcagcaacagcgccctggtggacaagaccgacaagacccagaccatgaagacccccaagggcctgggcaagaagaaggagaagagctgggagctggccaagaaggaggagaagctgggcagcggccagagccccacccagggcacccccaagaaggaggacgccaccaaggccggcaagggcaaggtgaccatccccgagcagaagcccagcagagccaagggcatcaagatcggcagcagagagaagagaagcatcctgctggagagcgagctggtggtggaggccaccgaggtggtgaaccccctgctggagcccgtggagcacagagacggcaaggtgttcatgcccggcaacaaggtgctgctgcacctgaacctgatcagaaacagaatcaccgaggtgggcctggagggcttcctggccaccgtgcagtaccagatgcagttcagcaaggccaagagcgccagcaagggccccgtgggcctgctgtggctgagcctggccaagaactgcttcgccccccagtgccccgcctacgccatcatccaggagctgatgctgcccagagaccccatcaaggccaagctgagagaggacgaggccatggccttcttcccctag

SEQ ID NO: 22186 - DNA, 864 bp, Artificial Sequence
  Description of Artificial Sequence: Synthetic coding sequence
atgagctgggaccccaaccccgtgcccagaaccctgagatgctggagactgagaagagccagcgagaccgccctgcagagcagcagaagagccgtggaggaccagctgaagatctgcggccacagaagagacgccgacgtgttcgagctgttcctgagcaagaaggagctgaccgaggtgatcgacctgagcagattcaagaagctgaagtacctgtggctgcaccacaacaagctgcacggcatcaccttcctgaccagaaactactgcctgaccgagctgtacctgaacaacaacgccatcttcgagatcgagggcctgcactacctgcccagcctgcacatcctgctgctgcaccacaacgagctgaccaacatcgacgccaccgtgaaggagctgaagggcatgctgaacctgaagatcctgagcctgtaccagaaccccctgtgccagtacaacctgtacagactgtacatcatctaccacctgcccggcgtggagctgctggacagaaaccaggtgaccgagaaggagagaagaagcatgatcaccatcttcaaccacaagaaggcccacatcgtgcagagcatcgccttcggcggcaaggtggacgccagctgggaccccaagagccccttcaagcagaagcccgcccagagagtgcccagcgacttcgccttcgccaacaacgtggacaagaccgtgctggacgaccccgaggacgccgtgttcgtgagaagcatgaagagaagcgtgatgaccctgaccagcatgaactgggacaccgtgcccaccagagaggagagatacctggaggaggagggcaccgagaccgcccagatgctgaccgtgaccctgagatag

SEQ ID NO: 22187 - DNA, 951 bp, Artificial Sequence
  Description of Artificial Sequence: Synthetic coding sequence
atgctgcccagcagcatccagatcagcggcgagcccctgagcggcgccgaggtgagagacatctgcagaggcctgagagacaacgccgtgagactgctgagcctgagaggctgcagactgtgcgacagagacttcggcagaatctgcagagccctggccggcgccaccagcctggcccagctgaacctgaacctgggcgtggtgagcagccccagcagaatcaagcagctggccgaggccctgagaaccaacagaagcatccagagcctgttcctgcacggcagccccctgaccgacgccggcctggccctgctgaaccccgccctggccctgcaccccgccctggtggccctggacctgggcgactgcatgctgggcgacgaggccatcaacctgatctgcggcctgctgccccccgacggcgccaagagcggcctgaaggagctgaccctgagcgccaaccccggcatcacccccaagggctggagcagactggccatcgccgtggcccacagcagccaggtgagagtgctgaacctggactacaaccccctgggcgaccacgtggccggcatgctggccgtggccgtggccagcagcagaaccctggaggtgctggacctggagggcaccggcctgaccaaccagagcgcccagaccctgctggacatggtggagaactaccccaccgccctgagaagcctggtgctggccgagaacagcatcagccccgagctgcagcagcagatctgcgacctgctgagcgagggcgaggaggaggaggaggtggccggcggcgccggcgacacccaggagtgggagagaggcagagagcccgccgcccaccagagaggcagcagcagctggatgtgccccagcgaccccagcagccagatggtgctgatgaccagcggcctgggcgacagcctgctggccgagaccgagatgtag

SEQ ID NO: 22188 - DNA, 1245 bp, Artificial Sequence
  Description of Artificial Sequence: Synthetic coding sequence
atgaagctgcactgcgaggtggaggtgatcagcagacacctgcccgccctgggcctgagaaacagaggcaagggcgtgagagccgtgctgagcctgtgccagcagaccagcagaagccagccccccgtgagagccttcctgctgatcagcaccctgaaggacaagagaggcaccagatacgagctgagagagaacatcgagcagttcttcaccaagttcgtggacgagggcaaggccaccgtgagactgaaggagccccccgtggacatctgcctgagcaaggccatcagcagcagcctgaagggcttcctgagcgccatgagactggcccacagaggctgcaacgtggacacccccgtgagcaccctgacccccgtgaagaccagcgagttcgagaacttcaagaccaagatggtgatcaccagcaagaaggactaccccctgagcaagaacttcccctacagcctggagcacctgcagaccagctactgcggcctggtgagagtggacatgagaatgctgtgcctgaagagcctgagaaagctggacctgagccacaaccacatcaagaagctgcccgccaccatcggcgacctgatccacctgcaggagctgaacctgaacgacaaccacctggagagcttcagcgtggccctgtgccacagcaccctgcagaagagcctgagaagcctggacctgagcaagaacaagatcaaggccctgcccgtgcagttctgccagctgcaggagctgaagaacctgaagctggacgacaacgagctgatccagttcccctgcaagatcggccagctgatcaacctgagattcctgagcgccgccagaaacaagctgcccttcctgcccagcgagttcagaaacctgagcctggagtacctggacctgttcggcaacaccttcgagcagcccaaggtgctgcccgtgatcaagctgcaggcccccctgaccctgctggagagcagcgccagaaccatcctgcacaacagaatcccctacggcagccacatcatccccttccacctgtgccaggacctggacaccgccaagatctgcgtgtgcggcagattctgcctgaacagcttcatccagggcaccaccaccatgaacctgcacagcgtggcccacaccgtggtgctggtggacaacctgggcggcaccgaggcccccatcatcagctacttctgcagcctgggctgctacgtgaacagcagcgacatgctgaagtag

SEQ ID NO: 22189 - DNA, 441 bp, Artificial Sequence
  Description of Artificial Sequence: Synthetic coding sequence
atgaagctgcactgcgaggtggaggtgatcagcagacacctgcccgccctgggcctgagaaacagaggcaagggcgtgagagccgtgctgagcctgtgccagcagaccagcagaagccagccccccgtgagagccttcctgctgatcagcaccctgaaggacaagagaggcaccagatacgagctgagagagaacatcgagcagttcttcaccaagttcgtggacgagggcaaggccaccgtgagactgaaggagccccccgtggacatctgcctgagcaaggacagcatctggctgagctaccacagcatccccagcctgcccagattcggctacagaaagaacctgtgcctgtggaagatcctgagcgagctgttccacagcagaaactactaccacgagagcgccttctgctgcccccactgcggcctgagcagatag

SEQ ID NO: 22190 - DNA, 1269 bp, Artificial Sequence
  Description of Artificial Sequence: Synthetic coding sequence
atgaagctgcactgcgaggtggaggtgatcagcagacacctgcccgccctgggcctgagaaacagaggcaagggcgtgagagccgtgctgagcctgtgccagcagaccagcagaagccagccccccgtgagagccttcctgctgatcagcaccctgaaggacaagagaggcaccagatacgagctgagagagaacatcgagcagttcttcaccaagttcgtggacgagggcaaggccaccgtgagactgaaggagccccccgtggacatctgcctgagcaagatggagagccacagcgtgacccaggtgggcgtgcagtgggaggagctgggcagcctgcagcccaccggccacttccagcagttcaagagattccccttcagctacgagaccggccacagaggctgcaacgtggacacccccgtgagcaccctgacccccgtgaagaccagcgagttcgagaacttcaagaccaagatggtgatcaccagcaagaaggactaccccctgagcaagaacttcccctacagcctggagcacctgcagaccagctactgcggcctggtgagagtggacatgagaatgctgtgcctgaagagcctgagaaagctggacctgagccacaaccacatcaagaagctgcccgccaccatcggcgacctgatccacctgcaggagctgaacctgaacgacaaccacctggagagcttcagcgtggccctgtgccacagcaccctgcagaagagcctgagaagcctggacctgagcaagaacaagatcaaggccctgcccgtgcagttctgccagctgcaggagctgaagaacctgaagctggacgacaacgagctgatccagttcccctgcaagatcggccagctgatcaacctgagattcctgagcgccgccagaaacaagctgcccttcctgcccagcgagttcagaaacctgagcctggagtacctggacctgttcggcaacaccttcgagcagcccaaggtgctgcccgtgatcaagctgcaggcccccctgaccctgctggagagcagcgccagaaccatcctgcacaacagaaccatctaccccaaggagatcaacgtgaacatgtgggagaccctgcccggcagaatcagcctgggctgcatgtacgacttcgccgccagcaactggagcaagggcagattcctgtacacctgctggagaggcggcatgtgcatcgtgacccacctggacgacagcaagaccttcatcaagaccaacttcagcttctag

SEQ ID NO: 22191 - DNA, 507 bp, Artificial Sequence
  Description of Artificial Sequence: Synthetic coding sequence
atgcaccccagcctggccaccatgggcaagctggccagcaagctgcagctggacctgagcgtggtgaagatctggttcaagaaccagagagccaagtggaagagacagcagagacagcagatgcagaccagacccagcctgggccccgccaaccagaccaccagcgtgaagaaggaggagacccccagcgccatcaccaccgccaacatcagacccgtgagccccggcatcagcgacgccaacgaccacgacctgagagagcccagcggcatcaagaaccccggcggcgccagcgccagcgccagagtgagcagctgggacagccagagctacgacatcgagcagatctgcctgggcgccagcaaccccccctgggccagcaccctgttcgagatcgacgagttcgtgaagatctacgacctgcccggcgaggacgacaccagcagcctgaaccagtacctgttccccgtgtgcctggagtacgaccagctgcagagcagcgtgtag

SEQ ID NO: 22192 - DNA, 549 bp, Artificial Sequence
  Description of Artificial Sequence: Synthetic coding sequence
tgagcccacggcttccagccccacgccagcgtggagcccgcctgccaggccggcacctggaacctgaagcagctgagccaggagggccccagaagatacagaagacccagaaccagattcctgagcaagcagctgaccgccctgagagagctgctggagaagaccatgcaccccagcctggccaccatgggcaagctggccagcaagctgcagctggacctgagcgtggtgaagatctggttcaagaaccagagagccaagtggaagagacagcagagacagcagatgcagaccagacccagcctgggccccgccaaccagaccaccagcgtgaagaaggaggagacccccagcgccatcaccaccgccaacatcagacccgtgagccccggcatcagcgacgccaacgaccacgacctgagagagcccagcggcatcaagaaccccggcggcgccagcgccagcgccagagtgagcagctgggacagccagagctacgacatcgagcagatctgcctgggcgccagcaaccccccctgggccagctag

SEQ ID NO: 22193 - DNA, 573 bp, Artificial Sequence
  Description of Artificial Sequence: Synthetic coding sequence
atggccagcagaggcaagaccgagaccagcaagctgaagcagaacctggaggagcagctggacagactgatgcagcagctgcaggacctggaggagtgcagagaggagctggacaccgacgagtacgaggagaccaagaaggagaccctggagcagctgagcgagttcaacgacagcctgaagaagatcatgagcggcaacatgaccctggtggacgagctgagcggcatgcagctggccatccaggccgccatcagccaggccttcaagacccccgaggtgatcagactgttcgccaagaagcagcccggccagctgagaaccagactggccgagatggacagagacctgatggtgggcaagctggagagagacctgtacacccagcagaaggtggagatcctgaccgccctgagaaagctgggcgagaagctgaccgccgacgacgaggccttcctgagcgccaacgccggcgccatcctgagccagttcgagaaggtgagcaccgacctgggcagcggcgacaagatcctggccctggccagcttcgaggtggagaagaccaagaagtag

SEQ ID NO: 22194 - DNA, 573 bp, Artificial Sequence; identical to SEQ ID NO: 22193
  Description of Artificial Sequence: Synthetic coding sequence

SEQ ID NO: 22195 - DNA, 573 bp, Artificial Sequence; identical to SEQ ID NO: 22193
  Description of Artificial Sequence: Synthetic coding sequence

SEQ ID NO: 22196 - DNA, 636 bp, Artificial Sequence
  Description of Artificial Sequence: Synthetic coding sequence
atgaacaacttcatcttcctgaagttcatgaccctgggcaccagcagaaccggcgagatcaagatggccagcagaggcaagaccgagaccagcaagctgaagcagaacctggaggagcagctggacagactgatgcagcagctgcaggacctggaggagtgcagagaggagctggacaccgacgagtacgaggagaccaagaaggagaccctggagcagctgagcgagttcaacgacagcctgaagaagatcatgagcggcaacatgaccctggtggacgagctgagcggcatgcagctggccatccaggccgccatcagccaggccttcaagacccccgaggtgatcagactgttcgccaagaagcagcccggccagctgagaaccagactggccgagatggacagagacctgatggtgggcaagctggagagagacctgtacacccagcagaaggtggagatcctgaccgccctgagaaagctgggcgagaagctgaccgccgacgacgaggccttcctgagcgccaacgccggcgccatcctgagccagttcgagaaggtgagcaccgacctgggcagcggcgacaagatcctggccctggccagcttcgaggtggagaagaccaagaagtag

SEQ ID NO: 22197 - DNA, 720 bp, Artificial Sequence
  Description of Artificial Sequence: Synthetic coding sequence
atggtgcagccccagaccagcaaggccgagagccccgccctggccgccagccccaacgcccagatggacgacgtgatcgacaccctgaccagcctgagactgaccaacagcgccctgagaagagaggccagcaccctgagagccgagaaggccaacctgaccaacatgctggagagcgtgatggccgagctgaccctgctgagaaccagagccagaatccccggcgccctgcagatcaccccccccatcagcagcatcaccagcaacggcaccagacccatgaccaccccccccaccagcctgcccgagcccttcagcggcgaccccggcagactggccggcttcctgatgcagatggacagattcatgatcttccaggccagcagattccccggcgaggccgagagagtggccttcctggtgagcagactgaccggcgaggccgagaagtgggccatcccccacatgcagcccgacagccccctgagaaacaactaccagggcttcctggccgagctgagaagaacctacaagagccccctgagacacgccagaagagcccagatcagaaagaccagcgccagcaacagagccgtgagagagagacagatgctgtgcagacagctggccagcgccggcaccggcccctgccccgtgcaccccgccagcaacggcaccagccccgcccccgccctgcccgccagagccagaaacctgtag

SEQ ID NO: 22198 - DNA, 2079 bp, Artificial Sequence
  Description of Artificial Sequence: Synthetic coding sequence
atggaccaccacatccccatgcacgccctgcccgaggagatccagaagatgctgcccgaggagaaggtgtgcaagtactgcggcgtgagctacctgatcctgcacgagttcaaggccatggaggagaaggtgaaggccatggagaaggagatgaagttctaccagggcagcgtggacagagagaagagactgcaggagaagctgcacagcctgagccaggagctggagcagtacaagatcgacaacaagagcaagaccgagagaatctacgacgtgggcatgcagctgaagagccagcagaacgagttccagaaggtgaagaagcagctgagccacctgcaggacgagctgaagatcaagtacagacagagctacatcttcagccagagactgagcgagtacaagtacttctggaacaagaccctgagcctgctgaccttcaccaagagagagctgaccagcatcaagaacgaggtgtacgacaactaccagaactggaccagcctgaagggcgccgtgttcctgcagatcaagagcatcagcgagaccgccctgaccgagatcgacatcctgaacaagagcctgaccgtgagccagagaaacaaggtgtgcctggagaaggagatgaagaacctgaagctgctgagcgacgccgccatcctgagaagccagcagatcagaaccagcagacagcaggaggtgaacctgcagaccagatgctacgacctgcagaaggaggtgctggacctgcagtgcctggtggaggccctgggcctgaagctgcagaaggccgtgaccgagatggacaactacaaggagatgctgatgaacaagagcaacgaggccgacgactgccagagagagctgaagaagctgaagttcgagagcatcatcagcgagagccagcacaccatgctgctgaaggagaaggaggacagcctgatgacctgccagcagatctacaaggccctgcaggaggagctgaccgtgaaggagaagcaggaggaggacatcaagagaagaatcaacctggccgagaacgagctggagatcaccaagaccctgctgaaccagaccagagaggaggtgctgaccctgaagaacgagagagagctgatgctgatcagccaccagaagagcatcgagcagctgcaggagaccctgagacagaagctgctgagcgacgacaactggaaggagaagatcgaggccgagctggccaaggagagagcccagcacctggtggagttcgaggagcaggccctgctgttcaaggaggagaccaagctgcagctggacatcgagaaggagaagcaccaggacgtgatccagaagtacaagaaggagcaggaggagctgcagatgaagatcagcgacctgatcaccggcgccaccagagacctgagacaggaggtgaccaccctgaaggagaagctgcacaagagccacatcagatacaccgaggagagcaacagcaaggagaaggagatcgagaacctgaagaacctggtggccgagttcgagagcagactgaagaaggagatcgacagcaacgacagcgtgagcgagaacctgagaaaggagatggagcagaagagcgacgagctgaagagagtgatgctggcccagacccagctgatcgagcagttcaaccagagccaggaggagaacaccttcctgcaggagaccgtgagaagagagtgcgaggagagattcgagctgaccgaggccctgagccaggccagagagcagctgctggagctgagcaagctgagaggcagcctgcccttcagcccctgcagcctgagcaagggcagcctgaccagccccgccgccgccgtgagcaaccacggcgagagaagcctggccagactgaacagcgagaagggcatccagatccccaacctgagaggcgtgagcaagcccaccaccttccccaccagcgacaagcccaagagagtgagaagcggcgtgcccatcctgccccagccccacccccccagaggcggcgccagcagcgccaacgagaccagacagagactggccgccatcctgagaagaagaagaagccagcagtag

SEQ ID NO: 22199 - DNA, 1167 bp, Artificial Sequence
  Description of Artificial Sequence: Synthetic coding sequence
atgctgctgaaggagaaggaggacagcctgatgacctgccagcagatctacaaggccctgcaggaggagctgaccgtgaaggagaagcaggaggaggacatcaagagaagaatcaacctggccgagaacgagctggagatcaccaagaccctgctgaaccagaccagagaggaggtgctgaccctgaagaacgagagagagctgatgctgatcagccaccagaagagcatcgagcagctgcaggagaccctgagacagaagctgctgagcgacgacaactggaaggagaagatcgaggccgagctggccaaggagagagcccagcacctggtggagttcgaggagcaggccctgctgttcaaggaggagaccaagctgcagctggacatcgagaaggagaagcaccaggacgtgatccagaagtacaagaaggagcaggaggagctgcagatgaagatcagcgacctgatcaccggcgccaccagagacctgagacaggaggtgaccaccctgaaggagaagctgcacaagagccacatcagatacaccgaggagagcaacagcaaggagaaggagatcgagaacctgaagaacctggtggccgagttcgagagcagactgaagaaggagatcgacagcaacgacagcgtgagcgagaacctgagaaaggagatggagcagaagagcgacgagctgaagagagtgatgctggcccagacccagctgatcgagcagttcaaccagagccaggaggagaacaccttcctgcaggagaccgtgagaagagagtgcgaggagagattcgagctgaccgaggccctgagccaggccagagagcagctgctggagctgagcaagctgagaggcagcctgcccttcagcccctgcagcctgagcaagggcagcctgaccagccccgccgccgccgtgagcaaccacggcgagagaagcctggccagactgaacagcgagaagggcatccagatccccaacctgagaggcgtgagcaagcccaccaccttccccaccagcgacaagcccaagagagtgagaagcggcgtgcccatcctgccccagccccacccccccagaggcggcgccagcagcgccaacgagaccagacagagactggccgccatcctgagaagaagaagaagccagcagtag

SEQ ID NO: 22200 - DNA, 1653 bp, Artificial Sequence
  Description of Artificial Sequence: Synthetic coding sequence
atggccagcgtgttccactacttcctgctggtgctggtgttcctggacacccacgccgcccagcccttctgcctgcccggctgcacctgcagcgaggagagcttcggcagaaccctgcagtgcaccagcgtgagcctgggcaagatccccggcaacctgagcgaggagttcaagcaggtgagaatcgagaacagccccctgttcgagatgccccagggcagcttcatcaacatgagcaccctggagtacctgtggctgaacttcaacaacatcagcgtgatccacctgggcgccctggagcacctgcccgagctgagagagctgagactggagggcaacaagctgtgcagcgtgccctggaccgccttcagagccacccccctgctgagagtgctggacctgaagagaaacaagatcgacgccctgcccgagctggccctgcagttcctggtgagcctgacctacctggacctgagcagcaacagactgaccgtggtgagcaagagcgtgttcctgaactggcccgcctaccagaagtgcagacagcccgactgcggcgccgagatcctgagcagcctggtggtggccctgcacgacaacccctgggtgtgcgactgcagactgagaggcctggtgcagttcgtgaagagcatcaccctgcccgtgatcctggtgaacagctacctgatctgccagggccccctgagcaaggccggccagctgttccacgagaccgagctgagcgcctgcatgaagccccagatcagcacccccagcgccaacatcaccatcagagccggccagaacgtgaccctgagatgcctggcccaggccagccccagccccagcatcgcctggacctaccccctgagcatgtggagagagttcgacgtgctgaccagcagcaccggcgaggacaccgccctgagcgagctggccatccccgccgcccacctggtggacagcggcaactacacctgcatggccagcaacagcatcggcaagagcaacctggtgatcagcctgcacgtgcagcccgcccaggccctgcacgcccccgacagcctgagcatccccagcgagggcaacgcctacatcgacctgagagtggtgaagcagaccgtgcacggcatcctgctggagtggctggccgtggccgacaccagcaaggaggagtggttcaccctgtacatcgccagcgacgaggccttcagaaaggaggtggtgcacatcggccccggcatcaacacctacgccgtggacgacctgctgcccggcaccaagtacgaggcctgcctgagcctggagggccagcccccccaccagggccagtgcgtggccttcgtgaccggcagagacgccggcggcctggaggccagagagcacctgctgcacgtgaccgtggtgctgtgcgtggtgctgctggccgtgcccgtgggcgcctacgcctgggccgcccagggcccctgcagctgcagcaagtgggtgctgagaggctgcctgcacagaagaaaggcccccagctgcacccccgccgccccccagagcaaggacggcagcttcagagagcaccccgccgtgtgcgacgacggcgagggccacatcgacaccgagggcgacaaggagaagggcggcaccgaggacaacagctag

SEQ ID NO: 22201 - DNA, 1683 bp, Artificial Sequence
  Description of Artificial Sequence: Synthetic coding sequence
atggccagcgtgttccactacttcctgctggtgctggtgttcctggacacccacgccgcccagcccttctgcctgcccggctgcacctgcagcgaggagagcttcggcagaaccctgcagtgcaccagcgtgagcctgggcaagatccccggcaacctgagcgaggagttcaagcaggtgagaatcgagaacagccccctgttcgagatgccccagggcagcttcatcaacatgagcaccctggagtacctgtggctgaacttcaacaacatcagcgtgatccacctgggcgccctggagcacctgcccgagctgagagagctgagactggagggcaacaagctgtgcagcgtgccctggaccgccttcagagccacccccctgctgagagtgctggacctgaagagaaacaagatcgacgccctgcccgagctggccctgcagttcctggtgagcctgacctacctggacctgagcagcaacagactgaccgtggtgagcaagagcgtgttcctgaactggcccgcctaccagaagtgcagacagcccgactgcggcgccgagatcctgagcagcctggtggtggccctgcacgacaacccctgggtgtgcgactgcagactgagaggcctggtgcagttcgtgaagagcatcaccctgcccgtgatcctggtgaacagctacctgatctgccagggccccctgagcaaggccggccagctgttccacgagaccgagctgagcgcctgcatgaagccccagatcagcacccccagcgccaacatcaccatcagagccggccagaacgtgaccctgagatgcctggcccaggccagccccagccccagcatcgcctggacctaccccctgagcatgtggagagagttcgacggcctgctgggcggcaagcacctgacccccgtgctgaccagcagcaccggcgaggacaccgccctgagcgagctggccatccccgccgcccacctggtggacagcggcaactacacctgcatggccagcaacagcatcggcaagagcaacctggtgatcagcctgcacgtgcagcccgcccaggccctgcacgcccccgacagcctgagcatccccagcgagggcaacgcctacatcgacctgagagtggtgaagcagaccgtgcacggcatcctgctggagtggctggccgtggccgacaccagcaaggaggagtggttcaccctgtacatcgccagcgacgaggccttcagaaaggaggtggtgcacatcggccccggcatcaacacctacgccgtggacgacctgctgcccggcaccaagtacgaggcctgcctgagcctggagggccagcccccccaccagggccagtgcgtggccttcgtgaccggcagagacgccggcggcctggaggccagagagcacctgctgcacgtgaccgtggtgctgtgcgtggtgctgctggccgtgcccgtgggcgcctacgcctgggccgcccagggcccctgcagctgcagcaagtgggtgctgagaggctgcctgcacagaagaaaggcccccagctgcacccccgccgccccccagagcaaggacggcagcttcagagagcaccccgccgtgtgcgacgacggcgagggccacatcgacaccgagggcgacaaggagaagggcggcaccgaggacaacagctag

SEQ ID NO: 22202 - DNA, 1176 bp, Artificial Sequence
  Description of Artificial Sequence: Synthetic coding sequence
atgagaggcagctgcgagagaagcggcgaggacgaggagcagaaggaggaggccatggtggcctgcggcagactgagcggcgtgcccgaggccgagcagggccccgaggccaactgggacagcgacctggagaccgagggcaccgacggcctgggcgagctggtgagagacaccctgtacctgagaagctgcagagcccacagcgtggtgcccatcagctgcttcctgagacagggcagcgcccaggagctgaacctgagacacagaggcctgggcccccagggcgccagagccctggccagcagcctgagcagcaacccctacgtgaagagactggacctgagagacaacggcctgtgcggcgccggcgccgaggccctggccggcgccctgagcaagagcagcagcatccacgacgtggacctgagcgagaaccagctgggcgtggccggcgcccaggccctgtgcgccgccctgaccgtgaaccaggccatgagaaagatgcagctgagcggcaacggcctggaggagcaggccgcccagcacctggccgagctgctgctggcccacaccgacctgaagagcctggacctgagctacaaccagctgaacgaccaggccggcgagaccctgggccccgccctggccgagaacaccggcctgaccgagctgaacgtgagctggaaccacctgagaggccccggcgccgtggccttcgccagaggcctggaggccaacatcttcctgaaggtgctggacatcagctacaacggcttcggcgaccccggcgccagcgccgtgggcgaggccctgaaggccaacaacgtgctggaggagctgaacatgagcaacaacagaatcagcgccatgggcgccctgagcctgggcctgggcctgagagtgaaccagaccctgagaatcctggtgagcagaaaccccatgagaagcgagggctgcttcggcctgctgaagagcgtgcaggacaaccccgccagcgccctggagctgctggacttcagcgacatccaggtgaacgccgagttcgacggcctggccagcagcgtgagaggcatcctgcccgagctgtgcatcaagaccggcgcctgcagagtggagtacaagaaggagctgctgcccgtgttcagaagcgccctgcccgccagcgtgcccaagtag

SEQ ID NO: 22203 - DNA, 486 bp, Artificial Sequence
  Description of Artificial Sequence: Synthetic coding sequence
atgagaggcagctgcgagagaagcggcgaggacgaggagcagaaggaggaggccatggtggcctgcggcagactgagcggcgtgcccgaggccgagcagggccccgaggccaactgggacagcgacctggagaccgagggcaccgacggcctgggcgagctggtgagagacaccctgtacctgagaagctgcagagcccacagcgtggtgcccatcagctgcttcctgagacagggcagcgcccaggagctgaacctgagacacagaggcctgggcccccagggcgccagagccctggccagcagcctgagcagcaacccctacgtgaagagactggacctgagagacaacggcctgtgcggcgccggcgccgaggccctggccggcgccctgagcaagagcagcagcatccacggcagatgctgggtgtggggcagatgggccggcgtgagcagcttcagcagcggcatgtgcctgcacagatag

SEQ ID NO: 22204 - DNA, 2298 bp, Artificial Sequence
  Description of Artificial Sequence: Synthetic coding sequence
atggccgccagccagggcggcggcggcaacagcggcggcggcggctgcggcggcggcggcagcagcggcggctgcggcaccgccggcggcggcggcggcggcgccggcggcggcggcggcggcggcggcggcaccctggtggtgcccatccccgtgcccaccctgttcggccagcccttccccaacggccccccctggaaccccggcagcctgcagccccagcacaccgtgagaagcctggacagagccctggaggaggccggcagcagcggcatcctgagcctgagcggcagaaagctgagagacttccccggcagcggctacgacctgaccgacaccacccaggccgacctgagcagaaacagattcaccgagatccccagcgacgtgtggctgttcgcccccctggagaccctgaacctgtaccacaactgcatcaagaccatccccgaggccatcaagaacctgcagatgctgacctacctgaacatcagcagaaacctgctgagcaccctgcccaagtacctgttcgacctgcccctgaaggtgctggtggtgagcaacaacaagctggtgagcatccccgaggagatcggcaagctgaaggacctgatggagctggacatcagctgcaacgagatccaggtgctgccccagcagatgggcaagctgcacagcctgagagagctgaacatcagaagaaacaacctgcacgtgctgcccgacgagctgggcgacctgcccctggtgaagctggacttcagctgcaacaaggtgaccgagatccccgtgtgctacagaaagctgcaccacctgcaggtgatcatcctggacaacaaccccctgcaggtgccccccgcccagatctgcctgaagggcaaggtgcacatcttcaagtacctgaacatccaggcctgctgcagaatggacaagaagcccgacagcctggacctgcccagcctgagcaagagaatgcccagccagcccctgaccgacagcatggaggacttctaccccaacaagaaccacggccccgacagcggcatcggcagcgacaacggcgagaagagactgagcaccaccgagcccagcgacgacgacaccgtgagcctgcacagccaggtgagcgagagcaacagagagcagaccagcagaaacgacagccacatcatcggcagcaagaccgacagccagaaggaccaggaggtgtacgacttcgtggaccccaacaccgaggacgtggccgtgcccgagcagggcaacgcccacatcggcagcttcgtgagcttcttcaagggcaaggagaagtgcagcgagaagagcagaaagaacgaggagctgggcgacgagaagagactggagaaggagcagctgctggccgaggaggaggacgacgacctgaaggaggtgaccgacctgagaaagatcgccgcccagctgctgcagcaggagcagaagaacagaatcctgaaccacagcaccagcgtgatgagaaacaagcccaagcagaccgtggagtgcgagaagagcgtgagcgccgacgaggtgaacagccccctgagccccctgacctggcagcccctggagaaccagaaggaccagatcgacgagcagccctggcccgagagccaccccatcatctggcagagcgaggagagaagaagaagcaagcagatcagaaaggagtacttcaagtacaagagcatgagaaagagcagcagcggcaacgagaacgacgagcaggacagcgacaacgccaacatgagcacccagagccccgtgagcagcgaggagtacgacagaaccgacggcttcagccacagccccttcggcctgaagcccagaagcgccttcagcagaagcagcagacaggagtacggcgccgccgaccccggcttcaccatgagaagaaagatggagcacctgagagaggagagagagcagatcagacagctgagaaacaacctggagagcagactgaaggtgatcctgcccgacgacatcggcgccgccctgatggacggcgtggtgctgtgccacctggccaaccacatcagacccagaagcgtggccagcatccacgtgcccagccccgccgtgcccaagctgagcatggccaagtgcagaagaaacgtggagaacttcctggacgcctgcaagaagctgggcgtgagccaggagagactgtgcctgccccaccacatcctggaggagagaggcctggtgaaggtgggcgtgaccgtgcaggccctgctggagctgcccaccaccaaggccagccagctgagcgtggcctag

SEQ ID NO: 22205 - DNA, 735 bp, Artificial Sequence
  Description of Artificial Sequence: Synthetic coding sequence
ggcctgttcagcctgcccggcacctggagaagagtgagagaggaggccgtgaccgtgggcgagagccaccccatcatctggcagagcgaggagagaagaagaagcaagcagatcagaaaggagtacttcaagtacaagagcatgagaaagagcagcagcggcaacgagaacgacgagcaggacagcgacaacgccaacatgagcacccagagccccgtgagcagcgaggagtacgacagaaccgacggcttcagccacagccccttcggcctgaagcccagaagcgccttcagcagaagcagcagacaggagtacggcgccgccgaccccggcttcaccatgagaagaaagatggagcacctgagagaggagagagagcagatcagacagctgagaaacaacctggagagcagactgaaggtgatcctgcccgacgacatcggcgccgccctgatggacggcgtggtgctgtgccacctggccaaccacatcagacccagaagcgtggccagcatccacgtgcccagccccgccgtgcccaagctgagcatggccaagtgcagaagaaacgtggagaacttcctggacgcctgcaagaagctgggcgtgagccaggagagactgtgcctgccccaccacatcctggaggagagaggcctggtgaaggtgggcgtgaccgtgcaggccctgctggagctgcccaccaccaaggccagccagctgagcgtggcctag

SEQ ID NO: 22206 - DNA, 2247 bp, Artificial Sequence
  Description of Artificial Sequence: Synthetic coding sequence
atggccgccagccagggcggcggcggcaacagcggcggcggcggctgcggcggcggcggcagcagcggcggctgcggcaccgccggcggcggcggcggcggcgccggcggcggcggcggcggcggcggcggcaccctggtggtgcccatccccgtgcccaccctgttcggccagcccttccccaacggccccccctggaaccccggcagcctgcagccccagcacaccgtgagaagcctggacagagccctggaggaggccggcagcagcggcatcctgagcctgagcggcagaaagctgagagacttccccggcagcggctacgacctgaccgacaccacccaggccgacctgagcagaaacagattcaccgagatccccagcgacgtgtggctgttcgcccccctggagaccctgaacctgtaccacaactgcatcaagaccatccccgaggccatcaagaacctgcagatgctgacctacctgaacatcagcagaaacctgctgagcaccctgcccaagtacctgttcgacctgcccctgaaggtgctggtggtgagcaacaacaagctggtgagcatccccgaggagatcggcaagctgaaggacctgatggagctggacatcagctgcaacgagatccaggtgctgccccagcagatgggcaagctgcacagcctgagagagctgaacatcagaagaaacaacctgcacgtgctgcccgacgagctgggcgacctgcccctggtgaagctggacttcagctgcaacaaggtgaccgagatccccgtgtgctacagaaagctgcaccacctgcaggtgatcatcctggacaacaaccccctgcaggtgccccccgcccagatctgcctgaagggcaaggtgcacatcttcaagtacctgaacatccaggcctgctgcagaatggacaagaagcccgacagcctggacctgcccagcctgagcaagagaatgcccagccagcccctgaccgacagcatggaggacttctaccccaacaagaaccacggccccgacagcggcatcggcagcgacaacggcgagaagagactgagcaccaccgagcccagcgacgacgacaccgtgagcctgcacagccaggtgagcgagagcaacagagagcagaccagcagaaacgacagccacatcatcggcagcaagaccgacagccagaaggaccaggaggtgtacgacttcgtggaccccaacaccgaggacgtggccgtgcccgagcagggcaacgcccacatcggcagcttcgtgagcttcttcaagggcaaggagaagtgcagcgagaagagcagaaagaacgaggagctgggcgacgagaagagactggagaaggagcagctgctggccgaggaggaggacgacgacctgaaggaggtgaccgacctgagaaagatcgccgcccagctgctgcagcaggagcagaagaacagaatcctgaaccacagcaccagcgtgatgagaaacaagcccaagcagaccgtggagtgcgagaagagcgtgagcgccgacgaggtgaacagccccctgagccccctgacctggcagcccctggagaaccagaaggaccagatcgacgagcagccctggcccgagagccaccccatcatctggcagagcgaggagagaagaagaagcaagcagatcagaaaggagtacttcaagtacaagagcatgagaaagagcagcagcggcaacgagaacgacgaggagtacgacagaaccgacggcttcagccacagccccttcggcctgaagcccagaagcgccttcagcagaagcagcagacaggagtacggcgccgccgaccccggcttcaccatgagaagaaagatggagcacctgagagaggagagagagcagatcagacagctgagaaacaacctggagagcagactgaaggtgatcctgcccgacgacatcggcgccgccctgatggacggcgtggtgctgtgccacctggccaaccacatcagacccagaagcgtggccagcatccacgtgcccagccccgccgtgcccaagctgagcatggccaagtgcagaagaaacgtggagaacttcctggacgcctgcaagaagctgggcgtgagccaggagagactgtgcctgccccaccacatcctggaggagagaggcctggtgaaggtgggcgtgaccgtgcaggccctgctggagctgcccaccaccaaggccagccagctgagcgtggcctag

SEQ ID NO: 22207 - DNA, 2247 bp, Artificial Sequence; identical to SEQ ID NO: 22206
  Description of Artificial Sequence: Synthetic coding sequence

SEQ ID NO: 22208 - DNA, 351 bp, Artificial Sequence
  Description of Artificial Sequence: Synthetic coding sequence
atgacccagctgaaggagctggacatcagcaacaacgccatcagagagatccccagaaacatcggcgagctgagaaacctggtgagcctgcacgcctacaacaaccagatcagctacctgccccccagcctgctgagcctgaacgacctgcagcagctgaacctgagcggcaacaacctgaccgccctgcccagcgccatctacaacatcttcagcctgaaggagatcaacttcgacgacaaccccctgctgagaccccccgtggagatctgcaagggcaagcagctgtacaccatcgccagatacctgcagagagccgacgagagagacggcctgcagctgcacagctag

SEQ ID NO: 22209 - DNA, 2583 bp, Artificial Sequence
  Description of Artificial Sequence: Synthetic coding sequence
atgagcgagaaggagggcatgagcgaggtgctggaggacaccatcagccagttcagaaaggagagcagaagccagagcatgaaggagcccggcttcatcaaggagaccagcaacctgatcaacgaggccagcgactacctggagggcaagagcagcaaccagatctacgagacccaccccagacagaacaccctggagagcaccagcagcagcggcagaaagagcaagagaaacgaggagcagaagaagaacctgcagttcagcgagaccagcaccagaaccggcaccagccagagcctgagcagcctgaccggcagaaccgccgagtaccaggccctggtgaacttcctgagccacgagaccgtgggcgaggtgagcccccaggtgagcgaggagaaccagaagcagctgggcctgggcgccgacaacttcaccgtgaacctggaggccaagggcctgcaggagttccccaaggacatcctgaagatcaagtacgtgaagtacctgtacctggacaagaaccagatcaagaccttccagggcgccgacagcggcgacctgctgggcctggagatcctgagcctgcaggagaacggcctgagcagcctgcccagcgagatccagctgctgcacaacctgagaatcctgaacgtgagccacaaccacatcagccacatccccaaggagatcagccagctgggcaacatcagacagctgttcttctacaacaactacatcgagaacttccccagcgacctggagtgcctgggcaacctggagatcctgagcctgggcaagaacaagctgagacacatccccgacaccctgcccagcctgaagaccctgagagtgctgaacctggagtacaaccagctgaccaccttccccaaggccctgtgcttcctgcccaagctgatcagcctggacctgaccggcaacctgatcagcagcctgcccaaggagatcagagagctgaagaacctggagaccctgctgatggaccacaacaagctgaccttcctggccgtggagatcttccagctgctgaagatcaaggagctgcagctggccgacaacaagctggaggtgatcagccacaagatcgagaacttcagagagctgagaatcctgatcctggacaagaacctgctgaagaacatccccgagaagatcagctgctgcgccatgctggagtgcctgagcctgagcgacaacaagctgaccgagctgcccaagtacatccacaagctgaacaacctgagaaagctgcacgtgaacagaaacaacatggtgaagatcaccgactgcatcagccacctgaacaacatctgcagcctggagttcagcggcaacatcatcaccgacgtgcccatcgagatcaagaactgccagaagatcatcaagatcgagctgagctacaacaagatcatgtacttccccctgggcctgtgcgccctggacagcctgtactacctgagcgtgaacggcaactacatcagcgagatccccgtggacatcagcttcagcaagcagctgctgcacctggagctgagcgagaacaagctgctgatcttcagcgagcacttctgcagcctgatcaacctgaagtacctggacctgggcaagaaccagatcaagaagatccccgccagcatcagcaacatgatcagcctgcacgtgctgatcctgtgctgcaacaagttcgagaccttccccagagagctgtgcaccctggagaacctgcaggtgctggacctgagcgagaaccagctgcagaagatcagcagcgacatctgcaacctgaagggcatccagaagctgaacttcagcagcaaccagttcatccacttccccatcgagctgtgccagctgcagagcctggagcagctgaacatcagccagatcaagggcagaaagctgaccagactgcccggcgagctgagcaacatgacccagctgaaggagctggacatcagcaacaacgccatcagagagatccccagaaacatcggcgagctgagaaacctggtgagcctgcacgcctacaacaaccagatcagctacctgccccccagcctgctgagcctgaacgacctgcagcagctgaacctgagcggcaacaacctgaccgccctgcccagcgccatctacaacatcttcagcctgaaggagatcaacttcgacgacaaccccctgctgagaccccccgtggagatctgcaagggcaagcagctgtacaccatcgccagatacctgcagagagccgacgagagagacgagaagatcctggagaagatcttcaagatcgtggccaacaacatcaccgagaccaacttcgagttcctgtgccagaagctgaacctggccaacagcgagaccgacatgcccaccaagagcaccgtgagcctgagcgagagagcccaccaggccctggtgatctggaagacccagagcaacaagctgagcctgaccgccgccgccctgagagaccagctgatcagagccctgaccatgatcggcgcctacgagatcatggacaagatcaccgccctgaacctgttcaccagagccatcaagttctag

SEQ ID NO: 22210 - DNA, 180 bp, Artificial Sequence
  Description of Artificial Sequence: Synthetic coding sequence
atgagcgagaaggagggcatgagcgaggtgctggaggacaccatcagccagttcagaaaggagagcagaagccagagcatgaaggagcccggcttcatcaaggagaccagcaacctgatcaacgaggccagcgactacctggagggcaagagcagcaaccagatctacgagacccactag

SEQ ID NO: 22211 - DNA, 354 bp, Artificial Sequence
  Description of Artificial Sequence: Synthetic coding sequence
atgacccagctgaaggagctggacatcagcaacaacgccatcagagagatccccagaaacatcggcgagctgagaaacctggtgagcctgcacgcctacaacaaccagatcagctacctgccccccagcctgctgagcctgaacgacctgcagcagctgaacctgagcggcaacaacctgaccgccctgcccagcgccatctacaacatcttcagcctgaaggagatcaacttcgacgacaaccccctgctgagaccccccgtggagatctgcaagggcaagcagctgtacaccatcgccagatacctgcagagagccgacgagagagacggcagactgaagatccacacctag

SEQ ID NO: 22212 - DNA, 2583 bp, Artificial Sequence; identical to SEQ ID NO: 22209
  Description of Artificial Sequence: Synthetic coding sequence

SEQ ID NO: 22213 - DNA, 2478 bp, Artificial Sequence
  Description of Artificial Sequence: Synthetic coding sequence
atggccaccagcgagagagccctgctgagaaccagagccgccagcctgctgagaggcctgggcagaagcagaaccggcgccagaagcctgcagttcagagccgagaaggagagacagccctgctggagcttccccatgggccagaagaccaagggcagcagcaacatcgccagcagctacctgctgcagcagctgatgcacagataccaggagctggacagcgacggcgacgaggaccagggcgagggcgaggccggcagcgaggagagcagcgagagcgagatgctgaacctggaggaggagttcgacggcgtgctgagagaggaggccgtggccaaggccctgcaccacctgggcagaagcggcagcggcaccgagcaggtgtacctgaacctgaccctgagcggctgcaacctgatcgacgtgagcatcctgtgcggctacgtgcacctgcagaagctggacctgagcgccaacaagatcgaggacctgagctgcgtgagctgcatgccctacctgctggagctgaacgccagccagaacaacctgaccaccttcttcaacttcaagccccccaagaacctgaagaaggccgacttcagccacaaccagatcagcgagatctgcgacctgagcgcctaccacgccctgaccaagctgatcctggacggcaacgagatcgaggagatcagcggcctggagatgtgcaacaacctgatccacctgagcctggccaacaacaagatcaccaccatcaacggcctgaacaagctgcccatcaagatcctgtgcctgagcaacaaccagatcgagatgatcaccggcctggaggacctgaaggccctgcagaacctggacctgagccacaaccagatcagcagcctgcagggcctggagaaccacgacctgctggaggtgatcaacctggaggacaacaagatcgccgagctgagagagatcgagtacatcaagaacctgcccatcctgagagtgctgaacctgctggagaaccccatccaggagaagagcgagtactggttcttcgtgatcttcatgctgctgagactgaccgagctggaccagaagaagatcaaggtggaggagaaggtgagcgccgtgaacaagtacgaccccccccccgaggtggtggccgcccaggaccacctgacccacgtggtgaacagcgtgatgcagccccagagaatcttcgacagcaccctgcccagcctggacgccccctaccccatgctgatcctggccggccccgaggcctgcggcaagagagagctggcccacagactgtgcagacagttcagcacctacttcagatacggcgcctgccacaccaccagacccccctacttcggcgagggcgacagagtggactaccacttcatcagccaggacgtgttcgacgagatggtgaacatgggcaagttcatcctgaccttcagctacggcaaccacaagtacggcctgaacagagacaccgtggagggcatcgccagagacggcctggccagctgcatccacatggagatcgagggcgtgagaagcctgaagtacagctacttcgagcccagatacatcctggtggtgcccatgaacaaggagaagtacgagggctacctgagaagaaagggcctgttcagcagagccgagatcgagttcgccgtgagcagagtggacctgtacatcaagatcaaccagaacttccccggctacttcgacgaggtgatcaacgccgacgacctggacgtggcctaccagaagctgagccagctgatcagagagtacctgggcctgaccgaggagcccgccaagagcctggccaccaccgccgacgtgaagaccagccacctgaagcccgaggcccaccccaccaagtacatcagcagcaacatgggcgacttcctgcacagcaccgacagaaactacctgatcaagttctgggccaagctgagcgccaagaagacccccgccgagagagacagcatccacagacagcacgaggccgccagacaggccctgatgggcagaatcagacccgaccacaccctgctgttccagagaggccccgtgcccgcccccctgaccagcggcctgcactactacaccaccctggaggagctgtggaagagcttcgacctgtgcgaggactacttcaagccccccttcggcccctaccccgagaagagcggcaaggacagcctggtgagcatgaagtgcagcctgttcagattctgcccctggagcaaggagctgcccttccagccccccgagggcagcatcagcagccacctgggcagcggcgccagcgacagcgagaccgaggagaccagaaaggccctgcccatccagagcttcagccacgagaaggagagccaccagcacagacagcacagcgtgcccgtgatcagcagacccggcagcaacgtgaagcccaccctgccccccatcccccagggcagaagatag

SEQ ID NO: 22214 - DNA, 3933 bp, Artificial Sequence
  Description of Artificial Sequence: Synthetic coding sequence
atggacgacgacgacgccaagctgaaggccgagatcgaggccgagctggacaagctgagcatcagcagcctggagaaggaggacatcgagagcgacgccaagagcgagacccagagcgacgacagcgacaccgacagcgtggagctgcccgagagcgtgctgcactgcatcaacatcatcaagaacagaagcaaggccgtggaggagctgatcctgcaggacctggaggacaccgacatcctgagctgcagctacggcgccgtgagcaacaaccacatgcacctgagaaccggcctgagcaccgagtacgaggagagcagcgagcagctgatcaagatcctgagcgagatcgagaaggaggagttcatgagaagcaagaccgactgcgccacccccgacttcgtgcccgagcccagcccccacgacctgcccatggacgagcacgtgctgcccgacgacgccgacatcaacttcggctactgcgaggtggaggagaagtgcagacagagcttcgaggcctggcaggagaagcagaaggagctggaggacaaggagaagcagaccctgaaggcccagagagacagagaggagaagcagttccaggaggaggaggagaagagacactgctggatgaagcagttcaaggtggagaagaagaagctggagaacatccagaaggagtacatcagaaacctgcacctgcagatggaggaggagagaaccagattcaaggaccagcaggagaaggagaagaacagcctgctgaagcagcagaacaacgccgccgtgaagatccaggccaagtacaaggccttcgtggcctaccagaagtacggccccatcatcaaggagcagatcgagagcaagaagagaaaggcccaggagtggaaggagaaggaggccaagatcagacagaaggaggaggagaacagaaagagactggaggaggagcagagaatcaaggaggagagaaagaagcagaaggaggaggagagaaagagaagagagaaggagtacgaggagaagaagaacatcgtgaagcaggagagagagcagctgatcagcaaggagaagatcatcctgagagaggacgccagccagcagctgatcatcagcagcgccctgaagaagagcggctacaacaacaagcacctgagcctggaggacatcagcaacgacaagggcgacatcgccaagaacctggtggacgagaacagcaagaagcaggaggacgtgctgctgtggctggtggaggagagcaacatgaaggagaacgtggacagacagaccatcctgaaggagagcatccaggtgaagctgaaggagagcatcagcagccagaccatcctggccgacttcaagatggaggagaagaacgagaacctggccaagaagagatgcagcgaggagctggtgaagcaggagagaaagtacgagaacaccgacaacaagaccgagctgggcaacagcgacctgaagggcaacctgaaggagcagttccccctgcaggagctgaagagcgacgcccagaaggaggagaagatcatgaagcacgtgatcaacgagaacaccggccagaagacccagatcatcctgggccacaaccaggagatcagcgaggtgaagaccaacgaggagcagaagatcatcaaggacaaccagcagaagaagatccagaaggtggagaaggaggagatccaggagcagaacggcctgctgtacaaggacaaggacaccctggtgatcagcgtgaagcagagaagcctgagcctgaccagcgagaacagcaaggacgtgagagagaacgtgatcctgcaggagaaggagatctacagcaagagcaaggagatcgaggagaaccccaaggacaacgcctggaacagcggcatcgtgatcttcaacaccaccgacaccatgatcaacatcgagggcaagagaaacgaccaggactacgtgctgggcagacacgccccctgcgagggcctgagcaactacaacgccgagagcagcatggtgagcaaggaggtgaacagcctgaagagcgagatcagaaacatcagcgagaagtgccacgagaacgcccccgagcccgacagcatgacctgctgcgtgagcgagagcaccctgctgtacagcatcgaggagagaagactggcctggatcaagagcttcaagccctggctggagatcttcaagcagaaccagcagaagaagatcgtgagaagaaagagacccgtgaagtgccccgccaacatgacccccgccctggacaagctggagatcctgagatgcggcccctgggacaccctgcagcaggtgaccaccgtgaccttccaggacctgcccggctgcgtgctgagcaccctggccgagtgcaccaacctgcagttcctgagcctgagaagatgcggcctgaccagcctgcacagcctgagcaactgcaagaagctgaagtacatcgacgcccaggagaaccacatcgaggccatcgagtgcgagaacctggagaacctgtgcgtggtgctgctgaacaagaaccagctgaccagcctgcacggcctggacggctgcaccaacatccagtgcctggagctgagctacaacaagatcaccagaatcggctacagcttcttcctggaggagaagctggtggacaacgccggcttctgccaccacctgggcaccagcaccagctacctgagcctggcccaggtgtggatccccaccggcctgtgctggagctggatccccatcaccagcctgaccaagaacagcgactgcaacttcctgatcagccacctgtactggaactgcggcctggagagcctgaagaacctgcagcagctgatcctggaccacaaccagctgatcaacaccaagggcctgtgcgacacccccaccatcgtgtacctggactgcagccacaaccacctgaccgacgtggagggcgtggagaactgcggcctgctgcagatcctgaagctgcagggcaactacctgagcgagctgcccagcctggagaacctggtgctgctgagagagctgcacctggacgacaacagcatcagcaccgtggaggccttcagcagctactggctgcccctgctgcagaacatcaccatcagccagaacagcctgaccaagatcgtgcccctgttccacttcgtgagcctggagaagctggacgtgagccacaactgcctgagcgacctgaagagcgccatcaagtggttcgacgcctgctacagcctgcacgagctgagcctgaccggcaaccccctgctgcaggagaccaactggagagacagcctgctgaaggtgctgcccgccctgagaatcctgaacggcaacatcctgaacagcaacagcgagagcagaaccgaggagcacaaccagctgggcagcgccggcttcctggccctgtgccagagccagatcagagagttcaacctgctgatcgagaactacatcaccggcaagggcgacgtgttcaccctggacaccgccgagaacctgtgccactacttcaagaagctgatgatcctgagcaccgagtacagacacgcccacgagagaggcgacgtgaccatcaccaagaaggacgagagcgaggcccagaagaaccacctggcccccaccaacagcgacagcaccctgcagaacggcgtgttctacagctgcgccagagagggcgagcccgacagccccgacatccccgagaagtggatggacagcgtgagcagccacagccccctgagcaagagcgccacctgcgagaacatggagggcagacaccaggagatcctggtgtgccagaagagagaggacagcaaggccagcagcatccccaccatcagaatccccttcaaggaggtggtgatgaccaacagcctgctgagaaaccaccagaacatcgagcccagcgagaagtag

SEQ ID NO: 22215 - DNA, 495 bp, Artificial Sequence
  Description of Artificial Sequence: Synthetic coding sequence
atggacgacgacgacgccaagctgaaggccgagatcgaggccgagctggacaagctgagcatcagcagcctggagaaggaggacatcgagagcgacgccaagagcgagacccagagcgacgacagcgacaccgacagcgtggagctgcccgagagcgtgctgcactgcatcaacatcatcaagaacagaagcaaggccgtggaggagctgatcctgcaggacctggaggacaccgacatcctgagctgcagctacggcgccgtgagcaacaaccacatgcacctgagaaccggcctgagcaccgagtacgaggagagcagcgagcagctgatcaagatcctgagcgagatcgagaaggaggagttcatgagaagcaagaccgactgcgccacccccgacttcgtgcccgagcccagcccccacgacctgcccatggacgagcacgtgctgcccgacgacgccgacatcaacttcggctactgcgaggtggagtag

SEQ ID NO: 22216 - DNA, 5169 bp, Artificial Sequence
  Description of Artificial Sequence: Synthetic coding sequence
atggacgacgacgacgccaagctgaaggccgagatcgaggccgagctggacaagctgagcatcagcagcctggagaaggaggacatcgagagcgacgccaagagcgagacccagagcgacgacagcgacaccgacagcgtggagctgcccgagagcgtgctgcactgcatcaacatcatcaagaacagaagcaaggccgtggaggagctgatcctgcaggacctggaggacaccgacatcctgagctgcagctacggcgccgtgagcaacaaccacatgcacctgagaaccggcctgagcaccgagtacgaggagagcagcgagcagctgatcaagatcctgagcgagatcgagaaggaggagttcatgagaagcaagaccgactgcgccacccccgacttcgtgcccgagcccagcccccacgacctgcccatggacgagcacgtgctgcccgacgacgccgacatcaacttcggctactgcgaggtggaggagaagtgcagacagagcttcgaggcctggcaggagaagcagaaggagctggaggacaaggagaagcagaccctgaaggcccagagagacagagaggagaagcagttccaggaggaggaggagaagagacactgctggatgaagcagttcaaggtggagaagaagaagctggagaacatccagaagcaggagcaggacaagatgaacgacgagctgtacaaggaggagaagatctggaaggagaagttcaagcagcacgaggagtacatcagaaacctgcacctgcagatggaggaggagagaaccagattcaaggaccagcaggagaaggagaagaacagcctgctgaagcagcagaacaacgccgccgtgaagatccaggccaagtacaaggccttcgtggcctaccagaagtacggccccatcatcaaggagcagatcgagagcaagaagagaaaggcccaggagtggaaggagaaggaggccaagatcagacagaaggaggaggagaacagaaagagactggaggaggagcagagaatcaaggaggagagaaagaagcagaaggaggaggagagaaagagaagagagaaggagtacgaggagaagaagaacatcgtgaagcaggagagagagcagctgatcagcaaggagaagatcatcctgagagaggacgccagccagcagctgatcatcagcagcgccctgaagaagagcggctacaacaacaagcacctgagcctggaggacatcagcaacgacaagggcgacatcgccaagaacctggtggacgagaacagcaagaagcaggaggacgtgctgctgtggctggtggaggagagcaacatgaaggagaacgtggacagacagaccatcctgaaggagagcatccaggtgaagctgaaggagagcatcagcagccagaccatcctggccgacttcaagatggaggagaagaacgagaacctggccaagaagagatgcagcgaggagctggtgaagcaggagagaaagtacgagaacaccgacaacaagaccgagctgggcaacagcgacctgaagggcaacctgaaggagcagttccccctgcaggagctgaagagcgacgcccagaaggaggagaagatcatgaagcacgtgatcaacgagaacaccggccagaagacccagatcatcctgggccacaaccaggagatcagcgaggtgaagaccaacgaggagcagaagatcatcaaggacaaccagcagaagaagatccagaaggtggagaaggaggagatccaggagcagaacggcctgctgtacaaggacaaggacaccctggtgatcagcgtgaagcagagaagcctgagcctgaccagcgagaacagcaaggacgtgagagagaacgtgatcctgcaggagaaggagatctacagcaagagcaaggagatcgaggagaaccccaaggacaacgcctggaacagcggcatcgtgatcttcaacaccaccgacaccatgatcaacatcgagggcaagagaaacgaccaggactacgtgctgggcagacacgccccctgcgagggcctgagcaactacaacgccgagagcagcatggtgagcaaggaggtgaacagcctgaagagcgagatcagaaacatcagcgagaagtgccacgagaacgcccccgagcccgacagcatgacctgctgcgtgagcgagagcaccctgctgtacagcatcgaggagagaagactggcctggatcaagagcttcaagccctggctggagatcttcaagcagaaccagcagaagaagatcgtgagaagaaagagacccgtgaagtgccccgccaacatgacccccgccctggacaagctggagatcctgagatgcggcccctgggacaccctgcagcaggtgaccaccgtgaccttccaggacctgcccggctgcgtgctgagcaccctggccgagtgcaccaacctgcagttcctgagcctgagaagatgcggcctgaccagcctgcacagcctgagcaactgcaagaagctgaagtacatcgacgcccaggagaaccacatcgaggccatcgagtgcgagaacctggagaacctgtgcgtggtgctgctgaacaagaaccagctgaccagcctgcacggcctggacggctgcaccaacatccagtgcctggagctgagctacaacaagatcaccagaatcggctacagcttcttcctggaggagaagctggtggacaacgccggcttctgccaccacctgggcaccagcaccagctacctgagcctggcccaggtgtggatccccaccggcctgtgctggagctggatccccatcaccagcctgaccaagaacagcgactgcaacttcctgatcagccacctgtactggaactgcggcctggagagcctgaagaacctgcagcagctgatcctggaccacaaccagctgatcaacaccaagggcctgtgcgacacccccaccatcgtgtacctggactgcagccacaaccacctgaccgacgtggagggcgtggagaactgcggcctgctgcagatcctgaagctgcagggcaactacctgagcgagctgcccagcctggagaacctggtgctgctgagagagctgcacctggacgacaacagcatcagcaccgtggaggccttcagcagctactggctgcccctgctgcagaacatcaccatcagccagaacagcctgaccaagatcgtgcccctgttccacttcgtgagcctggagaagctggacgtgagccacaactgcctgagcgacctgaagagcgccatcaagtggttcgacgcctgctacagcctgcacgagctgagcctgaccggcaaccccctgctgcaggagaccaactggagagacagcctgctgaaggtgctgcccgccctgagaatcctgaacggcaacatcctgaacagcaacagcgagagcagaaccgaggagcacaaccagctgggcagcgccggcttcctggccctgtgccagagccagatcagagagttcaacctgctgatcgagaactacatcaccggcaagggcgacgtgttcaccctggacaccgccgagaacctgtgccactacttcaagaagctgatgatcctgagcaccgagtacagacacgcccacgagagaggcgacgtgaccatcaccaagaaggacgagagcgaggcccagaagaaccacctggcccccaccaacagcgacagcaccctgcagaacggcgtgttctacagctgcgccagagagggcgagcccgacagccccgacatccccgagaagtggatggacagcgtgagcagccacagccccctgagcaagagcgccacctgcgagaacatggagggcagacaccaggagatcctggtgtgccagaagagagaggacagcaaggccagcagcatccccaccatcagaatccccttcaaggaggtggtgatgaccaacagcctgctgagaaaccaccagaacatcgagcccagcgagaagatcatggccgccgtggtgatccagagctactggagaggctacctgatgagaagacagacccacttcagcaccagactgcacaccgccgccaccgagggcctgcccaacagcagcatcaagaaccagaccatcctgaagaagggcaagagagagaacatcgtgaacatcagaaagcagagagagaaggccgccatcctgatccaggccgtgtggaagggcttcatcctgagaaagaagctgaccaccgccctggaggccatcaagaacgaggagagcgacgaggagtacagagagatcgacctggaggacttcatcttcgacgaggccgccctggaggaggagtggctggccctggacagcaccagattccccagccagaccctgctgctgagcaaccagctgcactggcccaagatccccggcaacctgaagtgggacgacaccagcttcaacctgcccagcaaccccgcccaggcctggctgtgcaacgacaaggagaacctgagcagcagcgagcacacccagttcaacagcagaagcgagaacaagaccagcagctggacccccgagagcaagaccagcagaaagagcctgctgaagagcgagaaggagaagaagatcagcgaggagtggggcttcaaggacatcagcaccgcccagcagatgctgaagagagcccagaagatgaagagcaagaagctgaagaagaagatcgacagcaccgtgagactggccctgttcaagaacaacgagaacaaggtgagcctgcccaagagccccaagatggtgcagcccagaagagacggctacttcgagggcatcgaggaggaccccatccacaaggacaccaccgccaacgagaagctggagagaaacagagagtacacctaccagtggctgcacacccaggtgggcgtgcacgagaccaccagcagcagaaacatgaagtgcaaccacttcctgcccgagctggaccccgacgtgctgaacggcggcagagtgcagctggtggccagactggtgagcagagaggacaccgacctggacctgttcagcatgaccaacggcagcgccctgagcgtgaacagagagaagaagaaccaggcccacagacacagcgccggcagcagcagcaagctgtggttccccagcaagctgatctag

SEQ ID NO: 22217 - DNA, 1875 bp, Artificial Sequence
  Description of Artificial Sequence: Synthetic coding sequence
atgttccacggcaccgtgaccgaggagctgaccagccacgaggagtggagccactacaacgagaacatcagagagggccagaaggacttcgtgttcgtgaagttcaacggcctgcacctgaagagcatggagaacctgcagagctgcatcagcctgagagtgtgcatcttcagcaacaacttcatcaccgacatccaccccctgcagagctgcatcaagctgatcaagctggacctgcacggcaaccagatcaagagcctgcccaacaccaagttctggaacggcctgaagaacctgaagctgctgtacctgcacgacaacggcttcgccaagctgaagaacatctgcgtgctgagcgcctgccccaccctgatcgccctgaccatgttcgactgccccgtgagcctgaagaagggctacagacacgtgctggtgaacagcatctggcccctgaaggccctggaccaccacgtgatcagcgacgaggagatcatccagaactggcacctgcccgagagattcaaggcctgcaaccacagactgttcttcaacttctgccccgccctgagaaagggcaccacctacgaggaggagatcaacaacatcaagcacatcaccagcaagatcaacgccatcctggcccacaacagccccgtgctgatcgtgcagagatggatcagaggcttcctggtgagaaagaacctgagccccgtgttcttccacaagaagaagcagcaggagaagatcatcagaggctacgaggccaagtggatctacatcaccaagggctacgaggacaagctgctgaaggacctgttcttcaagcccgagaccaacatcaagggcaagctggcctactggaagcacaacatctactaccccgtggacctgaagaacagcagcgagcacagaaagcacgtgagcagcatcctgtgcgagctgaagcccaaggacctgggcatgaagagcaagaccagcagacacctgatccagaagggccaggagagcgaggacgagatcgtggacgagaagctggacaccagcttcagaatcagcgtgttcaagctgcccatctacaccagcggcagcctgaagaacaacgccgtgctgagagagaagaagcagcacttcttccccgcctacccccagcccatctacaccacccaccccaagcccatcatcaagaaggacatcagactggagagaagcatgaaggagttcttcgccccccagagagccggcatgaagctgagaaccttcagcgacatcgacaagtactacaccgagcagaagaagcaggagtaccacaaggagaaggtgagagtggtggccatggcccaggtggccagagagagagtgagagtggccgtgaacgagcacctgaaccagaagaagtacgccacccagaagctgatcgaggagaacaaggagaccatccagaacagcctgagacaggtgtggcagaacagattcaactacctggagaaggccagagagagaaaggccctgttcctgaaggagaagagccagaaggccagcgagagactgctggtgcagaacctgaacaacgagagaaccctgctgaccagaggcctgctgaagatcgacagactggagaagaacgaggccgtgctgaaggagaagagcctgatcgtgaagcagaagctgaaggccgagaagtacagaaagaacctgctgaaggagatgaagaaggtgagaagccaggagatctacaagagacactgcgaggagaagttcgtgatggacatgatcgccttcgagaaggcctgcgagagactgcaggacgccaagaccaaggtggccatcgtgaagaccaacctggacttcaaggtgcccaacggcctgatcaagtag

SEQ ID NO: 22218 - DNA, 900 bp, Artificial Sequence
  Description of Artificial Sequence: Synthetic coding sequence
atgttccacggcaccgtgaccgaggagctgaccagccacgaggagtggagccactacaacgagaacatcagagagggccagaaggacttcgtgttcgtgaagttcaacggcctgcacctgaagagcatggagaacctgcagagctgcatcagcctgagagtgtgcatcttcagcaacaacttcatcaccgacatccaccccctgcagagctgcatcaagctgatcaagctggacctgcacggcaaccagatcaagagcctgcccaacaccaagttctggaacggcctgaagaacctgaagctgctgtacctgcacgacaacggcttcgccaagctgaagaacatctgcgtgctgagcgcctgccccaccctgatcgccctgaccatgttcgactgccccgtgagcctgaagaagggctacagacacgtgctggtgaacagcatctggcccctgaaggccctggaccaccacgtgatcagcgacgaggagatcatccagaactggcacctgcccgagagattcaaggcctgcaaccacagactgttcttcaacttctgccccgccctgagaaagggcaccacctacgaggaggagatcaacaacatcaagcacatcaccagcaagatcaacgccatcctggcccacaacagccccgtgctgatcgtgcagagatggatcagaggcttcctggtgagaaagaacctgagccccgtgttcttccacaagaagaagcagcaggagaagatcatcagaggctacgaggccaagtggatctacatcaccaagggctacgaggacaagctgctgaaggacctgttcttcaagcccgagaccaacatcaagggcaagctggcctactggaagcacgacatcaagaagctgtacagcaaccaccactag

SEQ ID NO: 22219 - DNA, 1683 bp, Artificial Sequence
  Description of Artificial Sequence: Synthetic coding sequence
atgagcaaggacatcaagagcgtggagcacagccccaagatccaccagagaaacgacccccagcacgtgaacgacagaaccttcttcatcgacgccagcaaccagagcctgaccgccatccccctggagatcttcaccttcaccgagctggaggaggtgcacctggagaacaaccagatcgaggagatcccccaggagatccagagactgaagaacatcagagtgctgtacctggacaagaacaacctgagaagcctgtgccccgccctgggcctgctgagcagcctggagagcctggacctgagctacaaccccatcttcagcagcagcctggtggtggtgagcttcctgcacgccctgagagagctgagactgtaccagaccgacctgaaggagatccccgtggtgatcttcaagaacctgcaccacctggagctgctgggcctgaccggcaaccacctgaagtgcctgcccaaggagatcgtgaaccagaccaagctgagagagatctacctgaagagaaaccagttcgaggtgttcccccaggagctgtgcgtgctgtacaccctggagatcatcgacctggacgagaacaagatcggcgccatccccgaggagatcggccacctgaccggcctgcagaagttctacatggccagcaacaacctgcccgtgctgcccgccagcctgtgccagtgcagccagctgagcgtgctggacctgagccacaacctgctgcacagcatccccaagagcttcgccgagctgagaaagatgaccgagatcggcctgagcggcaacagactggagaaggtgcccagactgatctgcagatggaccagcctgcacctgctgtacctgggcaacaccggcctgcacagactgagaggcagcttcagatgcctggtgaacctgagattcctggacctgagccagaaccacctgcaccactgccccctgcagatctgcgccctgaagaacctggaggtgctgggcctggacgacaacaagatcggccagctgcccagcgagctgggcagcctgagcaagctgaagatcctgggcctgaccggcaacgagttcctgagcttccccgaggaggtgctgagcctggccagcctggagaagctgtacatcggccaggaccagggcttcaagctgacctacgtgcccgagcacatcagaaagctgcagagcctgaaggagctgtacatcgagaacaaccacctggagtacctgcccgtgagcctgggcagcatgcccaacctggaggtgctggactgcagacacaacctgctgaagcagctgcccgacgccatctgccaggcccaggccctgaaggagctgagactggaggacaacctgctgacccacctgcccgagaacctggacagcctggtgaacctgaaggtgctgaccctgatggacaaccccatggaggagccccccaaggaggtgtgcgccgagggcaacgaggccatctggaagtacctgaaggagaacagaaacagaaacatcatggccaccaagatccaggcctggtggagaggcaccatggtgcagagaggcttcggcaagttcggcgagctgctgaagccccagaagaagggcaagaccagccccaaggacaagaagggcaagaaggacgtgaagggcaagcccggcaagggcaagaagaagtag

SEQ ID NO: 22220 - DNA, 537 bp, Artificial Sequence
  Description of Artificial Sequence: Synthetic coding sequence
atggagcacaaggacgacgacgacgacgacgtgagcttcgccaagtggatgagcagcttctggggccacagctggagagaggaggaccagagaggcctgagagagagacacagactgcaggccaccagccacagaaagaccagcctgccctgccccctgcccgtgctgcccagaatccccagcagcgactgccaccccagaagacacagccacgaggaccaggagttcagatgcagaagccacgtgagagactacagaaagtacagcgaggacggcagcttcaaggagcccctggagagcaagggcagaagccacagcaagatcgagaagttcagcgagagcttcgagagacagctgtgcttcagaaccaagagaagcgccagcctgggccccgagagcagaaaggagagaaacgagagagagtgcctgagaatggagatcaagagcagaaagaaggtggaggaggagagaagcagcagaaaggaggagcacggcgaggcccacatggcccccctgttcgagaagggccccgagtag

SEQ ID NO: 22221 - DNA, 1446 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcttctacaacaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcggcggcttccaggccctgttccccgtgggccccgtgacccccagccacagatggagattcacctgctactactactacaccaacacccccagagtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacgacagattcgtgctgtacaaggagggcgagagagacttcctgcagagacccggccagcagccccaggccggcctgagccaggccaacttcaccctgggccccgtgagccccagccacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagcagaggctacttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagcttccccagcgagcccctggagctgatggtgagcggccacagcggcggcagcagcctgccccccaccggcccccccagcacccccgccagccacgccaaggactacaccgtggagaacctgatcagaatgggcatggccggcctggtgctggtgttcctgggcatcctgctgttcgaggcccagcacagccagagaaacccccaggacgccgccggcagatag

SEQ ID NO: 22222 - DNA, 1395 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcttctacaacaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcggcggcttccaggccctgttccccgtgggccccgtgacccccagccacagatggagattcacctgctactactactacaccaacacccccagagtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacgacagattcgtgctgtacaaggagggcgagagagacttcctgcagagacccggccagcagccccaggccggcctgagccaggccaacttcaccctgggccccgtgagccccagccacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagcagaggctacttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagcttccccagcgagcccctggagctgatggtgagcgccagccacgccaaggactacaccgtggagaacctgatcagaatgggcatggccggcctggtgctggtgttcctgggcatcctgctgttcgaggcccagcacagccagagaaacccccaggacgccgccggcagatag

SEQ ID NO: 22223 - DNA, 1899 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcttctacaacaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcggcggcttccaggccctgttccccgtgggccccgtgacccccagccacagatggagattcacctgctactactactacaccaacacccccagagtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacaacagattcgtgctgtacaaggagggcgagagagacttcctgcagagacccggccagcagccccaggccggcctgagccaggccaacttcaccctgggccccgtgagccccagcaacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagctggtggcagttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagccaccccagcgagcccctggagctggtggtgagcggccacagcggcggcagcagcctgccccccaccggcccccccagcacccccggcctgggcagatacctggaggtgctgatcggcgtgagcgtggccttcgtgctgctgctgttcctgctgctgttcctgctgctgagaagacagagacacagcaagcacagaaccagcgaccagagaaagaccgacttccagagacccgccggcgccgccgagaccgagcccaaggacagaggcctgctgagaagaagcagccccgccgccgacgtgcaggaggagaacctgtacgccgccgtgaaggacacccagagcgaggacagagtggagctggacagccagcagagcccccacgacgaggacccccaggccgtgacctacgcccccgtgaagcacagcagccccagaagagagatggccagcccccccagcagcctgagcggcgagttcctggacaccaaggacagacaggtggaggaggacagacagatggacaccgaggccgccgccagcgaggccagccaggacgtgacctacgcccagctgcacagcctgaccctgagaagaaaggccaccgagcccccccccagccaggagggcgagccccccgccgagcccagcatctacgccaccctggccatccactag

SEQ ID NO: 22224 - DNA, 582 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcttctacaacaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcggcggcttccaggccctgttccccgtgggccccgtgacccccagccacagaagagtgtag

SEQ ID NO: 22225 - DNA, 1899 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcttctacaacaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcggcggcttccaggccctgttccccgtgggccccgtgacccccagccacagatggagattcacctgctactactactacaccaacacccccagagtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacgacagattcgtgctgtacaaggagggcgagagagacttcctgcagagacccggccagcagccccaggccggcctgagccaggccaacttcaccctgggccccgtgagccccagccacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagcagaggctacttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagcttccccagcgagcccctggagctgatggtgagcggccacagcggcggcagcagcctgccccccaccggcccccccagcacccccggcctgggcagatacctggaggtgctgatcggcgtgagcgtggccttcgtgctgctgctgttcctgctgctgttcctgctgctgagaagacagagacacagcaagcacagaaccagcgaccagagaaagaccgacttccagagacccgccggcgccgccgagaccgagcccaaggacagaggcctgctgagaagaagcagccccgccgccgacgtgcaggaggagaacctgtacgccgccgtgaaggacacccagagcgaggacagagtggagctggacagccagcagagcccccacgacgaggacccccaggccgtgacctacgcccccgtgaagcacagcagccccagaagagagatggccagcccccccagcagcctgagcggcgagttcctggacaccaaggacagacaggtggaggaggacagacagatggacaccgaggccgccgccagcgaggccagccaggacgtgacctacgcccagctgcacagcctgaccctgagaagaaaggccaccgagcccccccccagccaggagggcgagccccccgccgagcccagcatctacgccaccctggccatccactag

SEQ ID NO: 22226 - DNA, 1368 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcttctacaacaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcggcggcttccaggccctgttccccgtgggccccgtgacccccagccacagatggagattcacctgctactactactacaccaacacccccagagtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacgacagattcgtgctgtacaaggagggcgagagagacttcctgcagagacccggccagcagccccaggccggcctgagccaggccaacttcaccctgggccccgtgagccccagccacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagcagaggctacttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagcttccccagcgagcccctggagctgatggtgagcggcgagggcgccgaccccgtgctgagcgagctgaagggcagcgcccaggcccaggcccccagaagagccctgggctgggacggccccagagaggccgtgagagaggcctag

SEQ ID NO: 22227 - DNA, 1896 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcttctacaacaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcggcggcttccaggccctgttccccgtgggccccgtgacccccagccacagatggagattcacctgctactactactacaccaacacccccagagtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacgacagattcgtgctgtacaaggagggcgagagagacttcctgcagagacccggccagcagccccaggccggcctgagccaggccaacttcaccctgggccccgtgagccccagccacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagctggtggcagttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagccaccccagcgagcccctggagctggtggtgagcggccacagcggcggcagcagcctgccccccaccggcccccccagcacccccggcctgggcagatacctggaggtgctgatcggcgtgagcgtggccttcgtgctgctgctgttcctgctgctgttcctgctgctgagaagacagagacacagcaagcacagaaccagcgaccagagaaagaccgacttccagagacccgccggcgccgccgagaccgagcccaaggacagaggcctgctgagaagaagcagccccgccgccgacgtgcaggaggagaacctgtacgccgccgtgaaggacacccagagcgaggacagagtggagctggacagccagagcccccacgacgaggacccccaggccgtgacctacgcccccgtgaagcacagcagccccagaagagagatggccagcccccccagcagcctgagcggcgagttcctggacaccaaggacagacaggtggaggaggacagacagatggacaccgaggccgccgccagcgaggccagccaggacgtgacctacgcccagctgcacagcctgaccctgagaagaaaggccaccgagcccccccccagccaggagggcgagccccccgccgagcccagcatctacgccaccctggccatccactag

SEQ ID NO: 22228 - DNA, 1083 bp, Artificial Sequence
  Description of Artificial Sequence: Synthetic coding sequence
atgatccccctgctgctggccgccctgctgtgcgtgcccgccggcgccctgacctgctacggcgacagcggccagcccgtggactggttcgtggtgtacaagctgcccgccctgagaggcagcggcgaggccgcccagagaggcctgcagtacaagtacctggacgagagcagcggcggctggagagacggcagagccctgatcaacagccccgagggcgccgtgggcagaagcctgcagcccctgtacagaagcaacaccagccagctggccttcctgctgtacaacgaccagcccccccagcccagcaaggcccaggacagcagcatgagaggccacaccaagggcgtgctgctgctggaccacgacggcggcttctggctggtgcacagcgtgcccaacttccccccccccgccagcagcgccgcctacagctggccccacagcgcctgcacctacggccagaccctgctgtgcgtgagcttccccttcgcccagttcagcaagatgggcaagcagctgacctacacctacccctgggtgtacaactaccagctggagggcatcttcgcccaggagttccccgacctggagaacgtggtgaagggccaccacgtgagccaggagccctggaacagcagcatcaccctgaccagccaggccggcgccgtgttccagagcttcgccaagttcagcaagttcggcgacgacctgtacagcggctggctggccgccgccctgggcaccaacctgcaggtgcagttctggcacaagaccgtgggcatcctgcccagcaactgcagcgacatctggcaggtgctgaacgtgaaccagatcgccttccccggccccgccggccccagcttcaacagcaccgaggaccacagcaagtggtgcgtgagccccaagggcccctggacctgcgtgggcgacatgaacagaaaccagggcgaggagcagagaggcggcggcaccctgtgcgcccagctgcccgccctgtggaaggccttccagcccctggtgaagaactaccagccctgcaacggcatggccagaaagcccagcagagcctacaagatctag

SEQ ID NO: 22229 - DNA, 2346 bp, Artificial Sequence
  Description of Artificial Sequence: Synthetic coding sequence
atggccgccaacgtgggcgaccagagaagcaccgactggagcagccagtacagcatggtggccggcgccggcagagagaacggcatggagacccccatgcacgagaaccccgagtgggagaaggccagacaggccctggccagcatcagcaagagcggcgccgccggcggcagcgccaagagcagcagcaacggccccgtggccagcgcccagtacgtgagccaggccgaggccagcgccctgcagcagcagcagtactaccagtggtaccagcagtacaactacgcctacccctacagctactactaccccatgccccccgtgcccggcatggacgagagcatgagctaccaggcccccccccagcagctgcccagcgcccagcccccccagcccagcaaccccccccacggcgcccacaccctgaacagcggcccccagcccggcaccgcccccgccacccagcacagccaggccggccccgccaccggccaggcctacggcccccacacctacaccgagcccgccaagcccaagaagggccagcagctgtggaacagaatgaagcccgcccccggcaccggcggcctgaagttcaacatccagaagagacccttcgccgtgaccacccagagcttcggcagcaacgccgagggccagcacagcggcttcggcccccagcccaaccccgagaaggtgcagaaccacagcggcagcagcgccagaggcaacctgagcggcaagcccgacgactggccccaggacatgaaggagtacgtggagagatgcttcaccgcctgcgagagcgaggaggacaaggacagaaccgagaagctgctgaaggaggtgctgcaggccagactgcaggacggcagcgcctacaccatcgactggagcagagagcccctgcccggcctgaccagagagcccgtggccgagagccccaagaagaagagatgggaggccgccagcagcctgcacccccccagaggcgccggcagcgccaccagaggcggcggcgcccccagccagagaggcacccccggcgccggcggcgccggcagagccagaggcaacagcttcaccaagttcggcaacagaaacgtgttcatgaaggacaacagcagcagcagcagcaccgacagcagaagcagaagcagcagcagaagccccaccagacacttcagaagaagcgacagccacagcgacagcgacagcagctacagcggcaacgagtgccaccccgtgggcagaagaaaccccccccccaagggcagaggcggcagaggcgcccacatggacagaggcagaggcagagcccagagaggcaagagacacgacctggcccccaccaagagaagcagaaagaagatggccgccctggagtgcgaggaccccgagagagagctgaagaagcagaagagagccgccagattccagcacggccacagcagaagactgagactggagcccctggtgctgcagatgagcagcctggagagcagcggcgccgaccccgactggcaggagctgcagatcgtgggcacctgccccgacatcaccaagcactacctgagactgacctgcgcccccgaccccagcaccgtgagacccgtggccgtgctgaagaagagcctgtgcatggtgaagtgccactggaaggagaagcaggactacgccttcgcctgcgagcagatgaagagcatcagacaggacctgaccgtgcagggcatcagaaccgagttcaccgtggaggtgtacgagacccacgccagaatcgccctggagaagggcgaccacgaggagttcaaccagtgccagacccagctgaagagcctgtacgccgagaacctgcccggcaacgtgggcgagttcaccgcctacagaatcctgtactacatcttcaccaagaacagcggcgacatcaccaccgagctggcctacctgaccagagagctgaaggccgacccctgcgtggcccacgccctggccctgagaaccgcctgggccctgggcaactaccacagattcttcagactgtactgccacgccccctgcatgagcggctacctggtggacaagttcgccgacagagagagaaaggtggccctgaaggccatgatcaagacctacgtggtgcccagcagcctgctgcccctgctgttccccagcttcagactggtgagcagctgcatcaagctgagcccctgccccctgctgcccctgccccccgtgttcctgctgatcttcttcagccccttcccccccagcctgagcgccttcttcccctggttcagcaccggcaagaccgtgccccccagcctgccccccagcagcgccatgtag

SEQ ID NO: 22230 - DNA, 2403 bp, Artificial Sequence
  Description of Artificial Sequence: Synthetic coding sequence
atggccgccaacgtgggcgaccagagaagcaccgactggagcagccagtacagcatggtggccggcgccggcagagagaacggcatggagacccccatgcacgagaaccccgagtgggagaaggccagacaggccctggccagcatcagcaagagcggcgccgccggcggcagcgccaagagcagcagcaacggccccgtggccagcgcccagtacgtgagccaggccgaggccagcgccctgcagcagcagcagtactaccagtggtaccagcagtacaactacgcctacccctacagctactactaccccatgagcatgtaccagagctacggcagccccagccagtacggcatggccggcagctacggcagcgccaccccccagcagcccagcgccccccagcaccagggcaccctgaaccagccccccgtgcccggcatggacgagagcatgagctaccaggcccccccccagcagctgcccagcgcccagcccccccagcccagcaaccccccccacggcgcccacaccctgaacagcggcccccagcccggcaccgcccccgccacccagcacagccaggccggccccgccaccggccaggcctacggcccccacacctacaccgagcccgccaagcccaagaagggccagcagctgtggaacagaatgaagcccgcccccggcaccggcggcctgaagttcaacatccagaagagacccttcgccgtgaccacccagagcttcggcagcaacgccgagggccagcacagcggcttcggcccccagcccaaccccgagaaggtgcagaaccacagcggcagcagcgccagaggcaacctgagcggcaagcccgacgactggccccaggacatgaaggagtacgtggagagatgcttcaccgcctgcgagagcgaggaggacaaggacagaaccgagaagctgctgaaggaggtgctgcaggccagactgcaggacggcagcgcctacaccatcgactggagcagagagcccctgcccggcctgaccagagagcccgtggccgagagccccaagaagaagagatgggaggccgccagcagcctgcacccccccagaggcgccggcagcgccaccagaggcggcggcgcccccagccagagaggcacccccggcgccggcggcgccggcagagccagaggcaacagcttcaccaagttcggcaacagaaacgtgttcatgaaggacaacagcagcagcagcagcaccgacagcagaagcagaagcagcagcagaagccccaccagacacttcagaagaagcgacagccacagcgacagcgacagcagctacagcggcaacgagtgccaccccgtgggcagaagaaaccccccccccaagggcagaggcggcagaggcgcccacatggacagaggcagaggcagagcccagagaggcaagagacacgacctggcccccaccaagagaagcagaaagaagatggccgccctggagtgcgaggaccccgagagagagctgaagaagcagaagagagccgccagattccagcacggccacagcagaagactgagactggagcccctggtgctgcagatgagcagcctggagagcagcggcgccgaccccgactggcaggagctgcagatcgtgggcacctgccccgacatcaccaagcactacctgagactgacctgcgcccccgaccccagcaccgtgagacccgtggccgtgctgaagaagagcctgtgcatggtgaagtgccactggaaggagaagcaggactacgccttcgcctgcgagcagatgaagagcatcagacaggacctgaccgtgcagggcatcagaaccgagttcaccgtggaggtgtacgagacccacgccagaatcgccctggagaagggcgaccacgaggagttcaaccagtgccagacccagctgaagagcctgtacgccgagaacctgcccggcaacgtgggcgagttcaccgcctacagaatcctgtactacatcttcaccaagaacagcggcgacatcaccaccgagctggcctacctgaccagagagctgaaggccgacccctgcgtggcccacgccctggccctgagaaccgcctgggccctgggcaactaccacagattcttcagactgtactgccacgccccctgcatgagcggctacctggtggacaagttcgccgacagagagagaaaggtggccctgaaggccatgatcaagaccttcagacccgccctgcccgtgagctacctgcaggccgagctggccttcgagggcgaggccgcctgcagagccttcctggagcccctgggcctggcctacaccggccccgacaacagcagcatcgactgcagactgagcctggcccagctgagcgccttctag

SEQ ID NO: 22231 - DNA, 165 bp, Artificial Sequence
  Description of Artificial Sequence: Synthetic coding sequence
atggccgccaacgtgggcgaccagagaagcaccgactggagcagccagtacagcatggtggccggcgccggcagagagaacggcatggagacccccatgcacgagaaccccgacagaagcggcatcgactgcagactgagcctggcccagctgagcgccttctag

SEQ ID NO: 22232 - DNA, 903 bp, Artificial Sequence
  Description of Artificial Sequence: Synthetic coding sequence
atggccgccaacgtgggcgaccagagaagcaccgactggagcagccagtacagcatggtggccggcgccggcagagagaacggcatggagacccccatgcacgagaaccccgagtgggagaaggccagacaggccctggccagcatcagcaagagcggcgccgccggcggcagcgccaagagcagcagcaacggccccgtggccagcgcccagtacgtgagccaggccgaggccagcgccctgcagcagcagcagtactaccagtggtaccagcagtacaactacgcctacccctacagctactactaccccatgagcatgtaccagagctacggcagccccagccagtacggcatggccggcagctacggcagcgccaccccccagcagcccagcgccccccagcaccagggcaccctgaaccagccccccgtgcccggcatggacgagagcatgagctaccaggcccccccccagcagctgcccagcgcccagcccccccagcccagcaaccccccccacggcgcccacaccctgaacagcggcccccagcccggcaccgcccccgccacccagcacagccaggccggccccgccaccggccaggcctacggcccccacacctacaccgagcccgccaagcccaagaagggccagcagctgtggaacagaatgaagcccgcccccggcaccggcggcctgaagttcaacatccagaagagacccttcgccgtgaccacccagagcttcggcagcaacgccgagggccagcacagcggcttcggcccccagcccaaccccgagaaggtgcagaaccacagcggcagcagcgccagaggcaacctgagcggcaagcccgacgactggccccaggacatgaaggagtacgtggagagatgctag

SEQ ID NO: 22233 - DNA, 276 bp, Artificial Sequence
  Description of Artificial Sequence: Synthetic coding sequence
atggccgccaacgtgggcgaccagagaagcaccgactggagcagccagtacagcatggtggccggcgccggcagagagaacggcatggagacccccatgcacgagaaccccgagtgggagaaggccagacaggccctggccagcatcagcaagagcggcgccgccggcggcagcgccaagagcagcagcaacggccccgtggccagcgcccagtacgtgagccaggccgaggccagcgccctgcagcagcagcagtactaccagtggtaccagtag

SEQ ID NO: 22234 - DNA, 591 bp, Artificial Sequence
  Description of Artificial Sequence: Synthetic coding sequence
atggtgtgcagactgatctgcgtgttccacagcaccaacgccgtgagcgtgttcagcctgagcctgttcagagcctgcacccccgtgcccgaccccgccccctggcccatcccctgcagaggcgccagcggcaagaagaccggcagacccgccagagccagactgagaagaggccaccccgccagcccccccaccgccagatgcctgacctgcttcgccaccgacagctgcagccagcccctgggcgccagcgtgttcggcgtgggcgagctgctgagagactgcgccagacccagaccccccaccctgaagtgccagcaccaccagcaccagatcctgagaagacacaccgccctgagaaccagaagacccggcagactggtgagcagctgcatcaagctgagcccctgccccctgctgcccctgccccccgtgttcctgctgatcttcttcagccccttcccccccagcctgagcgccttcttcccctggttcagcaccggcaagaccgtgcccctgcccccctgcctgcacggcagccccgcccacgtgatgctgcccagcctgttcttcgtgtgcgtgttcatctag

SEQ ID NO: 22235 - DNA, 1506 bp, Artificial Sequence
  Description of Artificial Sequence: Synthetic coding sequence
atgggcagcagacccccctgcggcgccaccagcagcgccagaagagcctgccagttccccgcccccatggccgccgccagagagcccgagctgccccaggaggcccccgccaccgagcccgcccccccccccgcctgcagattcttcctggagggcagatgcagattcggcgccagatgcagacagccccaccccggcgcccccgccccccccggcagagaggcccagcccgaggccggcgccaagaagccccccctgagaaccgccgccgacgtgatccagagaatcagatgggaccccagactggaccccgccgacttcagcgtgggctacgtggacagattcctgggcgtgagagaggagcccttcagcgccttctgctgggaccagcccctggccgccctgggccccggcgtgctggccgtgccccagcacagagtgagattcttcagattccacggcagactggtgtgggacagagccagcagaaccgacctggtgttcggcagcggcagcgccgccggcagaggccccaccatcctggacgcccccaacaccgagggcgcccacggcgccgagggcgccgagtggaccctggccggcaccggccaggaggcccaggccgcccccaagagaggcagcaccagacccctgtgcaccggccaccaggagcccggcgtggaggagcccggcgagctggaggccgcccaggagagagccctgggcaccgccgccgacctgggcaccctggcccccagaggcagactggccggcgtgaccgaggaggccctgaagcccaccgccgccaccagaaccaccctgctgggcggcaaggaggcccaggccctgggcgtgcccggcggcagcgccgagaccaccgaggccgagtggggccccgccgcctggcccgaggacaagagagccagactgagcgtggccgccccctgccagcccagacccacccacttcgtggccctgatggtgaccgagcccggcctgcaggccgaggtgaccaaggcccaggagtacctggtgcacgtggccccccactgcgccaacttcctggtgcccagccagaacctgcacctgaccctggccctgctgagactggccggcgccggcgaggaggccgccgccatcggcgccctgagaagagccctgctggcccccggcctgaacgccccccccagactgagcttcagaaagctggtgctgctgggcccccacgtgctgtgcgccccccccagccccaccctggagagcatggcccaggtgctgagccagagactggaggccgagggcctgagcaccctgcagagccccggccagctgcacccccacctgaccgtggccaaggtgccccacggcagccaggtgcacctgcccaagctggagttcaccctgagccaggaggtgggctgccagcccctgcagaccctgtggctgtgcagaatcggcagaaccggcggccccttccagcccctggccgagatcagactggagtag

SEQ ID NO: 22236 - DNA, 3252 bp, Artificial Sequence
  Description of Artificial Sequence: Synthetic coding sequence
atggcctgccccgccctgggcctggaggccctgcagcccctgcagcccgagcccccccccgagcccgccttcagcgaggcccagaagtggatcgagcaggtgaccggcagaagcttcggcgacaaggacttcagaaccggcctggagaacggcatcctgctgtgcgagctgctgaacgccatcaagcccggcctggtgaagaagatcaacagactgcccacccccatcgccggcctggacaacatcatcctgttcctgagaggctgcaaggagctgggcctgaaggagagccagctgttcgaccccagcgacctgcaggacaccagcaacagagtgaccgtgaagagcctggactacagcagaaagctgaagaacgtgctggtgaccatctactggctgggcaaggccgccaacagctgcaccagctacagcggcaccaccctgaacctgaaggagttcgagggcctgctggcccagatgagaaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagatacggccccagaacccccgtgagcgacgacgccgagagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgaccccccagttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagaagagccccagagagcacttccaggccggccccttcagcccctgcagccccaccccccccggccagagccccaacagaagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22237 - DNA, 4401 bp, Artificial Sequence
  Description of Artificial Sequence: Synthetic coding sequence
agaaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagcttccccgagaccatcgaggaggagggcagcgaggtgggcagcgccggcgaggacaaccccgccggccagatgaaccccggctggaagcccagcgacggcggctgcgagctgcccgacggcagcggcaaggagcaccccagcagcgacggcgccgtggtggcccccgcccccaagagcgaggagaaggacgccgccgagatccagaagagaaagagactggagcaggccggcatcaaggtgatgcccgccgcccagagattcgccagccagaagcagctgagcgaggagaaggaggccatcagagacatcgtgctgagaaaggagaacagcttcctgacccaccagcacggcaacgacagcgaggccgagggcgaggtggtgtgcagactgcccgacctggagaaggacgacttcgccgccagaagagccagaatgaaccagaccaagcccatggtgcccctgaaccagctgctgtacggcccctaccccaagaagggcgccgagaagagcgacggcagcaagcagctgagcaagggcatcagcaagaagagaagcctggagtacaagagaaaccagggccacaccgaggaggtgaagctgatcgtgacctgcaacatgagagcccaggagagcgagcccgtggagggcggcctgagaaaggtgcccgacctgcacaaggacgacctggcccagcagagaatccagggcagcctggccccccacagagagccccccagcttcatcaccctgagcaacatcaccgaggccgacctggagacctgggagagactgaaggtgagcgagaaggccagagacggcgacgtgcagcacatctgcgccagcgagcccagccccgagatcaaggccgagaccgccatcagagacgacttcgccaacagaaaggccagagccagcaagaaggccagcagccccagacagaagttcgtgcacttcggccccgtgaccgagctggaccagcagaagtggaagagactgagcatcggcaaggccggccccagagaggacgaggaggaggtgatctgccacggcagcaagatccagatggacagcgtgagccccgtgagcgccgccaccagcagcctgaagggccaccagatcttcaacagacagaacgactgcagaaccatgaactgcggcagaggcgactactgcagaagagccagctggctggcccccgtgcccgagagccaggaggagtgggtgtgcagcctgggcgagtgccccagaggcaccgaggaggtgaccagcaagcagctgccccaggacggcaaggaggagaccgagagcgcccccagagacagcgagagactgagcaaggccgagagaagcgaggacagcagccagcccctggtgtgccccctggccagcgagtgcgaggccagcggcaccgaggagaagctggagaagatgaccgcccccgcctggagcggcagcggcctgaagggccagagaaagctggacgacagcagaaaggacgacatgatggccagaagaaccggcatgagcctgagacacaccggcagcaaccccaaccagttcctgcccgtgcccttcgccaagcagcaggacgtggaggagagcagcaagggcctgcccatgaaggaccagagatacggccccagaacccccgtgagcgacgacgccgagagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagaagagccccagagagcacttccaggccggccccttcagcccctgcagccccaccccccccggccagagccccaacagaagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22238 - DNA, 2673 bp, Artificial Sequence
  Description of Artificial Sequence: Synthetic coding sequence
atggacagcgagagacaggtgaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagaagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22239 - DNA, 2709 bp, Artificial Sequence
  Description of Artificial Sequence: Synthetic coding sequence
atggacagcgagagacaggtgaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagatacggccccagaacccccgtgagcgacgacgccgagagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22240 - DNA, 4404 bp, Artificial Sequence
  Description of Artificial Sequence: Synthetic coding sequence
atgagaaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagcttccccgagaccatcgaggaggagggcagcgaggtgggcagcgccggcgaggacaaccccgccggccagatgaaccccggctggaagcccagcgacggcggctgcgagctgcccgacggcagcggcaaggagcaccccagcagcgacggcgccgtggtggcccccgcccccaagagcgaggagaaggacgccgccgagatccagaagagaaagagactggagcaggccggcatcaaggtgatgcccgccgcccagagattcgccagccagaagcagctgagcgaggagaaggaggccatcagagacatcgtgctgagaaaggagaacagcttcctgacccaccagcacggcaacgacagcgaggccgagggcgaggtggtgtgcagactgcccgacctggagaaggacgacttcgccgccagaagagccagaatgaaccagaccaagcccatggtgcccctgaaccagctgctgtacggcccctaccccaagaagggcgccgagaagagcgacggcagcaagcagctgagcaagggcatcagcaagaagagaagcctggagtacaagagaaaccagggccacaccgaggaggtgaagctgatcgtgacctgcaacatgagagcccaggagagcgagcccgtggagggcggcctgagaaaggtgcccgacctgcacaaggacgacctggcccagcagagaatccagggcagcctggccccccacagagagccccccagcttcatcaccctgagcaacatcaccgaggccgacctggagacctgggagagactgaaggtgagcgagaaggccagagacggcgacgtgcagcacatctgcgccagcgagcccagccccgagatcaaggccgagaccgccatcagagacgacttcgccaacagaaaggccagagccagcaagaaggccagcagccccagacagaagttcgtgcacttcggccccgtgaccgagctggaccagcagaagtggaagagactgagcatcggcaaggccggccccagagaggacgaggaggaggtgatctgccacggcagcaagatccagatggacagcgtgagccccgtgagcgccgccaccagcagcctgaagggccaccagatcttcaacagacagaacgactgcagaaccatgaactgcggcagaggcgactactgcagaagagccagctggctggcccccgtgcccgagagccaggaggagtgggtgtgcagcctgggcgagtgccccagaggcaccgaggaggtgaccagcaagcagctgccccaggacggcaaggaggagaccgagagcgcccccagagacagcgagagactgagcaaggccgagagaagcgaggacagcagccagcccctggtgtgccccctggccagcgagtgcgaggccagcggcaccgaggagaagctggagaagatgaccgcccccgcctggagcggcagcggcctgaagggccagagaaagctggacgacagcagaaaggacgacatgatggccagaagaaccggcatgagcctgagacacaccggcagcaaccccaaccagttcctgcccgtgcccttcgccaagcagcaggacgtggaggagagcagcaagggcctgcccatgaaggaccagagatacggccccagaacccccgtgagcgacgacgccgagagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagaagagccccagagagcacttccaggccggccccttcagcccctgcagccccaccccccccggccagagccccaacagaagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22241 - DNA, 2694 bp, Artificial Sequence
  Description of Artificial Sequence: Synthetic coding sequence
atgagaaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagatacggccccagaacccccgtgagcgacgacgccgagagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22242 - DNA, 3210 bp, Artificial Sequence
  Description of Artificial Sequence: Synthetic coding sequence
atggcctgccccgccctgggcctggaggccctgcagcccctgcagcccgagcccccccccgagcccgccttcagcgaggcccagaagtggatcgagcaggtgaccggcagaagcttcggcgacaaggacttcagaaccggcctggagaacggcatcctgctgtgcgagctgctgaacgccatcaagcccggcctggtgaagaagatcaacagactgcccacccccatcgccggcctggacaacatcatcctgttcctgagaggctgcaaggagctgggcctgaaggagagccagctgttcgaccccagcgacctgcaggacaccagcaacagagtgaccgtgaagagcctggactacagcagaaagctgaagaacgtgctggtgaccatctactggctgggcaaggccgccaacagctgcaccagctacagcggcaccaccctgaacctgaaggagttcgagggcctgctggcccagatgagaaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagaagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggagagccccggcaccgccagcgtgcccctgagagtgcagaacagctggagaagaagccagttcttcagccagagcgtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22243 - DNA, 3174 bp, Artificial Sequence
  Description of Artificial Sequence: Synthetic coding sequence
atggcctgccccgccctgggcctggaggccctgcagcccctgcagcccgagcccccccccgagcccgccttcagcgaggcccagaagtggatcgagcaggtgaccggcagaagcttcggcgacaaggacttcagaaccggcctggagaacggcatcctgctgtgcgagctgctgaacgccatcaagcccggcctggtgaagaagatcaacagactgcccacccccatcgccggcctggacaacatcatcctgttcctgagaggctgcaaggagctgggcctgaaggagagccagctgttcgaccccagcgacctgcaggacaccagcaacagagtgaccgtgaagagcctggactacagcagaaagctgaagaacgtgctggtgaccatctactggctgggcaaggccgccaacagctgcaccagctacagcggcaccaccctgaacctgaaggagttcgagggcctgctggcccagatgagaaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagatacggccccagaacccccgtgagcgacgacgccgagagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgaccccccagttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22244 - DNA, 1230 bp, Artificial Sequence
  Description of Artificial Sequence: Synthetic coding sequence
atgaacctggacagatgcaacagcatcgccgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22245 - DNA, 3171 bp, Artificial Sequence
  Description of Artificial Sequence: Synthetic coding sequence
atggcctgccccgccctgggcctggaggccctgcagcccctgcagcccgagcccccccccgagcccgccttcagcgaggcccagaagtggatcgagcaggtgaccggcagaagcttcggcgacaaggacttcagaaccggcctggagaacggcatcctgctgtgcgagctgctgaacgccatcaagcccggcctggtgaagaagatcaacagactgcccacccccatcgccggcctggacaacatcatcctgttcctgagaggctgcaaggagctgggcctgaaggagagccagctgttcgaccccagcgacctgcaggacaccagcaacagagtgaccgtgaagagcctggactacagcagaaagctgaagaacgtgctggtgaccatctactggctgggcaaggccgccaacagctgcaccagctacagcggcaccaccctgaacctgaaggagttcgagggcctgctggcccagatgagaaaggacaccgacgacatcgagagccccaagagaagcatcagagacagcggctacatcgactgctgggacagcgagagaagcgacagcctgagcccccccagacacggcagagacgacagcttcgacagcctggacagcttcggcagcagaagcagacagacccccagccccgacgtggtgctgagaggcagcagcgacggcagaggcagcgacagcgagagcgacctgccccacagaaagctgcccgacgtgaagaaggacgacatgagcgccagaagaaccagccacggcgagcccaagagcgccgtgcccttcaaccagtacctgcccaacaagagcaaccagaccgcctacgtgcccgcccccctgagaaagaagaaggccgagagagaggagtacagaaagagctggagcaccgccaccagccccctgggcggcgagagacccttcagatacggccccagaacccccgtgagcgacgacgccgagagcaccagcatgttcgacatgagatgcgaggaggaggccgccgtgcagccccacagcagagccagacaggagcagctgcagctgatcaacaaccagctgagagaggaggacgacaagtggcaggacgacctggccagatggaagagcagaagaagaagcgtgagccaggacctgatcaagaaggaggaggagagaaagaagatggagaagctgctggccggcgaggacggcaccagcgagagaagaaagagcatcaagacctacagagagatcgtgcaggagaaggagagaagagagagagagctgcacgaggcctacaagaacgccagaagccaggaggaggccgagggcatcctgcagcagtacatcgagagattcaccatcagcgaggccgtgctggagagactggagatgcccaagatcctggagagaagccacagcaccgagcccaacctgagcagcttcctgaacgaccccaaccccatgaagtacctgagacagcagagcctgcccccccccaagttcaccgccaccgtggagaccaccatcgccagagccagcgtgctggacaccagcatgagcgccggcagcggcagccccagcaagaccgtgacccccaaggccgtgcccatgctgacccccaagccctacagccagcccaagaacagccaggacgtgctgaagaccttcaaggtggacggcaaggtgagcgtgaacggcgagaccgtgcacagagaggaggagaaggagagagagtgccccaccgtggcccccgcccacagcctgaccaagagccagatgttcgagggcgtggccagagtgcacggcagccccctggagctgaagcaggacaacggcagcatcgagatcaacatcaagaagcccaacagcgtgccccaggagctggccgccaccaccgagaagaccgagcccaacagccaggaggacaagaacgacggcggcaagagcagaaagggcaacatcgagctggccagcagcgagccccagcacttcaccaccaccgtgaccagatgcagccccaccgtggccttcgtggagttccccagcagcccccagctgaagaacgacgtgagcgaggagaaggaccagaagaagcccgagaacgagatgagcggcaaggtggagctggtgctgagccagaaggtggtgaagcccaagagccccgagcccgaggccaccctgaccttccccttcctggacaagatgcccgaggccaaccagctgcacctgcccaacctgaacagccaggtggacagccccagcagcgagaagagccccgtgatgacccccttcaagttctgggcctgggaccccgaggaggagagaagaagacaggagaagtggcagcaggagcaggagagactgctgcaggagagataccagaaggagcaggacaagctgaaggaggagtgggagaaggcccagaaggaggtggaggaggaggagagaagatactacgaggaggagagaaagatcatcgaggacaccgtggtgcccttcaccgtgagcagcagcagcgccgaccagctgagcaccagcagcagcatgaccgagggcagcggcaccatgaacaagatcgacctgggcaactgccaggacgagaagcaggacagaagatggaagaagagcttccagggcgacgacagcgacctgctgctgaagaccagagagagcgacagactggaggagaagggcagcctgaccgagggcgccctggcccacagcggcaaccccgtgagcaagggcgtgcacgaggaccaccagctggacaccgaggccggcgccccccactgcggcaccaacccccagctggcccaggaccccagccagaaccagcagaccagcaaccccacccacagcagcgaggacgtgaagcccaagaccctgcccctggacaagagcatcaaccaccagatcgagagccccagcgagagaagaaagagcatcagcggcaagaagctgtgcagcagctgcggcctgcccctgggcaagggcgccgccatgatcatcgagaccctgaacctgtacttccacatccagtgcttcagatgcggcatctgcaagggccagctgggcgacgccgtgagcggcaccgacgtgagaatcagaaacggcctgctgaactgcaacgactgctacatgagaagcagaagcgccggccagcccaccaccctgtag

SEQ ID NO: 22246 - DNA, 384 bp, Artificial Sequence
  Description of Artificial Sequence: Synthetic coding sequence
atgttccaggccgccggcgccgcccaggccacccccagccacgacgccaagggcggcggcagcagcaccgtgcagagaagcaagagcttcagcctgagagcccaggtgaaggagacctgcgccgcctgccagaagaccgtgtaccccatggagagactggtggccgacaagctgatcttccacaacagctgcttctgctgcaagcactgccacaccaagctgagcctgggcagctacgccgccctgcacggcgagttctactgcaagccccacttccagcagctgttcaagagcaagggcaactacgacgagggcttcggcagaaagcagcacaaggagctgtgggcccacaaggaggtggaccccggcaccaagaccgcctag

SEQ ID NO: 22247 - DNA, 1944 bp, Artificial Sequence
  Description of Artificial Sequence: Synthetic coding sequence
atgagactgaccctgctgtgctgcacctggagagaggagagaatgggcgaggagggcagcgagctgcccgtgtgcgccagctgcggccagagaatctacgacggccagtacctgcaggccctgaacgccgactggcacgccgactgcttcagatgctgcgactgcagcgccagcctgagccaccagtactacgagaaggacggccagctgttctgcaagaaggactactgggccagatacggcgagagctgccacggctgcagcgagcagatcaccaagggcctggtgatggtggccggcgagctgaagtaccaccccgagtgcttcatctgcctgacctgcggcaccttcatcggcgacggcgacacctacaccctggtggagcacagcaagctgtactgcggccactgctactaccagaccgtggtgacccccgtgatcgagcagatcctgcccgacagccccggcagccacctgccccacaccgtgaccctggtgagcatccccgccagcagccacggcaagagaggcctgagcgtgagcatcgaccccccccacggcccccccggctgcggcaccgagcacagccacaccgtgagagtgcagggcgtggaccccggctgcatgagccccgacgtgaagaacagcatccacgtgggcgacagaatcctggagatcaacggcacccccatcagaaacgtgcccctggacgagatcgacctgctgatccaggagaccagcagactgctgcagctgaccctggagcacgacccccacgacaccctgggccacggcctgggccccgagaccagccccctgagcagccccgcctacacccccagcggcgaggccggcagcagcgccagacagaagcccgtgctgagaagctgcagcatcgacagaagccccggcgccggcagcctgggcagccccgccagccagagaaaggacctgggcagaagcgagagcctgagagtggtgtgcagaccccacagaatcttcagacccagcgacctgatccacggcgaggtgctgggcaagggctgcttcggccaggccatcaaggtgacccacagagagaccggcgaggtgatggtgatgaaggagctgatcagattcgacgaggagacccagagaaccttcctgaaggaggtgaaggtgatgagatgcctggagcaccccaacgtgctgaagttcatcggcgtgctgtacaaggacaagagactgaacttcatcaccgagtacatcaagggcggcaccctgagaggcatcatcaagagcatggacagccagtacccctggagccagagagtgagcttcgccaaggacatcgccagcggcatggcctacctgcacagcatgaacatcatccacagagacctgaacagccacaactgcctggtgagagagaacaagaacgtggtggtggccgacttcggcctggccagactgatggtggacgagaagacccagcccgagggcctgagaagcctgaagaagcccgacagaaagaagagatacaccgtggtgggcaacccctactggatggcccccgagatgatcaacggcagaagctacgacgagaaggtggacgtgttcagcttcggcatcgtgctgtgcgagatcatcggcagagtgaacgccgaccccgactacctgcccagaaccatggacttcggcctgaacgtgagaggcttcctggacagatactgcccccccaactgcccccccagcttcttccccatcaccgtgagatgctgcgacctggaccccgagaagagacccagcttcgtgaagctggagcactggctggagaccctgagaatgcacctggccggccacctgcccctgggcccccagctggagcagctggacagaggcttctgggagacctacagaagaggcgagagcggcctgcccgcccaccccgaggtgcccgactag

SEQ ID NO: 22248 - DNA, 741 bp, Artificial Sequence
  Description of Artificial Sequence: Synthetic coding sequence
atgttccccgtgaaggtgaaggtggagaagagcgagctggagatggtgaaggccagaaaccagctggacgccgtgctgcagtgcctgctggagaagagccacatggacagagagagactggacgaggaggccggcaagacccccagcgacacccacaacaaggactgcagcatcgccgccaccggcaagagacccagcgccagattcccccaccagagaagaaagaagagaagagagatggacgacggcctggccgagggcggcccccagagaagcaacacctacgtgatcaagctgttcgacagaagcgtggacctggcccagttcagcgagaacacccccctgtaccccatctgcagagcctggatgagaaacagccccagcgtgagagagagagagtgcagccccagcagccccctgccccccctgcccgaggacgaggagggcagcgaggtgaccaacagcaagagcagagacgtgtacaagctgcccccccccaccccccccggcccccccggcgacgcctgcagaagcagaatccccagccccctgcagcccgagatgcagggcacccccgacgacgagcccagcgagcccgagcccagccccagcaccctgatctacagaaacatgcagagatggaagagaatcagacagagatggaaggaggccagccacagaaaccagctgagatacagcgagagcatgaagatcctgagagagatgtacgagagacagtag

SEQ ID NO: 22249 - DNA, 351 bp, Artificial Sequence
  Description of Artificial Sequence: Synthetic coding sequence
atgggctggaagatggccagccccaccgacggcaccgacctggaggccagcctgctgagcttcgagaagctggacagagccagccccgacctgtggcccgagcagctgcccggcgtggccgagttcgccgccagcttcaagagccccatcaccagcagcccccccaagtggatggccgagatcgagagagacgacatcgacatgctgaaggagctgggcagcctgaccaccgccaacctgatggagaaggtgagaggcctgcagaacctggcctaccagctgggcctggacgagagcagagagatgaccagaggcaagttcctgaacatcctggagaagcccaagaagtag

SEQ ID NO: 22250 - DNA, 447 bp, Artificial Sequence
  Description of Artificial Sequence: Synthetic coding sequence
atgagactgggctgcgagctgggcatcggcttcctgttcggcggcgtggcctacggcaccagcttcagcagaagaagactggccaccagcagagacatgggctggaagatggccagccccaccgacggcaccgacctggaggccagcctgctgagcttcgagaagctggacagagccagccccgacctgtggcccgagcagctgcccggcgtggccgagttcgccgccagcttcaagagccccatcaccagcagcccccccaagtggatggccgagatcgagagagacgacatcgacatgctgaaggagctgggcagcctgaccaccgccaacctgatggagaaggtgagaggcctgcagaacctggcctaccagctgggcctggacgagagcagagagatgaccagaggcaagttcctgaacatcctggagaagcccaagaagtag

SEQ ID NO: 22251 - DNA, 2598 bp, Artificial Sequence
  Description of Artificial Sequence: Synthetic coding sequence
atgagcgacgtgagcaccagcgtgcagagcaagttcgccagactggccaagaagaaggagaacatcacctacatgaagagagagcagctgaccgagaccgacaaggacatcgcccccgtgctggacctgaagtgcaaggacgtgagcgccatcatgaacaagttcaaggtgctgatggagatccaggacctgatgttcgaggagatgagagagaccctgaagaacgacctgaaggccgtgctgggcggcaaggccaccatccccgaggtgaagaacagcgagaacagcagcagcagaaccgagttccagcagatcatcaacctggccctgcagaagaccggcatggtgggcaagatcgagggcgagaacagcaagatcggcgacgacaacgagaacctgaccttcaagctggaggtgaacgagctgagcggcaagctggacaacaccaacgagtacaacagcaacgacggcaagaagctgccccagggcgagagcagaagctacgaggtgatgggcagcatggaggagaccctgtgcaacatcgacgacagagacggcaacagaaacgtgcacctggagttcaccgagagagagagcagaaaggacggcgaggacgagttcgtgaaggagatgagagaggagagaaagttccagaagctgaagaacaaggaggaggtgctgaaggccagcagagaggagaaggtgctgatggacgagggcgccgtgctgaccctggtggccgacctgagcagcgccaccctggacatcagcaagcagtggagcaacgtgttcaacatcctgagagagaacgacttcgagcccaagttcctgtgcgaggtgaagctggccttcaagtgcgacggcgagatcaagaccttcagcgacctgcagagcctgagaaagttcgccagccagaagagcagcgtgaaggagctgctgaaggacgtgctgccccagaaggaggagatcaaccagggcggcagaaagtacggcatccaggagaagagagacaagaccctgatcgacagcaagcacagagccggcgagatcaccagcgacggcctgagcttcctgttcctgaaggaggtgaaggtggccaagcccgaggagatgaagaacctggagacccaggaggaggagttcagcgagctggaggagctggacgaggaggccagcggcatggaggacgacgaggacaccagcggcctggaggaggaggaggaggagcccagcggcctggaggaggaggaggaggaggaggccagcggcctggaggaggacgaggccagcggcctggaggaggaggaggagcagaccagcgagcaggacagcaccttccagggccacaccctggtggacgccaagcacgaggtggagatcaccagcgacggcatggagaccaccttcatcgacagcgtggaggacagcgagagcgaggaggaggaggagggcaagagcagcgagaccggcaaggtgaagaccaccagcctgaccgagaagaaggccagcagaagacagaaggagatccccttcagctacctggtgggcgacagcggcaagaagaagctggtgaagcaccaggtggtgcacaagacccaggaggaggaggagaccgccgtgcccaccagccagggcaccggcaccccctgcctgaccctgtgcctggccagccccagcaagagcctggagatgagccacgacgagcacaagaagcacagccacaccaacctgagcatcagcaccggcgtgaccaagctgaagaagaccgaggagaagaagcacagaaccctgcacaccgaggagctgaccagcaaggaggccgacctgaccgaggagaccgaggagaacctgagaagcagcgtgatcaacagcatcagagagatcaaggaggagatcggcaacctgaagagcagccacagcggcgtgctggagatcgagaacagcgtggacgacctgagcagcagaatggacatcctggaggagagaatcgacagcctggaggaccagatcgaggagttcagcaaggacaccatgcagatgaccaagcagatcatcagcaaggagagacagagagacatcgaggagagaagcagaagctgcaacatcagactgatcggcatccccgagaaggagagctacgagaacagagccgaggacatcatcaaggagatcatcgacgagaacttcgccgagctgaagaagggcagcagcctggagatcgtgagcgcctgcagagtgcccagcaagatcgacgagaagagactgacccccagacacatcctggtgaagttctggaacagcagcgacaaggagaagatcatcagagccagcagagagagaagagagatcacctaccagggcaccagaatcagactgaccgccgacctgagcctggacaccctggacgccagaagcaagtggagcaacgtgttcaaggtgctgctggagaagggcttcaaccccagaatcctgtaccccgccaagatggccttcgacttcagaggcaagaccaaggtgttcctgagcatcgaggagttcagagactacgtgctgcacatgcccaccctgagagagctgctgggcaacaacatcccctag

SEQ ID NO: 22252 - DNA, 2274 bp, Artificial Sequence
  Description of Artificial Sequence: Synthetic coding sequence
atgaaggtgttctgcgaggtgctggaggagctgtacaagaaggtgctgctgggcgccaccctggagaacgacagccacgactacatcttctacctgaaccccgccgtgagcgaccaggactgcagcaccgccaccagcctggagtgggccaacacctgcggcatccagggcagacaccagcccatcagcgtgggcgtggcccccatcgccgtggcccccgtgtgcctgaagaccaacagccagatgagcggcagcagagaggtgatgctgctgcagctgaccgtgatcaaggtgatgaccaccagaatcctgagcgtgaagaccgagttccacgccaaggagcagtacagagacgtgatcaagatcctgctggagagcgccaaggtggacagcaagctgatctgcatgttccagaacagcgacaagctgctgagccacatggccgcccagtgcctggccctgctgctgtacttccagctgagagagaagatcaccctgagcaacagctggatcgccttctgccagaagaacctgagcgagtacagcgagagcaacaaggccatctactgcctgtggaccctgaccgccatcatcaaggagatcttcaaggacagctgcagccagaagaccgagatcctgaagcagttcctgacccacttcgacaccatcttcgaggtgttctacaacagcctgttcagccagcacttcgagaactgcagagacaccagcaagatcgtgaacatcctgatgtgcttcctggacctgctggagctgctgatcgccagcagaatccacctgaagctgcacttcacctgccagagaatcctgttcctgaagcccagctgcatgctggaggtgatcacctggcccatccaggccttcgtgaagagaaaggtgatcatcttcctgaagaagtgcctgctgtgcaaggtgggcgaggacctgtgcagaggcagcgtgcccgccctgatgccccccgaccaccacgtggccgtggacatgctggccctggccaacgccgtgctgcaggccgtgaacagcggcctgctgaagaccctgagcgtgtacgagaagcacagcttcttcggcggcgacgaggtgcagcccgagtgcgagctgatcaccagccccgaccacgtgatcctgagagccgccagcctggtgatcatgaagagcctggagatcaagttccagaactacagcagcgccagcgaggtgaaggtggacctgcagagattcatgagcgagctgctgaccttcctgaagccccacctgcagcccagcctgcagctgcacaacccctgcaagtggctgagcagagtgttcatcgagcaggacgacgacatgctggaggccgccaaggccagcctgggcatctacctgaccctgaccagaggctgcgaggccaccgagagcctgacccagggcaaggagatgtgggaccaccacacccacgagaacggctacaacccccactgcatcttcctgttcttcctgaagaacatcggcttcgacagcaccgtgctgctggacttcctgatcagcagcgagacctgcttcctggagtacttcgtgagatacctgaagctgctgcagaaggactgggacaacttcttcaccatctgcaacaacttcgacgccaccgagagcaagtacgacatcagcatctgcggctgcgtgcccagcctggtgcaggaccagagcagcaaccagaccatcccccacagactgaccgccccccacagccacagagacgtgtgcgccagacacagctgggccagcgacgcccccagcgagcccctgaaggccgtgatgagcaagggcgcccacaccatgtgcgccagcagcctgagcagccccagagccagccagagcctggtggactacgacagcagcgacgacagcgacgtggagagcaccgagcagtgcctggccaacagcaagcagaccagcctgcaccagcaggccaccaaggagatccaggacgccgccggcaccagcagagacaagaaggagttcagcctggagccccccagcagacccctggtgctgaaggagttcgacaccgccttcagcttcgactgcgaggtggcccccaacgacgtggtgagcgaggtgggcatcttctacagaatcgtgaagtgcttccaggagctgcaggacgccatctgcagactgcagaagaagaacctgttcccctacaaccccaccgccctgctgaagctgctgaagtacatcgaggtgatcagcaacaagaccatgaacaccctgtag

SEQ ID NO: 22253 - DNA, 576 bp, Artificial Sequence
  Description of Artificial Sequence: Synthetic coding sequence
atgaaggtgttctgcgaggtgctggaggagctgtacaagaaggtgctgctgggcgccaccctggagaacgacagccacgactacatcttctacctgaaccccgccgtgagcgaccaggactgcagcaccgccaccagcctggagtgggccaacacctgcggcatccagggcagacaccagcccatcagcgtgggcgtggcccccatcgccgtggcccccgtgtgcctgaagaccaacagccagatgagcggcagcagagaggtgatgctgctgcagctgaccgtgatcaaggtgatgaccaccagaatcctgagcgtgaagaccgagttccacgccaaggagcagtacagagacgtgatcaagatcctgctggagagcgccaaggtggacagcaagctgatctgcatgttccagaacagcgacaagctgctgagccacatggccgcccagtgcctggccctgctgctgtacttccagctgagagagaagatcaccctgagcaacagctggatcgccttctgccagaagaacctgagcgagtacagcgagagcaacaaggccatctactgcctgtag

SEQ ID NO: 22254 - DNA, 597 bp, Artificial Sequence
  Description of Artificial Sequence: Synthetic coding sequence
atgaaggtgttctgcgaggtgctggaggagctgtacaagaaggtgctgctgggcgccaccctggagaacgacagccacgactacatcttctacctgaaccccgccgtgagcgaccaggactgcagcaccgccaccagcctggagtgggccaacacctgcggcatccagggcagacaccagcccatcagcgtgggcgtggcccccatcgccgtggcccccgtgtgcctgaagaccaacagccagatgagcggcagcagagaggtgatgctgctgcagctgaccgtgatcaaggtgatgaccaccagaatcctgagcgtgaagaccgagttccacgccaaggagcagtacagagacgtgatcaagatcctgctggagagcgccaaggtggacagcaagctgatctgcatgttccagaacagcgacaagctgctgagccacatggccgcccagtgcctggccctgctgctgtacttccagctgagagagaagatcaccctgagcaacagctggatcgccttctgccagaagaacctgagcgagtacagcgagagcaacaaggccatctactgcctgtggaccctgaccgccatcatctag

SEQ ID NO: 22255 - DNA, 390 bp, Artificial Sequence
  Description of Artificial Sequence: Synthetic coding sequence
atgaaggtgttctgcgaggtgctggaggagctgtacaagaaggtgctgctgggcgccaccctggagaacgacagccacgactacatcttctacctgaaccccgccgtgagcgaccaggactgcagcaccgccaccagcctggagtgggccaacacctgcggcatccagggcagacaccagcccatcagcgtgggcgtggcccccatcgccgtggcccccgtgtgcctgaagaccaacagccagatgagcggcagcagagaggtgatgctgctgcagctgaccgtgatcaaggtgatgaccaccagaatcctgagcgtgaagaccgagttccacgccaaggagcagtacagagacgtgatcaagatcctgctggagagcgccaaggtgtag

SEQ ID NO: 22256 - DNA, 435 bp, Artificial Sequence
  Description of Artificial Sequence: Synthetic coding sequence
atgaaggtgttctgcgaggtgctggaggagctgtacaagaaggtgctgctgggcgccaccctggagaacgacagccacgactacatcttctacctgaaccccgccgtgagcgaccaggactgcagcaccgccaccagcctggagtgggccaacacctgcggcatccagggcagacaccagcccatcagcgtgggcgtggcccccatcgccgtggcccccgtgtgcctgaagaccaacagccagatgagcggcagcagagaggtgatgctgctgcagctgaccgtgatcaaggtgatgaccaccagaatcctgagcgtgaagaccgagttccacgccaaggagcagtacagagacgtgatcaagatcctgctggagagcgccaaggtggacagcaagctgatctgcatgttccagaacagcgacaagctgctgtag

SEQ ID NO: 22257 - DNA, 1311 bp, Artificial Sequence
  Description of Artificial Sequence: Synthetic coding sequence
atgaaggtgttctgcgaggtgctggaggagctgtacaagaaggtgctgctgggcgccaccctggagaacgacagccacgactacatcttctacctgaaccccgccgtgagcgaccaggactgcagcaccgccaccagcctggagtgggccaacacctgcggcatccagggcagacaccagcccatcagcgtgggcgtggcccccatcgccgtggcccccgtgtgcctgaagaccaacagccagatgagcggcagcagagaggtgatgctgctgcagctgaccgtgatcaaggtgatgaccaccagaatcctgagcgtgaagaccgagttccacgccaaggagcagtacagagacgtgatcaagatcctgctggagagcgccaaggtggacagcaagctgatctgcatgttccagaacagcgacaagctgctgagccacatggccgcccagtgcctggccctgctgctgtacttccagctgagagagaagatcaccctgagcaacagctggatcgccttctgccagaagaacctgagcgagtacagcgagagcaacaaggccatctactgcctgtggaccctgaccgccatcatcaaggagatcttcaaggacagctgcagccagaagaccgagatcctgaagcagttcctgacccacttcgacaccatcttcgaggtgttctacaacagcctgttcagccagcacttcgagaactgcagagacaccagcaagatcgtgaacatcctgatgtgcttcctggacctgctggagctgctgatcgccagcagaatccacctgaagctgcacttcacctgccagagaatcctgttcctgaagcccagctgcatgctggaggtgatcacctggcccatccaggccttcgtgaagagaaaggtgatcatcttcctgaagaagtgcctgctgtgcaaggtgggcgaggacctgtgcagaggcagcgtgcccgccctgatgccccccgaccaccacgtggccgtggacatgctggccctggccaacgccgtgctgcaggccgtgaacagcggcctgctgaagaccctgagcgtgtacgagaagcacagcttcttcggcggcgacgaggtgcagcccgagtgcgagctgatcaccagccccgaccacgtgatcctgagagccgccagcctggtgatcatgaagagcctggagatcaagttccagaactacagcagcgccagcgaggtgaagggcaacagccccaacagcttctgcatgcagtgcgtgatcatctacctgagcaccgtgatccacaactaccagatcagcggcctggtgtag

SEQ ID NO: 22258 - DNA, 732 bp, Artificial Sequence
  Description of Artificial Sequence: Synthetic coding sequence
atgagcagcggcaccgagctgctgtggcccggcgccgccctgctggtgctgctgggcgtggccgccagcctgtgcgtgagatgcagcagacccggcgccaagagaagcgagaagatctaccagcagagaagcctgagagaggaccagcagagcttcaccggcagcagaacctacagcctggtgggccaggcctggcccggccccctggccgacatggcccccaccagaaaggacaagctgctgcagttctaccccagcctggaggaccccgccagcagcagataccagaacttcagcaagggcagcagacacggcagcgaggaggcctacatcgaccccatcgccatggagtactacaactggggcagattcagcaagccccccgaggacgacgacgccaacagctacgagaacgtgctgatctgcaagcagaagaccaccgagaccggcgcccagcaggagggcatcggcggcctgtgcagaggcgacctgagcctgagcctggccctgaagaccggccccaccagcggcctgtgccccagcgccagccccgaggaggacgaggagagcgaggactaccagaacagcgccagcatccaccagtggagagagagcagaaaggtgatgggccagctgcagagagaggccagccccggccccgtgggcagccccgacgaggaggacggcgagcccgactacgtgaacggcgaggtggccgccaccgaggcctag

SEQ ID NO: 22259 - DNA, 732 bp, Artificial Sequence; identical to SEQ ID NO: 22258
  Description of Artificial Sequence: Synthetic coding sequence

SEQ ID NO: 22260 - DNA, 732 bp, Artificial Sequence; identical to SEQ ID NO: 22258
  Description of Artificial Sequence: Synthetic coding sequence

SEQ ID NO: 22261 - DNA, 495 bp, Artificial Sequence
  Description of Artificial Sequence: Synthetic coding sequence
atggtgggcgtggtgagcgacgaccaggacttcctggacagcaaggacaccatgaagatggccgtggtgctggtgacccccctgggcaacggcgacctggccctgaagttcggctaccccaccccccacggcggctgccagaagatggacaccaccttcaccgagggcgccgtgcccggccagttcagcaaccccgccatggccctgagcgacatcagagtggccttcagcgactaccagcacttcgccctgctgtacctggagatgagaaagggcggcctgagaaaccagtggctgcagctgtacggcggcagagccgccggcagaagacccagacaccccagattcggcagcggcatgagccccctgtgcctgcaccagcccttcctgcacgccgagggcggcaccgccggcagctggtgcctgtggcccagagtgcccgcccccccctgccccagcctgcccctgttcgccccccccgcccccagcctgtag

SEQ ID NO: 22262 - DNA, 696 bp, Artificial Sequence
  Description of Artificial Sequence: Synthetic coding sequence
atgagacagcccgccgtgagactggtgagactgggcagagtgccctacgccgagctgctgggcctgcaggacagatggctgagaagactgcaggccgagcccggcatcgaggcccccagcggcaccgaggccggcgccctgctgctgtgcgagcccgccggccccgtgtacaccgccggcctgagaggcggcctgacccccgaggagaccgccagactgagagccctgggcgccgaggtgagagtgaccggcagaggcggcctggccaccttccacggccccggccagctgctgtgccaccccgtgctggacctgagaagactgggcctgagactgagaatgcacgtggccagcctggaggcctgcgccgtgagactgtgcgagctgcagggcctgcaggacgccagagccagaccccccccctacaccggcgtgtggctggacgacagaaagatctgcgccatcggcgtgagatgcggcagacacatcaccagccacggcctggccctgaactgcagcaccgacctgacctggttcgagcacatcgtgccctgcggcctggtgggcaccggcgtgaccagcctgagcaaggagctgcagagacacgtgaccgtggaggaggtgatgccccccttcctggtggccttcaaggagatctacaagtgcaccctgatcagcgaggacagccccaactag

SEQ ID NO: 22263 - DNA, 849 bp, Artificial Sequence
  Description of Artificial Sequence: Synthetic coding sequence
atggacagaaccctggagagcctgagacacatcatcgcccaggtgctgccccacagagaccccgccctggtgttcaaggacctgaacgtggtgagcatgctgcaggagttctgggagagcaagcagcagcagaaggccgccttccccagcgagggcgtggtggtgtacgagagcctgcccgcccccggcccccccttcgtgagctacgtgaccctgcccggcggcagctgcttcggcaacttccagtgctgcctgagcagagccgaggccagaagagacgccgccaaggtggccctgatcaacagcctgttcaacgagctgcccagcagaagaatcaccaaggagttcatcatggagagcgtgcaggaggccgtggccagcaccagcggcaccctggacgacgccgacgaccccagcaccagcgtgggcgcctaccactacatgctggagagcaacatgggcaagaccatgctggagttccaggagctgatgaccatcttccagctgctgcactggaacggcagcctgaaggccctgagagagaccaagtgcagcagacaggaggtgatcagctactacagccagtacagcctggacgagaagatgagaagccacatggccctggactggatcatgaaggagagagacagccccggcatcgtgagccaggagctgagaatggccctgagacagctggaggaggccagaaaggccggccaggagctgagattctacaaggagaagaaggagatcctgagcctggccctgacccagatctgcagcgaccccgacaccagcagccccagcgacgaccagctgagcctgaccgccctgtgcggctaccactag

SEQ ID NO: 22264 - DNA, 1014 bp, Artificial Sequence
  Description of Artificial Sequence: Synthetic coding sequence
atggagaccatgagagcccagagactgcagcccggcgtgggcaccagcggcagaggcaccctgagagccctgagacccggcgtgaccggcgccgccgccgccaccgccaccccccccgccggccccccccccgccccccccccccccgcccccccccccccccccctgctgctgagcggcgcccccggcctgcccctgccccccggcgccgccggcagccccgccgtgctgagagaggccgtggaggccgtggtgagaagcttcgccaagcacacccagggctacggcagagtgaacgtggtggaggccctgcaggagttctggcagatgaagcagagcagaggcgccgacctgaagaacggcgccctggtggtgtacgagatggtgcccagcaacagccccccctacgtgtgctacgtgaccctgcccggcggcagctgcttcggcagcttccagttctgccccaccaaggccgaggccagaagaagcgccgccaagatcgccctgatgaacagcgtgttcaacgagcaccccagcagaagaatcaccgacgagttcatcgagaagagcgtgagcgaggccctggccagcttcaacggcaacagagaggaggccgacaaccccaacaccggcatcggcgccttcagattcatgctggagagcaacaagggcaagagcatgctggagttccaggagctgatgaccgtgttccagctgctgcactggaacggcagcctgaaggccatgagagagagacagtgcagcagacaggaggtgctggcccactacagccacagagccctggacgacgacatcagacaccagatggccctggactgggtgagcagagagcagagcgtgcccggcgccctgagcagagagctggccagcaccgagagagagctggacgaggccagactggccggcaaggagctgagattccacaaggagaagaaggacatcctggtgctggccgccggccagctgggcaacatgcacagcagcaactgctag

SEQ ID NO: 22265 - DNA, 855 bp, Artificial Sequence
  Description of Artificial Sequence: Synthetic coding sequence
atggagaccatgagagcccagagactgcagcccggcgtgggcaccagcggcagaggcaccctgagagccctgagacccggcgtgaccggcgccgccgccgccaccgccacccacacccagggctacggcagagtgaacgtggtggaggccctgcaggagttctggcagatgaagcagagcagaggcgccgacctgaagaacggcgccctggtggtgtacgagatggtgcccagcaacagccccccctacgtgtgctacgtgaccctgcccggcggcagctgcttcggcagcttccagttctgccccaccaaggccgaggccagaagaagcgccgccaagatcgccctgatgaacagcgtgttcaacgagcaccccagcagaagaatcaccgacgagttcatcgagaagagcgtgagcgaggccctggccagcttcaacggcaacagagaggaggccgacaaccccaacaccggcatcggcgccttcagattcatgctggagagcaacaagggcaagagcatgctggagttccaggagctgatgaccgtgttccagctgctgcactggaacggcagcctgaaggccatgagagagagacagtgcagcagacaggaggtgctggcccactacagccacagagccctggacgacgacatcagacaccagatggccctggactgggtgagcagagagcagagcgtgcccggcgccctgagcagagagctggccagcaccgagagagagctggacgaggccagactggccggcaaggagctgagattccacaaggagaagaaggacatcctggtgctggccgccggccagctgggcaacatgcacagcagcaactgctag

SEQ ID NO: 22266 - DNA, 390 bp, Artificial Sequence
  Description of Artificial Sequence: Synthetic coding sequence
atggccaagagcctgagaagcaagtggaagagaaagatgagagccgagaagagaaagaagaacgcccccaaggaggccagcagactgaagagcatcctgaagctggacggcgacgtgctgatgaaggacgtgcaggagatcgccaccgtggtggtgcccaagcccaagcactgccaggagaagatgcagtgcgaggtgaaggacgagaaggacgacatgaagatggagaccgacatcaagagaaacaagaagaccctgctggaccagcacggccagtaccccatctggatgaaccagagacagagaaagagactgaaggccaagagagagaagagaaagggcaagagcaaggccaaggccgtgaaggtggccaagggcctggcctggtag

SEQ ID NO: 22267 - DNA, 390 bp, Artificial Sequence; identical to SEQ ID NO: 22266
  Description of Artificial Sequence: Synthetic coding sequence

SEQ ID NO: 22268 - DNA, 414 bp, Artificial Sequence
  Description of Artificial Sequence: Synthetic coding sequence
atgagccagttccagggcaagggccccagatggaccgtgctgatcatgagcaaggtgggcctgagaggcggcctgagcgaccagatggccatgaaggtgctggaccccctgagacaggccctggacagcagcatgcagagcaacaacctgtgccagcacccccagcccctggccctgcacgtgagcgccgccgtggccagcgccggcgcccaggccagcagcctgctgggccccctgccccacctgagcagcttcgccttccagcccgcccacagcctgctgagcctgctgggcagccacggcgccgaggtgagcaagaagatggccctgctggccagagagagaagccccgcccacctggtggccttccccggcagactgaccgccaccccccccggcctgcccaccttctag

SEQ ID NO: 22269 - DNA, 198 bp, Artificial Sequence
  Description of Artificial Sequence: Synthetic coding sequence
atgaagaaggacagccagggcgccttcagcggcttctgccacggcggcgacgccctgcacgagggcagagtgagaagacccctgtggctgaaggacatgtacaagcccctgagcgccaccagagtgaacaaccacgcctggaagctgcacaagaagagcagcaacgaggacgagatcctgaacagagaccccggctag

SEQ ID NO: 22270 - DNA, 1818 bp, Artificial Sequence
  Description of Artificial Sequence: Synthetic coding sequence
atgagcagcgtgagccccatccagatccccagcagactgcccctgctgctgacccacgagggcgtgctgctgcccggcagcaccatgagaaccagcgtggacagcgccagaaacctgcagctggtgagaagcagactgctgaagggcaccagcctgcagagcaccatcctgggcgtgatccccaacacccccgaccccgccagcgacgcccaggacctgccccccctgcacagaatcggcaccgccgccctggccgtgcaggtggtgggcagcaactggcccaagccccactacaccctgctgatcaccggcctgtgcagattccagatcgtgcaggtgctgaaggagaagccctaccccatcgccgaggtggagcagctggacagactggaggagttccccaacacctgcaagatgagagaggagctgggcgagctgagcgagcagttctacaagtacgccgtgcagatcctggacgccgtgagcctggaggagagattcaagatgaccatccccctgctggtgagacagatcgagggcctgaagctgctgcagaagaccagaaagcccaagcaggacgacgacaagagagtgatcgccatcagacccatcagaagaatcacccacatcagcggcaccctggaggacgaggacgaggacgaggacaacgacgacatcgtgatgctggagaagaagatcagaaccagcagcatgcccgagcaggcccacaaggtgtgcgtgaaggagatcaagagactgaagaagatgccccagagcatgcccgagtacgccctgaccagaaactacctggagctgatggtggagctgccctggaacaagagcaccaccgacagactggacatcagagccgccagaatcctgctggacaacgaccactacgccatggagaagctgaagaagagagtgctggagtacctggccgtgagacagctgaagaacaacctgaagggccccatcctgtgcttcgtgggcccccccggcgtgggcaagaccagcgtgggcagaagcgtggccaagaccctgggcagagagttccacagaatcgccctgggcggcgtgtgcgaccagagcgacatcagaggccacagaagaacctacgtgggcagcatgcccggcagaatcatcaacggcctgaagaccgtgggcgtgaacaaccccgtgttcctgctggacgaggtggacaagctgggcaagagcctgcagggcgaccccgccgccgccctgctggaggtgctggaccccgagcagaaccacaacttcaccgaccactacctgaacgtggccttcgacctgagccaggtgctgttcatcgccaccgccaacaccaccgccaccatccccgccgccctgctggacagaatggagatcatccaggtgcccggctacacccaggaggagaagatcgagatcgcccacagacacctgatccccaagcagctggagcagcacggcctgaccccccagcagatccagatcccccaggtgaccaccctggacatcatcaccagatacaccagagaggccggcgtgagaagcctggacagaaagctgggcgccatctgcagagccgtggccgtgaaggtggccgagggccagcacaaggaggccaagctggacagaagcgacgtgaccgagagagagggctgcagagagcacatcctggaggacgagaagcccgagagcatcagcgacaccaccgacctggccctgccccccgagatgcccatcctgatcgacttccacgccctgaaggacatcctgggcccccccatgtacgagatggagatcgccagctag

SEQ ID NO: 22271 - DNA, 2427 bp, Artificial Sequence
  Description of Artificial Sequence: Synthetic coding sequence
atgagcagcgtgagccccatccagatccccagcagactgcccctgctgctgacccacgagggcgtgctgctgcccggcagcaccatgagaaccagcgtggacagcgccagaaacctgcagctggtgagaagcagactgctgaagggcaccagcctgcagagcaccatcctgggcgtgatccccaacacccccgaccccgccagcgacgcccaggacctgccccccctgcacagaatcggcaccgccgccctggccgtgcaggtggtgggcagcaactggcccaagccccactacaccctgctgatcaccggcctgtgcagattccagatcgtgcaggtgctgaaggagaagccctaccccatcgccgaggtggagcagctggacagactggaggagttccccaacacctgcaagatgagagaggagctgggcgagctgagcgagcagttctacaagtacgccgtgcagatcctggacgccgtgagcctggaggagagattcaagatgaccatccccctgctggtgagacagatcgagggcctgaagctgctgcagaagaccagaaagcccaagcaggacgacgacaagagagtgatcgccatcagacccatcagaagaatcacccacatcagcggcaccctggaggacgaggacgaggacgaggacaacgacgacatcgtgatgctggagaagaagatcagaaccagcagcatgcccgagcaggcccacaaggtgtgcgtgaaggagatcaagagactgaagaagatgccccagagcatgcccgagtacgccctgaccagaaactacctggagctgatggtggagctgccctggaacaagagcaccaccgacagactggacatcagagccgccagaatcctgctggacaacgaccactacgccatggagaagctgaagaagagagtgctggagtacctggccgtgagacagctgaagaacaacctgaagggccccatcctgtgcttcgtgggcccccccggcgtgggcaagaccagcgtgggcagaagcgtggccaagaccctgggcagagagttccacagaatcgccctgggcggcgtgtgcgaccagagcgacatcagaggccacagaagaacctacgtgggcagcatgcccggcagaatcatcaacggcctgaagaccgtgggcgtgaacaaccccgtgttcctgctggacgaggtggacaagctgggcaagagcctgcagggcgaccccgccgccgccctgctggaggtgctggaccccgagcagaaccacaacttcaccgaccactacctgaacgtggccttcgacctgagccaggtgctgttcatcgccaccgccaacaccaccgccaccatccccgccgccctgctggacagaatggagatcatccaggtgcccggctacacccaggaggagaagatcgagatcgcccacagacacctgatccccaagcagctggagcagcacggcctgaccccccagcagatccagatcccccaggtgaccaccctggacatcatcaccagatacaccagagaggccggcgtgagaagcctggacagaaagctgggcgccatctgcagagccgtggccgtgaaggtggccgagggccagcacaaggaggccaagctggacagaagcgacgtgaccgagagagagggctgcagagagcacatcctggaggacgagaagcccgagagcatcagcgacaccaccgacctggccctgccccccgagatgcccatcctgatcgacttccacgccctgaaggacatcctgggcccccccatgtacgagatggaggtgagccagagactgagccagcccggcgtggccatcggcctggcctggacccccctgggcggcgagatcatgttcgtggaggccagcagaatggacggcgagggccagctgaccctgaccggccagctgggcgacgtgatgaaggagagcgcccacctggccatcagctggctgagaagcaacgccaagaagtaccagctgaccaacgccttcggcagcttcgacctgctggacaacaccgacatccacctgcacttccccgccggcgccgtgaccaaggacggccccagcgccggcgtgaccatcgtgacctgcctggccagcctgttcagcggcagactggtgagaagcgacgtggccatgaccggcgagatcaccctgagaggcctggtgctgcccgtgggcggcatcaaggacaaggtgctggccgcccacagagccggcctgaagcaggtgatcatccccagaagaaacgagaaggacctggagggcatccccggcaacgtgagacaggacctgagcttcgtgaccgccagctgcctggacgaggtgctgaacgccgccttcgacggcggcttcaccgtgaagaccagacccggcctgctgaacagcaagctgtag

SEQ ID NO: 22272 - DNA, 1746 bp, Artificial Sequence
  Description of Artificial Sequence: Synthetic coding sequence
atgctggagaagaagatcagaaccagcagcatgcccgagcaggcccacaaggtgtgcgtgaaggagatcaagagactgaagaagatgccccagagcatgcccgagtacgccctgaccagaaactacctggagctgatggtggagctgccctggaacaagagcaccaccgacagactggacatcagagccgccagaatcctgctggacaacgaccactacgccatggagaagctgaagaagagagtgctggagtacctggccgtgagacagctgaagaacaacctgaagggccccatcctgtgcttcgtgggcccccccggcgtgggcaagaccagcgtgggcagaagcgtggccaagaccctgggcagagagttccacagaatcgccctgggcggcgtgtgcgaccagagcgacatcagaggccacagaagaacctacgtgggcagcatgcccggcagaatcatcaacggcctgaagaccgtgggcgtgaacaaccccgtgttcctgctggacgaggtggacaagctgggcaagagcctgcagggcgaccccgccgccgccctgctggaggtgctggaccccgagcagaaccacaacttcaccgaccactacctgaacgtggccttcgacctgagccaggtgctgttcatcgccaccgccaacaccaccgccaccatccccgccgccctgctggacagaatggagatcatccaggtgcccggctacacccaggaggagaagatcgagatcgcccacagacacctgatccccaagcagctggagcagcacggcctgaccccccagcagatccagatcccccaggtgaccaccctggacatcatcaccagatacaccagagaggccggcgtgagaagcctggacagaaagctgggcgccatctgcagagccgtggccgtgaaggtggccgagggccagcacaaggaggccaagctggacagaagcgacgtgaccgagagagagggctgcagagagcacatcctggaggacgagaagcccgagagcatcagcgacaccaccgacctggccctgccccccgagatgcccatcctgatcgacttccacgccctgaaggacatcctgggcccccccatgtacgagatggaggtgagccagagactgagccagcccggcgtggccatcggcctggcctggacccccctgggcggcgagatcatgttcgtggaggccagcagaatggacggcgagggccagctgaccctgaccggccagctgggcgacgtgatgaaggagagcgcccacctggccatcagctggctgagaagcaacgccaagaagtaccagctgaccaacgccttcggcagcttcgacctgctggacaacaccgacatccacctgcacttccccgccggcgccgtgaccaaggacggccccagcgccggcgtgaccatcgtgacctgcctggccagcctgttcagcggcagactggtgagaagcgacgtggccatgaccggcgagatcaccctgagaggcctggtgctgcccgtgggcggcatcaaggacaaggtgctggccgcccacagagccggcctgaagcaggtgatcatccccagaagaaacgagaaggacctggagggcatccccggcaacgtgagacaggacctgagcttcgtgaccgccagctgcctggacgaggtgctgaacgccgccttcgacggcggcttcaccgtgaagaccagacccggcctgctgaacagcaagctgtag

SEQ ID NO: 22273 - DNA, 2322 bp, Artificial Sequence
  Description of Artificial Sequence: Synthetic coding sequence
atgagcagccccgccgtggccagaaccagccccggcggcagcagagagatggcccccgccccccagggcagaggcagattctgggaggtgggcggcggcagcggccacagactggagagagccgccgccgagagcgagagatgggagctgctgctgagaagaggcgagctgctggccctgggcggccacctgaagggcgccctggaggccttcgccgccgccctgagaagaggcgcccccgccagacccgagtgcctgggcgccctggtggactgcctggtgttcaactacagactgagacacggcctgggctggagcgccgcccccgtggccggcgccgacggcggcgccggcggcctgctgagatgcctgggctgcagaggcttcctgagcgagcccgtgaccgtgccctgcggccacagctactgcagaagatgcctgagaagagagctgagagccagatgcagactgtgcagagacagactgccccccgccaccgccagcgccaccgacgccgagggcaccgcccccagacccccccccctggccgccgccatcgccgccagcgacttcagaaccagcgtggtgctgaaccacctggccgagaagtggttccccggccagagagagagagccagagccgccggcagactgggcgagctgctgcaccagggcagatacagagaggccctggccgccgcctgcgaggccctgagagccgagcccagcgacctgatcgtgaagatctacagagccgagagctacgccggcctgcaggagttcaaggccgccatcgaggacctgaacgccgtgctgttccagctgcccgactggcccgaggtgtacttcagaaagggcaaggtgctgtgcgacgccggcttcctgggcgacgccctgcagctgttcctgcagtgcctggccctggacgaggacttcgcccccgccaagctgcaggtgcagaagatcctgtgcgacctgctgctgcccgagaacctgaaggagggcctgaaggagagcagctggagcagcctgccctgcaccaagaacagacccttcgacttccacagcgtgatggaggagagccagagcctgaacgagcccagccccaagcagagcgaggagatccccgaggtgaccagcgagcccgtgaagggcagcctgaacagagcccagagcgcccagagcatcaacagcaccgagatgcccgccagagaggactgcctgaagagagtgagcagcgagcccgtgctgagcgtgcaggagaagggcgtgctgctgaagagaaagctgagcctgctggagcaggacgtgatcgtgaacgaggacggcagaaacaagctgaagaagcagggcgagacccccaacgaggtgtgcatgttcagcctggcctacggcgacatccccgaggagctgatcgacgtgagcgacttcgagtgcagcctgtgcatgagactgttcttcgagcccgtgaccaccccctgcggccacagcttctgcaagaactgcctggagagatgcctggaccacgccccctactgccccctgtgcaaggagagcctgaaggagtacctggccgacagaagatactgcgtgacccagctgctggaggagctgatcgtgaagtacctgcccgacgagctgagcgagagaaagaagatctacgacgaggagaccgccgagctgagccacctgaccaagaacgtgcccatcttcgtgtgcaccatggcctaccccaccgtgccctgccccctgcacgtgttcgagcccagatacagactgatgatcagaagaagcatccagaccggcaccaagcagttcggcatgtgcgtgagcgacacccagaacagcttcgccgactacggctgcatgctgcagatcagaaacgtgcacttcctgcccgacggcagaagcgtggtggacaccgtgggcggcaagagattcagagtgctgaagagaggcatgaaggacggctactgcaccgccgacatcgagtacctggaggacgtgaaggtggagaacgaggacgagatcaagaacctgagagagctgcacgacctggtgtacagccaggcctgcagctggttccagaacctgagagacagattcagaagccagatcctgcagcacttcggcagcatgcccgagagagaggagaacctgcaggccgcccccaacggccccgcctggtgctggtggctgctggccgtgctgcccgtggaccccagataccagctgagcgtgctgagcatgaagagcctgaaggagagactgaccaagatccagcacatcctgacctacttcagcagagaccagagcaagtag

SEQ ID NO: 22274 - DNA, 2265 bp, Artificial Sequence
  Description of Artificial Sequence: Synthetic coding sequence
atgagccccgagcccgtgcccccccccccccccccccagtgccccggctgcgacagagccgagcccatcgcccagagactggaggagggcgacgaggccttcagagccggcgactacgagatggccgccgagctgttcagaagcatgctggccggcctggcccagcccgacagaggcctgtgcctgagactgggcgacgccctggccagagccggcagactgcccgaggccctgggcgccttcagaggcgccgccagactgggcgccctgagacccgaggagctggaggagctggccggcggcctggtgagagccgtgggcctgagagacagacccctgagcgccgagaaccccggcggcgagcccgaggcccccggcgagggcggccccgcccccgagcccagagcccccagagacctgctgggctgccccagatgcagaagactgctgcacaagcccgtgaccctgccctgcggcctgaccgtgtgcaagagatgcgtggagcccggccccgccagaccccaggtgagaagagtgaacgtggtgctgagcggcctgctggagaagtgcttccccgccgagtgcagactgagaagactggccggccaggccagaagcctgcagagacagcagcagcccgaggccgccctgctgagatgcgaccaggccctggagctggcccccgacgacaacagcctgctgctgctgagagccgagctgtacctgaccatgaagaactacgagcaggccctgcaggacgccagcgccgcctgccagaacgagcccctgctgatcaagggccaccaggtgaaggcccaggccctgagcggcctgggcagaagcaaggaggtgctgaaggagttcctgtactgcctggccctgaaccccgagtgcaacagcgtgaagaaggaggcccagaaggtgatgtgcgaggtgctgttcagcgccaccgccaacgtgcacgagaacctgaccagcagcatccagagcagactgaaggcccagggccacagccacatgaacgcccaggccctgctggaggagggcgacgccggcagcagcgagaacagcagcgagaagagcgacatgctgggcaacaccaacagcagcgtgctgtacttcatcctgggcctgcacttcgaggaggacaagaaggccctggagagcatcctgcccaccgcccccagcgccggcctgaagagacagttccccgacgacgtggaggacgcccccgacctgaacgcccccggcaagatccccaagaaggacctgagcctgcagagaagccccaacagcgagaccgaggagagccagggcctgagcctggacgtgaccgacttcgagtgcgccctgtgcatgagactgctgttcgagcccgtgaccaccccctgcggccacaccttctgcctgaagtgcctggagagatgcctggaccacgccccccactgccccctgtgcaaggacaagctgagcgagctgctggccagcagaaacttcaacatcaccgtgctggccgaggagctgatcttcagatacctgcccgacgagctgagcgacagaaagagaatctacgacgaggagatgagcgagctgagcaacctgaccagagacgtgcccatcttcgtgtgcgccatggccttccccaccgtgccctgccccctgcacgtgttcgagcccagatacagactgatgatcagaagatgcatggagaccggcaccaagagattcggcatgtgcctgagcgccgagcacgccggcctgagcgagtacggctgcatgctggagatcaaggacgtgagaaccttccccgacggcagcagcgtggtggacgccatcggcatcagcagattcagagtgctgagccacagacacagagacggctacaacaccgccgacatcgagtacctggaggacgagaaggtggagggccccgagtacgaggagctggccgccctgcacgacagcgtgcaccagcagagcgtgagctggttcgccagcctgcaggacagaatgaaggagcagatcctgagccacttcggcgtgatgcccgacagagagcccgagccccagagcaaccccagcggccccgcctggagctggtggatcctggccgtgctgcccctggagagaaaggcccagctggccatcctgggcatgaccagcctgaaggagagactgctggccatcagaagaatcctggtgatcatcaccagaaagatgaacagcagacaggagctggccaacgccagagagagaaacaactag

SEQ ID NO: 22275 - DNA, 1536 bp, Artificial Sequence
  Description of Artificial Sequence: Synthetic coding sequence
atgaagaactacgagcaggccctgcaggacgccagcgccgcctgccagaacgagcccctgctgatcaagggccaccaggtgaaggcccaggccctgagcggcctgggcagaagcaaggaggtgctgaaggagttcctgtactgcctggccctgaaccccgagtgcaacagcgtgaagaaggaggcccagaaggtgatgtgcgaggtgctgttcagcgccaccgccaacgtgcacgagaacctgaccagcagcatccagagcagactgaaggcccagggccacagccacatgaacgcccaggccctgctggaggagggcgacgccggcagcagcgagaacagcagcgagaagagcgacatgctgggcaacaccaacagcagcgtgctgtacttcatcctgggcctgcacttcgaggaggacaagaaggccctggagagcatcctgcccaccgcccccagcgccggcctgaagagacagttccccgacgacgtggaggacgcccccgacctgaacgcccccggcaagatccccaagaaggacctgagcctgcagagaagccccaacagcgagaccgaggagagccagggcctgagcctggacgtgaccgacttcgagtgcgccctgtgcatgagactgctgttcgagcccgtgaccaccccctgcggccacaccttctgcctgaagtgcctggagagatgcctggaccacgccccccactgccccctgtgcaaggacaagctgagcgagctgctggccagcagaaacttcaacatcaccgtgctggccgaggagctgatcttcagatacctgcccgacgagctgagcgacagaaagagaatctacgacgaggagatgagcgagctgagcaacctgaccagagacgtgcccatcttcgtgtgcgccatggccttccccaccgtgccctgccccctgcacgtgttcgagcccagatacagactgatgatcagaagatgcatggagaccggcaccaagagattcggcatgtgcctgagcgccgagcacgccggcctgagcgagtacggctgcatgctggagatcaaggacgtgagaaccttccccgacggcagcagcgtggtggacgccatcggcatcagcagattcagagtgctgagccacagacacagagacggctacaacaccgccgacatcgagtacctggaggacgagaaggtggagggccccgagtacgaggagctggccgccctgcacgacagcgtgcaccagcagagcgtgagctggttcgccagcctgcaggacagaatgaaggagcagatcctgagccacttcggcgtgatgcccgacagagagcccgagccccagagcaaccccagcggccccgcctggagctggtggatcctggccgtgctgcccctggagagaaaggcccagctggccatcctgggcatgaccagcctgaaggagagactgctggccatcagaagaatcctggtgatcatcaccagaaagatgaacagcagacaggagctggccaacgccagagagagaaacaactag

SEQ ID NO: 22276 - DNA, 2157 bp, Artificial Sequence
  Description of Artificial Sequence: Synthetic coding sequence
atggagagcgtgagaatcgagcagatgctgagcctgcccgccgaggtgagcagcgacaacctggagagcgccgagagaggcgccagcgccgcccaggtggacatgggcccccaccccaaggtggccgccgagggccccgcccccctgcccaccagagagcccgagcaggagcagagccccggcaccagcacccccgagagcaaggtgctgctgacccaggccgacgccctggccagcagaggcagaatcagagaggccctggaggtgtacagacagctgagcgagagacagcagctggtggccgagcagctggagcagctggtgagatgcctggccgagaaggtgccccagggcgaggccctggcccccgccccccccgacgagggcagcaccgccagcggcaccgtggccgccgaggagaccggcgccgccgccgccgccgccgccaccgaggtgtgggacggcttcaagtgcagaaagtgccacggcttcctgagcgaccccgtgagcctgagctgcggccacaccttctgcaagctgtgcctggagagaggcagagccgccgacagaagatgcgccctgtgcggcgtgaagctgagcgccctgatggtggccaccggcagagccagaggcgccagaagagccggccagcagccccccccccccctgagagtgaacgtggtgctgagcggcctgctgggcaagctgttccccggccccgccagagccagccagctgagacacgagggcaacagactgtacagagagagacaggtggaggccgccctgctgaagtacaacgaggccgtgaagctggcccccaacgaccacctgctgtacagcaacagaagccagatctacttcaccctggagagccacgagaacgccctgcacgacgccgagatcgcctgcaagctgagacccatgggcttcaaggacaacctggagctgccccactgcagcagccaggaggaggccgccgccagaggcgacggcagcagcctgatggaccccgccaaggtgaagggcgacggccagcagcaccacatgaaggaccaggaggaggaggaggagaagtgggacgccaccagccccaaggccgccagcagcaagaccggcaagtgccaggagaagaagagaaagcactgccagatcgagagccaggaggagaccggcatgcccaacaaggccagcaagcaggacccccccaccgaccagggcgacaagcccgccctgagcctgcccctggccagcttcgacgccagcgacctggagtgcgccctgtgcatgagactgttctacgagcccgtgaccaccccctgcggccacaccttctgcctgaagtgcctggagagatgcctggaccacaacgccaagtgccccctgtgcaaggacggcctgagccagtgcctggccagcagaaagtacagcaagaacgtgatcatggaggagctgatcgccaagttcctgcccgaggagctgaaggagagaagaaagctgtacgaggaggagatggaggagctgagcaacctgaacaagaacgtgcccatcttcgtgtgcaccatggcctaccccaccgtgccctgccccctgcacatcttcgagccctgctacagactgatgatcagaagatgcatcgagaccggcaccagacagttcggcatgtgcctgggcgaccccgtgaagggcttcgccgagtacggctgcatcctggagatcagaaacgtgcagttcttcgccgacggcagaagcgtggtggacagcatcggcaagagaagattcagagtgctgcaccagagccagagagacggctacaacaccgccgacatcgagtacatcgaggaccagaaggtgcagggcgaggactgcgccgagctgatgggcctgcacaactgcgtgtaccagcaggccagcctgtggttccacagcctgaagctgagcctgaagaacagaatcctgaaccacttcggccccatgcccgagaaggacgccgacccccagatgaaccccaacggccccgcctggtgctggtggatgctggccgtgctgcccctggagagcagagcccagctgcccttcctggccatgagaagcctgaaggacagactgaacggcatcagaagagtgctggccttcatcagcagaaaccagaactag

SEQ ID NO: 22277 - DNA, 2157 bp, Artificial Sequence; identical to SEQ ID NO: 22276
  Description of Artificial Sequence: Synthetic coding sequence

SEQ ID NO: 22278 - DNA, 2280 bp, Artificial Sequence
  Description of Artificial Sequence: Synthetic coding sequence
atggagagcgtgagaatcgagcagatgctgagcctgcccgccgaggtgagcagcgacaacctggagagcgccgagagaggcgccagcgccgcccaggtggacatgggcccccaccccaaggtggccgccgagggccccgcccccctgcccaccagagagcccgagcaggagcagagccccggcaccagcacccccgagagcaaggtgctgctgacccaggccgacgccctggccagcagaggcagaatcagagaggccctggaggtgtacagacagctgagcgagagacagcagctggtggccgagcagctggagcagctggtgagatgcctggccgagaaggtgccccagggcgaggccctggcccccgccccccccgacgagggcagcaccgccagcggcaccgtggccgccgaggagaccggcgccgccgccgccgccgccgccaccgaggtgtgggacggcttcaagtgcagaaagtgccacggcttcctgagcgaccccgtgagcctgagctgcggccacaccttctgcaagctgtgcctggagagaggcagagccgccgacagaagatgcgccctgtgcggcgtgaagctgagcgccctgatggtggccaccggcagagccagaggcgccagaagagccggccagcagccccccccccccctgagagtgaacgtggtgctgagcggcctgctgggcaagctgttccccggccccgccagagccagccagctgagacacgagggcaacagactgtacagagagagacaggtggaggccgccctgctgaagtacaacgaggccgtgaagctggcccccaacgaccacctgctgtacagcaacagaagccagatctacttcaccctggagagccacgagaacgccctgcacgacgccgagatcgcctgcaagctgagacccatgggcttcaaggcccacttcagaaaggcccaggccctggccaccctgggcaaggtggaggaggccctgagagagttcctgtactgcgtgagcctggacggcaagaacaagagagccagatgcgaggcccagagagacaacctggagctgccccactgcagcagccaggaggaggccgccgccagaggcgacggcagcagcctgatggaccccgccaaggtgaagggcgacggccagcagcaccacatgaaggaccaggaggaggaggaggagaagtgggacgccaccagccccaaggccgccagcagcaagaccggcaagtgccaggagaagaagagaaagcactgccagatcgagagccaggaggagaccggcatgcccaacaaggccagcaagcaggacccccccaccgaccagggcgacaagcccgccctgagcctgcccctggccagcttcgacgccagcgacctggagtgcgccctgtgcatgagactgttctacgagcccgtgaccaccccctgcggccacaccttctgcctgaagtgcctggagagatgcctggaccacaacgccaagtgccccctgtgcaaggacggcctgagccagtgcctggccagcagaaagtacagcaagaacgtgatcatggaggagctgatcgccaagttcctgcccgaggagctgaaggagagaagaaagctgtacgaggaggagatggaggagctgagcaacctgaacaagaacgtgcccatcttcgtgtgcaccatggcctaccccaccgtgccctgccccctgcacatcttcgagccctgctacagactgatgatcagaagatgcatcgagaccggcaccagacagttcggcatgtgcctgggcgaccccgtgaagggcttcgccgagtacggctgcatcctggagatcagaaacgtgcagttcttcgccgacggcagaagcgtggtggacagcatcggcaagagaagattcagagtgctgcaccagagccagagagacggctacaacaccgccgacatcgagtacatcgaggaccagaaggtgcagggcgaggactgcgccgagctgatgggcctgcacaactgcgtgtaccagcaggccagcctgtggttccacagcctgaagctgagcctgaagaacagaatcctgaaccacttcggccccatgcccgagaaggacgccgacccccagatgaaccccaacggccccgcctggtgctggtggatgctggccgtgctgcccctggagagcagagcccagctgcccttcctggccatgagaagcctgaaggacagactgaacggcatcagaagagtgctggccttcatcagcagaaaccagaactag

SEQ ID NO: 22279 - DNA, 1512 bp, Artificial Sequence
  Description of Artificial Sequence: Synthetic coding sequence
atgggcttcaaggcccacttcagaaaggcccaggccctggccaccctgggcaaggtggaggaggccctgagagagttcctgtactgcgtgagcctggacggcaagaacaagagagccagatgcgaggcccagagactgctgctgagcttcttcagccccagcgtgcccggcgacagccaggagcacagccccgacatcctgaagctgctggccccccaccccagactgaaggagaacgtggagagcatgaccaccgaggtgaccagccacaacctgcccagactgctgcaggacaacctggagctgccccactgcagcagccaggaggaggccgccgccagaggcgacggcagcagcctgatggaccccgccaaggtgaagggcgacggccagcagcaccacatgaaggaccaggaggaggaggaggagaagtgggacgccaccagccccaaggccgccagcagcaagaccggcaagtgccaggagaagaagagaaagcactgccagatcgagagccaggaggagaccggcatgcccaacaaggccagcaagcaggacccccccaccgaccagggcgacaagcccgccctgagcctgcccctggccagcttcgacgccagcgacctggagtgcgccctgtgcatgagactgttctacgagcccgtgaccaccccctgcggccacaccttctgcctgaagtgcctggagagatgcctggaccacaacgccaagtgccccctgtgcaaggacggcctgagccagtgcctggccagcagaaagtacagcaagaacgtgatcatggaggagctgatcgccaagttcctgcccgaggagctgaaggagagaagaaagctgtacgaggaggagatggaggagctgagcaacctgaacaagaacgtgcccatcttcgtgtgcaccatggcctaccccaccgtgccctgccccctgcacatcttcgagccctgctacagactgatgatcagaagatgcatcgagaccggcaccagacagttcggcatgtgcctgggcgaccccgtgaagggcttcgccgagtacggctgcatcctggagatcagaaacgtgcagttcttcgccgacggcagaagcgtggtggacagcatcggcaagagaagattcagagtgctgcaccagagccagagagacggctacaacaccgccgacatcgagtacatcgaggaccagaaggtgcagggcgaggactgcgccgagctgatgggcctgcacaactgcgtgtaccagcaggccagcctgtggttccacagcctgaagctgagcctgaagaacagaatcctgaaccacttcggccccatgcccgagaaggacgccgacccccagatgaaccccaacggccccgcctggtgctggtggatgctggccgtgctgcccctggagagcagagcccagctgcccttcctggccatgagaagcctgaaggacagactgaacggcatcagaagagtgctggccttcatcagcagaaaccagaactag

SEQ ID NO: 22280 - DNA, 1578 bp, Artificial Sequence
  Description of Artificial Sequence: Synthetic coding sequence
tgatgcggcgtgaagctgagcgccctgatggtggccaccggcagagccagaggcgccagaagagccggccagcagccccccccccccctgagagtgaacgtggtgctgagcggcctgctgggcaagctgttccccggccccgccagagccagccagctgagacacgagggcaacagactgtacagagagagacaggtggaggccgccctgctgaagtacaacgaggccgtgaagctggcccccaacgaccacctgctgtacagcaacagaagccagatctacttcaccctggagagccacgagaacgccctgcacgacgccgagatcgcctgcaagctgagacccatgggcttcaaggacaacctggagctgccccactgcagcagccaggaggaggccgccgccagaggcgacggcagcagcctgatggaccccgccaaggtgaagggcgacggccagcagcaccacatgaaggaccaggaggaggaggaggagaagtgggacgccaccagccccaaggccgccagcagcaagaccggcaagtgccaggagaagaagagaaagcactgccagatcgagagccaggaggagaccggcatgcccaacaaggccagcaagcaggacccccccaccgaccagggcgacaagcccgccctgagcctgcccctggccagcttcgacgccagcgacctggagtgcgccctgtgcatgagactgttctacgagcccgtgaccaccccctgcggccacaccttctgcctgaagtgcctggagagatgcctggaccacaacgccaagtgccccctgtgcaaggacggcctgagccagtgcctggccagcagaaagtacagcaagaacgtgatcatggaggagctgatcgccaagttcctgcccgaggagctgaaggagagaagaaagctgtacgaggaggagatggaggagctgagcaacctgaacaagaacgtgcccatcttcgtgtgcaccatggcctaccccaccgtgccctgccccctgcacatcttcgagccctgctacagactgatgatcagaagatgcatcgagaccggcaccagacagttcggcatgtgcctgggcgaccccgtgaagggcttcgccgagtacggctgcatcctggagatcagaaacgtgcagttcttcgccgacggcagaagcgtggtggacagcatcggcaagagaagattcagagtgctgcaccagagccagagagacggctacaacaccgccgacatcgagtacatcgaggaccagaaggtgcagggcgaggactgcgccgagctgatgggcctgcacaactgcgtgtaccagcaggccagcctgtggttccacagcctgaagctgagcctgaagaacagaatcctgaaccacttcggccccatgcccgagaaggacgccgacccccagatgaaccccaacggccccgcctggtgctggtggatgctggccgtgctgcccctggagagcagagcccagctgcccttcctggccatgagaagcctgaaggacagactgaacggcatcagaagagtgctggccttcatcagcagaaaccagaactag

SEQ ID NO: 22281 - DNA, 1389 bp, Artificial Sequence
  Description of Artificial Sequence: Synthetic coding sequence
atgggcgccgccggcagagccaccagactggtgggcggcagagagcagagaggcgccgtgggcggcggctggtggggcggcgagcccgacatcccctacacccacaccaccgagcacccccccatgggcagccccctgcccaacctgagagcccacgtgagaaccggcagaccccccgacccctgcaccgccgccgccagagacagaagacccctgggcagaggcggcagaggcgccgcccagaccttcggccagagaaccagaggcggccccagatgccccggcagccacagacagagaccccccagcatgaaggccgcccccagactgccccacagactgagacacagaggccagccccccgagcccagcagcctgagagccctgcacgccgaccccatccccagcggcctgagccccggcccctgcggcgccccccccacctggagcggcagaagagcccccggcgacagagacaacagacccaccagcggcccctggcagagacacaccagaagaagcagagtgtggagccagagaggccccccccagcccaagctggtgagcagaagcggcagagaggacaccagagccggcagaggcgcccagaccggcaaggccagagacagaaagggcaagggcaccagagagcccgccgagggcagactgggcaagaagccccaggccaagcccggccaccaggagaacaccgccaccggcagccacagacacagatacgagggcggccccgccgcccccagactgggcagcagaaccgcccccggcacccacagagaccccccccacgagcccggcagcagacacagagaccccgaggccaccagcgccaccaaccccacccccggccccagatgctggttcctggtgcacccccccaccctgagcagcagcggcagacccgccagaccccccctgggcatgctgcccatggccagacaccccaaccccgtgcccagaaagagaggctgcagacacagaagcctgctgctgagaggcgccggcggcgagcccgccagaagcggcgccggccacgcccccgacggcacccccggcaccgccaccgccagagccgccagccagcccctgggcagaagacccggccccgccggcagcagccccgacagcgagggcggcggcgccggccacaccgtgggcgacgagccccccagcgtgcccaccgccgaggacagcctgaagagagagagcgtgagagacagcagcttcagccccgagagcagcgaggtggacggcggcctgtgcagcgagctgctgtggttccagctggccgccagaagaagagagatcagcaacgtgagcagagaggccagagccaccgtgatcgagcccagaaagtggagactgcagtag

SEQ ID NO: 22282 - DNA, 495 bp, Artificial Sequence
  Description of Artificial Sequence: Synthetic coding sequence
atgagaccccagcccagaggcggcagcggcagaaaggagaacaccggcgaggagagagagggcagagccgagagataccacgccatcagcgccgacggcgagagaagactgcagcccggcaccgccgtgctgaccagacacgtgagcttcctgttcggcggcagagaggccgaggagcacgtgatggagaccgacagagtggagggcgccagagacggcgacaagagaaaggaggtgtgcttcgtgcccatccagggcagcttctgcttcatgagactgacctgcgccagactggtggccgccctggacatccacggcctgagcttcagcctgagattctgcggcagcagagacaccaagcacgaggacatcaccggcagagagggccaggtgacccccctgcccagaggcaccccccagctgtgcaccgccagagtgggcctgagcagccccagaaccagaggccagggcgtgcccatcagctgcaagacctag

SEQ ID NO: 22283 - DNA, 261 bp, Artificial Sequence
  Description of Artificial Sequence: Synthetic coding sequence
atggtgagacacccctacagcgtgcagacccagctgagcaccgaggccaaggccatctggagaagcatgcagcagcaggagaccaacctgctggccaacctgaccaccaacgacgccagagacaacagcaaggacttccagaacagcaaggtgggcgccgccgccaccagcagagacgagggctgcaactgccccatcatcggcgagatcgtgatcagctgctactggctgttcgagatcccccccctgatcagcagatag

SEQ ID NO: 22284 - DNA, 192 bp, Artificial Sequence
  Description of Artificial Sequence: Synthetic coding sequence
cagcagcaggagaccaacctgctggccaacctgaccaccaacgacgccagagacaacagcaaggacttccagaacagcaaggtgggcgccgccgccaccagcagagacgagggctgcaactgccccatcatcggcgagatcgtgatcagctgctactggctgttcgagatcccccccctgatcagcgagtag

SEQ ID NO: 22285 - DNA, 249 bp, Artificial Sequence
  Description of Artificial Sequence: Synthetic coding sequence
atgcagtgcctgtacttcatcctgatcctgaagggctacttccaccagcagcaccacaccctgctgatcaccatcgccctgtgcttcctgcagcagcagcaggagaccaacctgctggccaacctgaccaccaacgacgccagagacaacagcaaggacttccagaacagcaaggtgggcgccgccgccaccagcagagacgagggcgagacccagaagtgcatccagaagcccctgcacgagaagtag

SEQ ID NO: 22286 - DNA, 795 bp, Artificial Sequence
  Description of Artificial Sequence: Synthetic coding sequence
atgcccagaagcctgaagagagcccagctgagaagcctgctgcccagaccccccgccgtgagccacacccagccctggtacagagccgcccaccccaccaccagccccaccgccgccagcagagacgtgcaccccgccagcggcgccgtgcccggcccctggctggtggagggcaccgccgtgagagagggcccccagctgcaggacgccgtgccccagagacccaccagacccagcaaggccctgtggcccgcccagatgagcgccgcccccgccatcagactgggccagatggtgcccggcgacaccagaggcctgtggggcccccagggcaccctgctgacctggacctacagaggcggccagggcggcagatggaccagaagagccgagggccccagagagggcaccttcgccgagcagagaccccacttccagagcagcggcgcccagcaggagagcagactggccatgggccccccccccctgggcctgggcgacgccgccggcgacggcagaggccagaccggccaggagaagggcagagccgagggcagacaggccagaaagagcgcctgcaagtgccccagaaagggccccaaccccggcccctggaccagagccgccgcctggtggggcagactggagggcgccaaggccagcgccaagggcgagcaggtgagagaccccggcggccacctgtgggagcagggccacgtgagcccctgcgccagattcaaccagggccacagctgcggcagccccaaggtgagccacaccacctgggtgagctag

SEQ ID NO: 22287 - DNA, 447 bp, Artificial Sequence
  Description of Artificial Sequence: Synthetic coding sequence
atgggcagcgagcagagcagcgaggccgagagcagacccaacgacctgaacagcagcggcctgctgagcggccagaccagccccaccaacgccaagctggagaagctggacagccagcaggtgctgcagctgtgcctgagataccaggaccacctgcaccagtgcgccgaggccgtggccttcgaccagaacgccctggtgaagagaatcaaggagatggacctgagcgtggagaccctgttcagcttcatgcaggagagacagaagagatacgccaagtacgccgagcagatccagaaggtgaacgagatgagcgccatcctgagaagaatccagatgggcatcgaccagaccgtgcccctgctggacagactgaacagcatgctgcccgagggcgagagactggagcccttcagcatgaagcccgacagagagctgagactgtag

SEQ ID NO: 22288 - DNA, 591 bp, Artificial Sequence
  Description of Artificial Sequence: Synthetic coding sequence
atgggcagcgagcagagcagcgaggccgagagcagacccaacgacctgaacagcagcgtgacccccagccccgccaagcacagagccaagatggacgacatcgtggtggtggcccagggcagccaggccagcagaaacgtgagcaacgaccccgacgtgatcaagctgcaggagatccccaccttccagcccctgctgaagggcctgctgagcggccagaccagccccaccaacgccaagctggagaagctggacagccagcaggtgctgcagctgtgcctgagataccaggaccacctgcaccagtgcgccgaggccgtggccttcgaccagaacgccctggtgaagagaatcaaggagatggacctgagcgtggagaccctgttcagcttcatgcaggagagacagaagagatacgccaagtacgccgagcagatccagaaggtgaacgagatgagcgccatcctgagaagaatccagatgggcatcgaccagaccgtgcccctgctggacagactgaacagcatgctgcccgagggcgagagactggagcccttcagcatgaagcccgacagagagctgagactgtag

SEQ ID NO: 22289 - DNA, 501 bp, Artificial Sequence
  Description of Artificial Sequence: Synthetic coding sequence
atgcagggcaccagagccgagctgagcgcccacagccccagcagagccgccggcaacagaagacacgagcagggcctgccccccggcgcccaggcctgcatcaccctgaccaacagaaccggcttcctgtgccacgaccagagaagctgcatccccgccagcggcgtgtgcgacggcgtgagaacctgcacccacggcgaggacgaggacgagagcctgtgcagagacgtgccccagagcctgccccacttcctggtggcccactgcggcgaccccgccagctggatctacagcgaccagaagtgcgacggcaccaacaactgcggcgactgcagcgacgagctgagccccgtgaccgtgtgccccccctgcggccccggctggtggagatgccccagcaccttcttcaagtactgcgactgcatccccagacacctgtgcagagaccacgtgcagcactgcagcgactggagcgacgagtacgcctgccccggcccctag

SEQ ID NO: 22290 - DNA, 489 bp, Artificial Sequence
  Description of Artificial Sequence: Synthetic coding sequence
atgaacaaggtgttcccccagggcgagaacggctacaccgccgccgagagcaaggcccaccccggcggcgagggcgcccaggcctgcatcaccctgaccaacagaaccggcttcctgtgccacgaccagagaagctgcatccccgccagcggcgtgtgcgacggcgtgagaacctgcacccacggcgaggacgaggacgagagcctgtgcagagacgtgccccagagcctgccccacttcctggtggcccactgcggcgaccccgccagctggatctacagcgaccagaagtgcgacggcaccaacaactgcggcgactgcagcgacgagctgagccccgtgaccgtgtgccccccctgcggccccggctggtggagatgccccagcaccttcttcaagtactgcgactgcatccccagacacctgtgcagagaccacgtgcagcactgcagcgactggagcgacgagtacgcctgccccggcccctag

SEQ ID NO: 22291 - DNA, 759 bp, Artificial Sequence
  Description of Artificial Sequence: Synthetic coding sequence
atggagggccacgtgtactggaccgacgacgaggtgtgggccatcagaagagcctacctggacggcagcggcgcccagaccctgatcaacaccaagatcaacgaccccgacgacatcgccgtgaactgggtggccagaagcctgtactggacccacaccggcaccgagcacatcgaggtgacctgcctgaacagcaccagccacaagatcctggtgagcgaggacatggacgagcccagagccatcgccctgcaccccgagatgggcctgacctactggatcgactggggcgagaaccccgagatcaagagagccaacctggacagacaggagctgagagtgctggtgaacgccagcctgggctggcccaacggcctggccctggacctgcaggagggcaagctgtactggggcgacgccaagaccgacaagatcgaggccatcagcgtggacgagaccaagagacagaccctgctgaaggacaagctgccccacatcttcagattcaccctgctgggcgacttcatctactggaccgcctggcagcaccacagcatcaagagagtgcacaaggtgaaggccaacagagacgtgatcatcgaccagctgcccgacctgatgggcctgaaggccgtgaacgtggacaaggtggtgggcaccaacccccacgccgacagaaacggcggcgccgccacctgcgccagcagcagacccacccagcccggcctggccgcccccagcagagcctggaactgctag

SEQ ID NO: 22292 - DNA, 759 bp, Artificial Sequence; identical to SEQ ID NO: 22291
  Description of Artificial Sequence: Synthetic coding sequence

SEQ ID NO: 22293 - DNA, 675 bp, Artificial Sequence
  Description of Artificial Sequence: Synthetic coding sequence
atggagggccacgtgtactggaccgacgacgaggtgtgggccatcagaagagcctacctggacggcagcggcgcccagaccctgatcaacaccaagatcaacgaccccgacgacatcgccgtgaactgggtggccagaagcctgtactggacccacaccggcaccgagcacatcgaggtgacctgcctgaacagcaccagccacaagatcctggtgagcgaggacatggacgagcccagagccatcgccctgcaccccgagatgggcctgacctactggatcgactggggcgagaaccccgagatcaagagagccaacctggacagacaggagctgagagtgctggtgaacgccagcctgggctggcccaacggcctggccctggacctgcaggagggcaagctgtactggggcgacgccaagaccgacaagatcgaggccatcagcgtggacgagaccaagagacagaccctgctgaaggacaagctgccccacatcttcagattcaccctgctgggcgacttcatctactggaccgcctggcagcaccacagcatcaagagagtgcacaaggtgaaggccaacagagacgtgatcatcgaccagctgcccgacctgatgggcctgaaggccgtgaacgtggacaaggtggtgggccccggcaccgccgagtag

SEQ ID NO: 22294 - DNA, 12 bp, Artificial Sequence
  Description of Artificial Sequence: Synthetic coding sequence
atggagggctag

SEQ ID NO: 22295 - DNA, 1158 bp, Artificial Sequence
  Description of Artificial Sequence: Synthetic coding sequence
atgagcggcagcagcggcaccccctacctgggcagcaagatcagcctgatcagcaaggcccagatcagatacgagggcatcctgtacaccatcgacaccgacaacagcaccgtggccctggccaaggtgagaagcttcggcaccgaggacagacccaccgacagacccgccccccccagagaggagatctacgagtacatcatcttcagaggcagcgacatcaaggacatcaccgtgtgcgagccccccaaggcccagcacaccctgccccaggaccccgccatcgtgcagagcagcctgggcagcgccagcgccagccccttccagccccacgtgccctacagccccttcagaggcatggccccctacggccccctggccgccagcagcctgctgagccagcagtacgccgccagcctgggcctggagaagctggtgagcccccccgccagcgccgccgccagcagccccagcagcagccccagcccccagcccgtgagcgagctggacctgagcagcgagccccagcagctgaccgccaagggcaacagcagcctgggcgagctgcacgccgtgctgcagaccatcctgagagccagaggcaaggccgccgacagaatgaccgtggccgtggccgaccacctgcccagcccctgcagcagaagaagaagcggcaacagaagaaccagaaacagaagcagaggccagaacagacccaccaacgtgaaggagaacaccatcaagttcgagggcgacttcgacttcgagagcgccaacgcccagttcaacagagaggagctggacaaggagttcaagaagaagctgaacttcaaggacgacaaggccgagaagggcgaggagaaggacctggccgtggtgacccagagcgccgaggcccccgccgaggaggacctgctgggccccaactgctactacgacaagagcaagagcttcttcgacaacatcagcagcgagctgaagaccagcagcagaagaaccacctgggccgaggagagaaagctgaacaccgagaccttcggcgtgagcggcagattcctgagaggcagaagcagcagaggcggcttcagaggcggcagaggcaacggcaccaccagaagaaaccccaccagccacagagccggcaccggcagagtgtag

SEQ ID NO: 22296 - DNA, 1158 bp, Artificial Sequence
  Description of Artificial Sequence: Synthetic coding sequence
atgagcggcagcagcggcaccccctacctgggcagcaagatcagcctgatcagcaaggcccagatcagatacgagggcatcctgtacaccatcgacaccgacaacagcaccgtggccctggccaaggtgagaagcttcggcaccgaggacagacccaccgacagacccgccccccccagagaggagatctacgagtacatcatcttcagaggcagcgacatcaaggacatcaccgtgtgcgagccccccaaggcccagcacaccctgccccaggaccccgccatcgtgcagagcagcctgggcagcgccagcgccagccccttccagccccacgtgccctacagccccttcagaggcatggccccctacggccccctggccgccagcagcctgctgagccagcagtacgccgccagcctgggcctgggcgccggcttccccagcatccccgtgggcaagagccccatggtggagcaggccgtgcagaccggcagcgccgacaacctgaacgccaagaagctgctgcccggcaagggcaccaccggcacccagctgaacggcagacaggcccagcccagcagcaagaccgccagcgacgtggtgcagcccgccgccgtgcaggcccagggccaggtgaacgacgagaacagaagaccccagagaagaagaagcggcaacagaagaaccagaaacagaagcagaggccagaacagacccaccaacgtgaaggagaacaccatcaagttcgagggcgacttcgacttcgagagcgccaacgcccagttcaacagagaggagctggacaaggagttcaagaagaagctgaacttcaaggacgacaaggccgagaagggcgaggagaaggacctggccgtggtgacccagagcgccgaggcccccgccgaggaggacctgctgggccccaactgctactacgacaagagcaagagcttcttcgacaacatcagcagcgagctgaagaccagcagcagaagaaccacctgggccgaggagagaaagctgaacaccgagaccttcggcgtgagcggcagattcctgagaggcagaagcagcagaggcggcttcagaggcggcagaggcaacggcaccaccagaagaaaccccaccagccacagagccggcaccggcagagtgtag

SEQ ID NO: 22297 - DNA, 672 bp, Artificial Sequence
  Description of Artificial Sequence: Synthetic coding sequence
atgagcggcagcagcggcaccccctacctgggcagcaagatcagcctgatcagcaaggcccagatcagatacgagggcatcctgtacaccatcgacaccgacaacagcaccgtggccctggccaaggtgagaagcttcggcaccgaggacagacccaccgacagacccgccccccccagagaggagatctacgagtacatcatcttcagaggcagcgacatcaaggacatcaccgtgtgcgagccccccaaggcccagcacaccctgccccaggaccccgccatcgtgcagagcagcctgggcagcgccagcgccagccccttccagccccacgtgccctacagccccttcagaggcatggccccctacggccccctggccgccagcagcctgctgagccagcagtacgccgccagcctgggcctgggcgccggcttccccagcatccccgtgggcaagagccccatggtggagcaggccgtgcagaccggcagcgccgacaacctgaacgccaagaagctgctgcccggcaagggcaccaccggcacccagctgaacggcagacaggcccagcccagcagcaagaccgccagcggcaacagaagaaccagaaacagaagcagaggccagaacagacccaccaacgtgaaggagaacaccatcaagttctag

SEQ ID NO: 22298 - DNA, 747 bp, Artificial Sequence
  Description of Artificial Sequence: Synthetic coding sequence
atggccccctacggccccctggccgccagcagcctgctgagccagcagtacgccgccagcctgggcctggagaagctggtgagcccccccgccagcgccgccgccagcagccccagcagcagccccagcccccagcccgtgagcgagctggacctgagcagcgagccccagcagctgaccgccaagggcgccggcttccccagcatccccgtgggcaagagccccatggtggagcaggccgtgcagaccggcagcgccgacaacctgaacgccaagaagctgctgcccggcaagggcaccaccggcacccagctgaacggcagacaggcccagcccagcagcaagaccgccagcgacgtggtgcagcccgccgccgtgcaggcccagggccaggtgaacgacgagaacagaagaccccagagaagaagaagcggcaacagaagaaccagaaacagaagcagaggccagaacagacccaccaacgtgaaggagaacaccatcaagttcgagggcgacttcgacttcgagagcgccaacgcccagttcaacagagaggagctggacaaggagttcaagaagaagctgaacttcaaggacgacaaggccgagaagggcgaggagaaggacctggccgtggtgacccagagcgccgaggcccccgccgaggaggacctgctgggccccaactgctactacgacaagagcaagagcttcttcgacaacatcagcagcgagctgaagacctag

SEQ ID NO: 22299 - DNA, 720 bp, Artificial Sequence
  Description of Artificial Sequence: Synthetic coding sequence
atggccccctacggccccctggccgccagcagcctgctgagccagcagtacgccgccagcctgggcctggagaagctggtgagcccccccgccagcgccgccgccagcagccccagcagcagccccagcccccagcccgtgagcgagctggacctgagcagcgagccccagcagctgaccgccaagggctgcctgttctgcttcagaagcctgttcacctacacccagagccacatcgtgctgttcagagtgcccaccggccccggcaccctggagagagaggagatggagagaggcgccggcttccccagcatccccgtgggcaagagccccatggtggagcaggccgtgcagaccggcagcgccgacaacctgaacgccaagaagctgctgcccggcaagggcaccaccggcacccagctgaacggcagacaggcccagcccagcagcaagaccgccagcgacgtggtgcagcccgccgccgtgcaggcccagggccaggtgaacgacgagaacagaagaccccagagaagaagaagcggcaacagaagaaccagaaacagaagcagaggccagaacagacccaccaacgtgaaggagaacaccatcaagttcgagggcgacttcgacttcgagagcgccaacgcccagttcaacagagaggagctggacaaggagttcaagaagagacccatcctgctgctggtgttctggacctag

SEQ ID NO: 22300 - DNA, 666 bp, Artificial Sequence
  Description of Artificial Sequence: Synthetic coding sequence
atgagcggcagcagcggcaccccctacctgggcagcaagatcagcctgatcagcaaggcccagatcagatacgagggcatcctgtacaccatcgacaccgacaacagcaccgtggccctggccaaggtgagaagcttcggcaccgaggacagacccaccgacagacccgccccccccagagaggagatctacgagtacatcatcttcagaggcagcgacatcaaggacatcaccgtgtgcgagccccccaaggcccagcacaccctgccccaggaccccgccatcgtgcagagcagcctgggcagcgccagcgccagccccttccagccccacgtgccctacagccccttcagaggcatggccccctacggccccctggccgccagcagcctgctgagccagcagtacgccgccagcctgggcctggagaagctggtgagcccccccgccagcgccgccgccagcagccccagcagcagccccagcccccagcccgtgagcgagctggacctgagcagcgagccccagcagctgaccgccaagggcaacagcagcctgggcgagctgcacgccgtgctgcagaccatcctgagagccagaggcaaggccgccgacagaatgaccgtggccgtggccgaccacctgcccagcccctgcagcagatag

SEQ ID NO: 22301 - DNA, 891 bp, Artificial Sequence
  Description of Artificial Sequence: Synthetic coding sequence
atgagcggcagcagcggcaccccctacctgggcagcaagatcagcctgatcagcaaggcccagatcagatacgagggcatcctgtacaccatcgacaccgacaacagcaccgtggccctggccaaggtgagaagcttcggcaccgaggacagacccaccgacagacccgccccccccagagaggagatctacgagtacatcatcttcagaggcagcgacatcaaggacatcaccgtgtgcgagccccccaaggcccagcacaccctgccccaggaccccgccatcgtgcagctgaacaagagacccgacgagggcgtgagaggcgacggcatggccttcgccgtgctgaccagatgcctggtggtgcagagcagcctgggcagcgccagcgccagccccttccagccccacgtgccctacagccccttcagaggcatggccccctacggccccctggccgccagcagcctgctgagccagcagtacgccgccagcctgggcctgggcgccggcttccccagcatccccgtgggcaagagccccatggtggagcaggccgtgcagaccggcagcgccgacaacctgaacgccaagaagctgctgcccggcaagggcaccaccggcacccagctgaacggcagacaggcccagcccagcagcaagaccgccagcgacgtggtgcagcccgccgccgtgcaggcccagggccaggtgaacgacgagaacagaagaccccagagaagaagaagcggcaacagaagaaccagaaacagaagcagaggccagaacagacccaccaacgtgaaggagaacaccatcaagttcgagggcgacttcgacttcgagagcgccaacgcccagttcaacagagaggagctggacaaggagtag

SEQ ID NO: 22302 - DNA, 693 bp, Artificial Sequence
  Description of Artificial Sequence: Synthetic coding sequence
atggccccctacggccccctggccgccagcagcctgctgagccagcagtacgccgccagcctgggcctggagaagctggtgagcccccccgccagcgccgccgccagcagccccagcagcagccccagcccccagcccgtgagcgagctggacctgagcagcgagccccagcagctgaccgccaagggctgcctgttctgcttcagaagcctgttcacctacacccagagccacatcgtgctgttcagagtgcccaccggccccggcaccctggagagagaggagatggagagaggcgccggcttccccagcatccccgtgggcaagagccccatggtggagcaggccgtgcagaccggcagcgccgacaacctgaacgccaagaagctgctgcccggcaagggcaccaccggcacccagctgaacggcagacaggcccagcccagcagcaagaccgccagcgacgtggtgcagcccgccgccgtgcaggcccagggccaggtgaacgacgagaacagaagaccccagagaagaagaagcggcaacagaagaaccagaaacagaagcagaggccagaacagacccaccaacgtgaaggagaacaccatcaagttcgagggcgacttcgacttcgagagcgccaacgcccagttcaacagagaggagctggacaaggagttcaagaagaagtag

SEQ ID NO: 22303 - DNA, 1158 bp, Artificial Sequence; identical to SEQ ID NO: 22296
  Description of Artificial Sequence: Synthetic coding sequence

SEQ ID NO: 22304 - DNA, 1428 bp, Artificial Sequence
  Description of Artificial Sequence: Synthetic coding sequence
atgccccacagaaagaagaagcccttcatcgagaagaagaaggccgtgagcttccacctggtgcacagaagccagagagaccccctggccgccgacgagagcgccccccagagagtgctgctgcccacccagaagatcgacaacgaggagagaagagccgagcagagaaagtacggcgtgttcttcgacgacgactacgactacctgcagcacctgaaggagcccagcggccccagcgagctgatccccagcagcaccttcagcgcccacaacagaagagaggagaaggaggagaccctggtgatccccagcaccggcatcaagctgcccagcagcgtgttcgccagcgagttcgaggaggacgtgggcctgctgaacaaggccgcccccgtgagcggccccagactggacttcgaccccgacatcgtggccgccctggacgacgacttcgacttcgacgaccccgacaacctgctggaggacgacttcatcctgcaggccaacaaggccaccggcgaggaggagggcatggacatccagaagagcgagaacgaggacgacagcgagtgggaggacgtggacgacgagaagggcgacagcaacgacgactacgacagcgccggcctgctgagcgacgaggactgcatgagcgtgcccggcaagacccacagagccatcgccgaccacctgttctggagcgaggagaccaagagcagattcaccgagtacagcatgaccagcagcgtgatgagaagaaacgagcagctgaccctgcacgacgagagattcgagaagttctacgagcagtacgacgacgacgagatcggcgccctggacaacgccgagctggagggcagcatccaggtggacagcaacagactgcaggaggtgctgaacgactactacaaggagaaggccgagaactgcgtgaagctgaacaccctggagcccctggaggaccaggacctgcccatgaacgagctggacgagagcgaggaggaggagatgatcaccgtggtgctggaggaggccaaggagaagtgggactgcgagagcatctgcagcacctacagcaacctgtacaaccacccccagctgatcaagtaccagcccaagcccaagcagatcagaatcagcagcaagaccggcatccccctgaacgtgctgcccaagaagggcctgaccgccaagcagaccgagagaatccagatgatcaacggcagcgacctgcccaaggtgagcacccagcccagaagcaagaacgagagcaaggaggacaagagagccagaaagcaggccatcaaggaggagagaaaggagagaagagtggagaagaaggccaacaagctggccttcaagctggagaagagaagacaggagaaggagctgctgaacctgaagaagaacgtggagggcctgaagctgtag

SEQ ID NO: 22305 - DNA, 714 bp, Artificial Sequence
  Description of Artificial Sequence: Synthetic coding sequence
atgaagggcatcctggtggccggcatcaccgccgtgctggtggccgccgtggagagcctgagctgcgtgcagtgcaacagctgggagaagagctgcgtgaacagcatcgccagcgagtgccccagccacgccaacaccagctgcatcagcagcagcgccagcagcagcctggagacccccgtgagactgtaccagaacatgttctgcagcgccgagaactgcagcgaggagacccacatcaccgccttcaccgtgcacgtgagcgccgaggagcacttccacttcgtgagccagtgctgccagggcaaggagtgcagcaacaccagcgacgccctggacccccccctgaagaacgtgagcagcaacgccgagtgccccgcctgctacgagagcaacggcaccagctgccacggcaagccctggaagtgctacgaggaggagcagtgcgtgttcctggtggccgagctgaagaacgacatcgagagcaagagcctggtgctgaagggctgcagcaacgtgagcaacgccacctgccagttcctgagcggcgagaacaagaccctgggcggcgtgatcttcagaaagttcgagtgcgccaacgtgaacagcctgacccccaccagcgcccccaccaccagccacaacgtgggcagcaaggccagcctgtacctgctggccctggccagcctgctgctgagaggcctgctgccctag

SEQ ID NO: 22306 - DNA, 5622 bp, Artificial Sequence
  Description of Artificial Sequence: Synthetic coding sequence
atgagaaccggctgggccacccccagaagacccgccggcctgctgatgctgctgttctggttcttcgacctggccgagcccagcggcagagccgccaacgaccccttcaccatcgtgcacggcaacaccggcaagtgcatcaagcccgtgtacggctggatcgtggccgacgactgcgacgagaccgaggacaagctgtggaagtgggtgagccagcacagactgttccacctgcacagccagaagtgcctgggcctggacatcaccaagagcgtgaacgagctgagaatgttcagctgcgacagcagcgccatgctgtggtggaagtgcgagcaccacagcctgtacggcgccgccagatacagactggccctgaaggacggccacggcaccgccatcagcaacgccagcgacgtgtggaagaagggcggcagcgaggagagcctgtgcgaccagccctaccacgagatctacaccagagacggcaacagctacggcagaccctgcgagttccccttcctgatcgacggcacctggcaccacgactgcatcctggacgaggaccacagcggcccctggtgcgccaccaccctgaactacgagtacgacagaaagtggggcatctgcctgaagcccgagaacggctgcgaggacaactgggagaagaacgagcagttcggcagctgctaccagttcaacacccagaccgccctgagctggaaggaggcctacgtgagctgccagaaccagggcgccgacctgctgagcatcaacagcgccgccgagctgacctacctgaaggagaaggagggcatcgccaagatcttctggatcggcctgaaccagctgtacagcgccagaggctgggagtggagcgaccacaagcccctgaacttcctgaactgggaccccgacagacccagcgcccccaccatcggcggcagcagctgcgccagaatggacgccgagagcggcctgtggcagagcttcagctgcgaggcccagctgccctacgtgtgcagaaagcccctgaacaacaccgtggagctgaccgacgtgtggacctacagcgacaccagatgcgacgccggctggctgcccaacaacggcttctgctacctgctggtgaacgagagcaacagctgggacaaggcccacgccaagtgcaaggccttcagcagcgacctgatcagcatccacagcctggccgacgtggaggtggtggtgaccaagctgcacaacgaggacatcaaggaggaggtgtggatcggcctgaagaacatcaacatccccaccctgttccagtggagcgacggcaccgaggtgaccctgacctactgggacgagaacgagcccaacgtgccctacaacaagacccccaactgcgtgagctacctgggcgagctgggccagtggaaggtgcagagctgcgaggagaagctgaagtacgtgtgcaagagaaagggcgagaagctgaacgacgccagcagcgacaagatgtgcccccccgacgagggctggaagagacacggcgagacctgctacaagatctacgaggacgaggtgcccttcggcaccaactgcaacctgaccatcaccagcagattcgagcaggagtacctgaacgacctgatgaagaagtacgacaagagcctgagaaagtacttctggaccggcctgagagacgtggacagctgcggcgagtacaactgggccaccgtgggcggcagaagaagagccgtgaccttcagcaactggaacttcctggagcccgccagccccggcggctgcgtggccatgagcaccggcaagagcgtgggcaagtgggaggtgaaggactgcagaagcttcaaggccctgagcatctgcaagaagatgagcggccccctgggccccgaggaggccagccccaagcccgacgacccctgccccgagggctggcagagcttccccgccagcctgagctgctacaaggtgttccacgccgagagaatcgtgagaaagagaaactgggaggaggccgagagattctgccaggccctgggcgcccacctgagcagcttcagccacgtggacgagatcaaggagttcctgcacttcctgaccgaccagttcagcggccagcactggctgtggatcggcctgaacaagagaagccccgacctgcagggcagctggcagtggagcgacagaacccccgtgagcaccatcatcatgcccaacgagttccagcaggactacgacatcagagactgcgccgccgtgaaggtgttccacagaccctggagaagaggctggcacttctacgacgacagagagttcatctacctgagacccttcgcctgcgacaccaagctggagtgggtgtgccagatccccaagggcagaacccccaagacccccgactggtacaaccccgacagagccggcatccacggcccccccctgatcatcgagggcagcgagtactggttcgtggccgacctgcacctgaactacgaggaggccgtgctgtactgcgccagcaaccacagcttcctggccaccatcaccagcttcgtgggcctgaaggccatcaagaacaagatcgccaacatcagcggcgacggccagaagtggtggatcagaatcagcgagtggcccatcgacgaccacttcacctacagcagatacccctggcacagattccccgtgaccttcggcgaggagtgcctgtacatgagcgccaagacctggctgatcgacctgggcaagcccaccgactgcagcaccaagctgcccttcatctgcgagaagtacaacgtgagcagcctggagaagtacagccccgacagcgccgccaaggtgcagtgcagcgagcagtggatccccttccagaacaagtgcttcctgaagatcaagcccgtgagcctgaccttcagccaggccagcgacacctgccacagctacggcggcaccctgcccagcgtgctgagccagatcgagcaggacttcatcaccagcctgctgcccgacatggaggccaccctgtggatcggcctgagatggaccgcctacgagaagatcaacaagtggaccgacaacagagagctgacctacagcaacttccaccccctgctggtgagcggcagactgagaatccccgagaacttcttcgaggaggagagcagataccactgcgccctgatcctgaacctgcagaagagccccttcaccggcacctggaacttcaccagctgcagcgagagacacttcgtgagcctgtgccagaagtacagcgaggtgaagagcagacagaccctgcagaacgccagcgagaccgtgaagtacctgaacaacctgtacaagatcatccccaagaccctgacctggcacagcgccaagagagagtgcctgaagagcaacatgcagctggtgagcatcaccgacccctaccagcaggccttcctgagcgtgcaggccctgctgcacaacagcagcctgtggatcggcctgttcagccaggacgacgagctgaacttcggctggagcgacggcaagagactgcacttcagcagatgggccgagaccaacggccagctggaggactgcgtggtgctggacaccgacggcttctggaagaccgtggactgcaacgacaaccagcccggcgccatctgctactacagcggcaacgagaccgagaaggaggtgaagcccgtggacagcgtgaagtgccccagccccgtgctgaacaccccctggatccccttccagaactgctgctacaacttcatcatcaccaagaacagacacatggccaccacccaggacgaggtgcacaccaagtgccagaagctgaaccccaagagccacatcctgagcatcagagacgagaaggagaacaacttcgtgctggagcagctgctgtacttcaactacatggccagctgggtgatgctgggcatcacctacagaaacaagagcctgatgtggttcgacaagacccccctgagctacacccactggagagccggcagacccaccatcaagaacgagaagttcctggccggcctgagcaccgacggcttctgggacatccagaccttcaaggtgatcgaggaggccgtgtacttccaccagcacagcatcctggcctgcaagatcgagatggtggactacaaggaggagtacaacaccaccctgccccagttcatgccctacgaggacggcatctacagcgtgatccagaagaaggtgacctggtacgaggccctgaacatgtgcagccagagcggcggccacctggccagcgtgcacaaccagaacggccagctgttcctggaggacatcgtgaagagagacggcttccccctgtgggtgggcctgagcagccacgacggcagcgagagcagcttcgagtggagcgacggcagcaccttcgactacatcccctggaagggccagaccagccccggcaactgcgtgctgctggaccccaagggcacctggaagcacgagaagtgcaacagcgtgaaggacggcgccatctgctacaagcccaccaagagcaagaagctgagcagactgacctacagcagcagatgccccgccgccaaggagaacggcagcagatggatccagtacaagggccactgctacaagagcgaccaggccctgcacagcttcagcgaggccaagaagctgtgcagcaagcacgaccacagcgccaccatcgtgagcatcaaggacgaggacgagaacaagttcgtgagcagactgatgagagagaacaacaacatcaccatgagagtgtggctgggcctgagccagcacagcgtggaccagagctggagctggctggacggcagcgaggtgaccttcgtgaagtgggagaacaagagcaagagcggcgtgggcagatgcagcatgctgatcgccagcaacgagacctggaagaaggtggagtgcgagcacggcttcggcagagtggtgtgcaaggtgcccctggactgccccagcagcacctggatccagttccaggacagctgctacatcttcctgcaggaggccatcaaggtggagagcatcgaggacgtgagaaaccagtgcaccgaccacggcgccgacatgatcagcatccacaacgaggaggagaacgccttcatcctggacaccctgaagaagcagtggaagggccccgacgacatcctgctgggcatgttctacgacaccgacgacgccagcttcaagtggttcgacaacagcaacatgaccttcgacaagtggaccgaccaggacgacgacgaggacctggtggacacctgcgccttcctgcacatcaagaccggcgagtggaagaagggcaactgcgaggtgagcagcgtggagggcaccctgtgcaagaccgccatcccctacaagagaaagtacctgagcgacaaccacatcctgatcagcgccctggtgatcgccagcaccgtgatcctgaccgtgctgggcgccatcatctggttcctgtacaagaagcacagcgacagcagattcaccaccgtgttcagcaccgccccccagagcccctacaacgaggactgcgtgctggtggtgggcgaggagaacgagtaccccgtgcagttcgactag

SEQ ID NO: 22307 - DNA, 5454 bp, Artificial Sequence
  Description of Artificial Sequence: Synthetic coding sequence
atgagaaccggctgggccacccccagaagacccgccggcctgctgatgctgctgttctggttcttcgacctggccgagcccagcggcagagccgccaacgaccccttcaccatcgtgcacggcaacaccggcaagtgcatcaagcccgtgtacggctggatcgtggccgacgactgcgacgagaccgaggacaagctgtggaagtgggtgagccagcacagactgttccacctgcacagccagaagtgcctgggcctggacatcaccaagagcgtgaacgagctgagaatgttcagctgcgacagcagcgccatgctgtggtggaagtgcgagcaccacagcctgtacggcgccgccagatacagactggccctgaaggacggccacggcaccgccatcagcaacgccagcgacgtgtggaagaagggcggcagcgaggagagcctgtgcgaccagccctaccacgagatctacaccagagacggcaacagctacggcagaccctgcgagttccccttcctgatcgacggcacctggcaccacgactgcatcctggacgaggaccacagcggcccctggtgcgccaccaccctgaactacgagtacgacagaaagtggggcatctgcctgaagcccgagaacggctgcgaggacaactgggagaagaacgagcagttcggcagctgctaccagttcaacacccagaccgccctgagctggaaggaggcctacgtgagctgccagaaccagggcgccgacctgctgagcatcaacagcgccgccgagctgacctacctgaaggagaaggagggcatcgccaagatcttctggatcggcctgaaccagctgtacagcgccagaggctgggagtggagcgaccacaagcccctgaacttcctgaactgggaccccgacagacccagcgcccccaccatcggcggcagcagctgcgccagaatggacgccgagagcggcctgtggcagagcttcagctgcgaggcccagctgccctacgtgtgcagaaagcccctgaacaacaccgtggagctgaccgacgtgtggacctacagcgacaccagatgcgacgccggctggctgcccaacaacggcttctgctacctgctggtgaacgagagcaacagctgggacaaggcccacgccaagtgcaaggccttcagcagcgacctgatcagcatccacagcctggccgacgtggaggtggtggtgaccaagctgcacaacgaggacatcaaggaggaggtgtggatcggcctgaagaacatcaacatccccaccctgttccagtggagcgacggcaccgaggtgaccctgacctactgggacgagaacgagcccaacgtgccctacaacaagacccccaactgcgtgagctacctgggcgagctgggccagtggaaggtgcagagctgcgaggagaagctgaagtacgtgtgcaagagaaagggcgagaagctgaacgacgccagcagcgacaagatgtgcccccccgacgagggctggaagagacacggcgagacctgctacaagatctacgaggacgaggtgcccttcggcaccaactgcaacctgaccatcaccagcagattcgagcaggagtacctgaacgacctgatgaagaagtacgacaagagcctgagaaagtacttctggaccggcctgagagacgtggacagctgcggcgagtacaactgggccaccgtgggcggcagaagaagagccgtgaccttcagcaactggaacttcctggagcccgccagccccggcggctgcgtggccatgagcaccggcaagagcgtgggcaagtgggaggtgaaggactgcagaagcttcaaggccctgagcatctgcaagaagatgagcggccccctgggccccgaggaggccagccccaagcccgacgacccctgccccgagggctggcagagcttccccgccagcctgagctgctacaaggtgttccacgccgagagaatcgtgagaaagagaaactgggaggaggccgagagattctgccaggccctgggcgcccacctgagcagcttcagccacgtggacgagatcaaggagttcctgcacttcctgaccgaccagttcagcggccagcactggctgtggatcggcctgaacaagagaagccccgacctgcagggcagctggcagtggagcgacagaacccccgtgagcaccatcatcatgcccaacgagttccagcaggactacgacatcagagactgcgccgccgtgaaggtgttccacagaccctggagaagaggctggcacttctacgacgacagagagttcatctacctgagacccttcgcctgcgacaccaagctggagtgggtgtgccagatccccaagggcagaacccccaagacccccgactggtacaaccccgacagagccggcatccacggcccccccctgatcatcgagggcagcgagtactggttcgtggccgacctgcacctgaactacgaggaggccgtgctgtactgcgccagcaaccacagcttcctggccaccatcaccagcttcgtgggcctgaaggccatcaagaacaagatcgccaacatcagcggcgacggccagaagtggtggatcagaatcagcgagtggcccatcgacgaccacttcacctacagcagatacccctggcacagattccccgtgaccttcggcgaggagtgcctgtacatgagcgccaagacctggctgatcgacctgggcaagcccaccgactgcagcaccaagctgcccttcatctgcgagaagtacaacgtgagcagcctggagaagtacagccccgacagcgccgccaaggtgcagtgcagcgagcagtggatccccttccagaacaagtgcttcctgaagatcaagcccgtgagcctgaccttcagccaggccagcgacacctgccacagctacggcggcaccctgcccagcgtgctgagccagatcgagcaggacttcatcaccagcctgctgcccgacatggaggccaccctgtggatcggcctgagatggaccgcctacgagaagatcaacaagtggaccgacaacagagagctgacctacagcaacttccaccccctgctggtgagcggcagactgagaatccccgagaacttcttcgaggaggagagcagataccactgcgccctgatcctgaacctgcagaagagccccttcaccggcacctggaacttcaccagctgcagcgagagacacttcgtgagcctgtgccagaagtacagcgaggtgaagagcagacagaccctgcagaacgccagcgagaccgtgaagtacctgaacaacctgtacaagatcatccccaagaccctgacctggcacagcgccaagagagagtgcctgaagagcaacatgcagctggtgagcatcaccgacccctaccagcaggccttcctgagcgtgcaggccctgctgcacaacagcagcctgtggatcggcctgttcagccaggacgacgagctgaacttcggctggagcgacggcaagagactgcacttcagcagatgggccgagaccaacggccagctggaggactgcgtggtgctggacaccgacggcttctggaagaccgtggactgcaacgacaaccagcccggcgccatctgctactacagcggcaacgagaccgagaaggaggtgaagcccgtggacagcgtgaagtgccccagccccgtgctgaacaccccctggatccccttccagaactgctgctacaacttcatcatcaccaagaacagacacatggccaccacccaggacgaggtgcacaccaagtgccagaagctgaaccccaagagccacatcctgagcatcagagacgagaaggagaacaacttcgtgctggagcagctgctgtacttcaactacatggccagctgggtgatgctgggcatcacctacagaaacaagagcctgatgtggttcgacaagacccccctgagctacacccactggagagccggcagacccaccatcaagaacgagaagttcctggccggcctgagcaccgacggcttctgggacatccagaccttcaaggtgatcgaggaggccgtgtacttccaccagcacagcatcctggcctgcaagatcgagatggtggactacaaggaggagtacaacaccaccctgccccagttcatgccctacgaggacggcatctacagcgtgatccagaagaaggtgacctggtacgaggccctgaacatgtgcagccagagcggcggccacctggccagcgtgcacaaccagaacggccagctgttcctggaggacatcgtgaagagagacggcttccccctgtgggtgggcctgagcagccacgacggcagcgagagcagcttcgagtggagcgacggcagcaccttcgactacatcccctggaagggccagaccagccccggcaactgcgtgctgctggaccccaagggcacctggaagcacgagaagtgcaacagcgtgaaggacggcgccatctgctacaagcccaccaagagcaagaagctgagcagactgacctacagcagcagatgccccgccgccaaggagaacggcagcagatggatccagtacaagggccactgctacaagagcgaccaggccctgcacagcttcagcgaggccaagaagctgtgcagcaagcacgaccacagcgccaccatcgtgagcatcaaggacgaggacgagaacaagttcgtgagcagactgatgagagagaacaacaacatcaccatgagagtgtggctgggcctgagccagcacagcgtggactgccccagcagcacctggatccagttccaggacagctgctacatcttcctgcaggaggccatcaaggtggagagcatcgaggacgtgagaaaccagtgcaccgaccacggcgccgacatgatcagcatccacaacgaggaggagaacgccttcatcctggacaccctgaagaagcagtggaagggccccgacgacatcctgctgggcatgttctacgacaccgacgacgccagcttcaagtggttcgacaacagcaacatgaccttcgacaagtggaccgaccaggacgacgacgaggacctggtggacacctgcgccttcctgcacatcaagaccggcgagtggaagaagggcaactgcgaggtgagcagcgtggagggcaccctgtgcaagaccgccatcccctacaagagaaagtacctgagcgacaaccacatcctgatcagcgccctggtgatcgccagcaccgtgatcctgaccgtgctgggcgccatcatctggttcctgtacaagaagcacagcgacagcagattcaccaccgtgttcagcaccgccccccagagcccctacaacgaggactgcgtgctggtggtgggcgaggagaacgagtaccccgtgcagttcgactag

SEQ ID NO: 22308 - DNA, 498 bp, Artificial Sequence
  Description of Artificial Sequence: Synthetic coding sequence
atggccctgctggccctgctgctggtggtggccctgcccagagtgtggaccgacgccaacctgaccgccagacagagagaccccgaggacagccagagaaccgacgagggcgacaacagagtgtggtgccacgtgtgcgagagagagaacaccttcgagtgccagaaccccagaagatgcaagtggaccgagccctactgcgtgatcgccgccgtgaagatcttccccagattcttcatggtggccaagcagtgcagcgccggctgcgccgccatggagagacccaagcccgaggagaagagattcctgctggaggagcccatgcccttcttctacctgaagtgctgcaagatcagatactgcaacctggagggcccccccatcaacagcagcgtgttcaaggagtacgccggcagcatgggcgagagctgcggcggcctgtggctggccatcctgctgctgctggccagcatcgccgccggcctgagcctgagctag

SEQ ID NO: 22309 - DNA, 639 bp, Artificial Sequence
  Description of Artificial Sequence: Synthetic coding sequence
gacttcggctactgccccagagtgtactgcgagaaccagcccatgctgcccatcggcgtgctggtgatggtgggcttcaccgtgggcaaggtgcccgtgcccgacatcagaacctgccacttctgcctggtggaggaccccagcgtgggctgcatcagcggcagcgagaagtgcaccatcagcagcagcagcctgtgcatggtgatcaccatctactacgacgtgaaggtgagattcatcgtgagaggctgcggccagtacatcagctacagatgccaggagaagagaaacacctacttcgccgagtactggtaccaggcccagtgctgccagtacgactactgcaacagctggagcagcccccagctgcagagcagcctgcccgagccccacgacagacccctggccctgcccctgagcgacagccagatccagtggttctaccaggccctgaacctgagcctgcccctgcccaacttccacgccggcaccgagcccgacggcctggaccccatggtgaccctgagcctgaacctgggcctgagcttcgccgagctgtgcagaatgtacctgttcctgaacagcagcggcctgctggtgctgccccaggccggcctgctgaccccccaccccagctag

SEQ ID NO: 22310 - DNA, 639 bp, Artificial Sequence
  Description of Artificial Sequence: Synthetic coding sequence
gacttcggctactgccccagagtgtactgcgagaaccagcccatgctgcccatcggcgtgctggtgatggtgggcttcaccgtgggcaaggtgcccgtgcccgacatcagaacctgccacttctgcctggtggaggaccccagcgtgggctgcatcagcggcagcgagaagtgcaccatcagcagcagcagcctgtgcatggtgatcaccatctactacgacgtgaaggtgagattcatcgtgagaggctgcggccagtacatcagctacagatgccaggagaagagaaacacctacttcgccgagtactggtaccaggcccagtgctgccagtacgactactgcaacagctggagcagcccccagctgcagagcagcctgcccgagccccacgacagacccctggccctgcccctgagcgacagccagatccagtggttctaccaggccctgaacctgagcctgcccctgcccaacttccacgccggcaccgagcccgacggcctggaccccatggtgaccctgagcctgaacctgggcctgagcttcgccgagctgagaagaatgtacctgttcctgaacagcagcggcctgctggtgctgccccaggccggcctgctgaccccccaccccagctag

SEQ ID NO: 22311 - DNA, 687 bp, Artificial Sequence
  Description of Artificial Sequence: Synthetic coding sequence
atgagcagcagcgaggaggtgagctggatcagctggttctgcggcctgagaggcaacgagttcttctgcgaggtggacgaggactacatccaggacaagttcaacctgaccggcctgaacgagcaggtgccccactacagacaggccctggacatgatcctggacctggagcccgacgaggagctggaggacaaccccaaccagagcgacctgatcgagcaggccgccgagatgctgtacggcctgatccacgccagatacatcctgaccaacagaggcatcgcccagatgctggagaagtaccagcagggcgacttcggctactgccccagagtgtactgcgagaaccagcccatgctgcccatcggcctgagcgacatccccggcgaggccatggtgaagctgtactgccccaagtgcatggacgtgtacacccccaagagcagcagacaccaccacaccgacggcgcctacttcggcaccggcttcccccacatgctgttcatggtgcaccccgagtacagacccaagagacccgccaaccagttcgtgcccagcagctgcagcagacaccccgacgtgcccctgctgcccagaagaagacccttctgcagaatgcacttcagactgagagaggtgtaccaccagcagctgatccccgtgcacggcgaccaccacctgctgtag

SEQ ID NO: 22312 - DNA, 639 bp, Artificial Sequence; identical to SEQ ID NO: 22310
  Description of Artificial Sequence: Synthetic coding sequence

SEQ ID NO: 22313 - DNA, 639 bp, Artificial Sequence; identical to SEQ ID NO: 22309
  Description of Artificial Sequence: Synthetic coding sequence

SEQ ID NO: 22314 - DNA, 687 bp, Artificial Sequence; identical to SEQ ID NO: 22311
  Description of Artificial Sequence: Synthetic coding sequence

SEQ ID NO: 22315 - DNA, 606 bp, Artificial Sequence
  Description of Artificial Sequence: Synthetic coding sequence
atgaaggtgcacatgctggtgggcgtgctggtgatggtgggcttcaccgtgggcaaggtgcccgtgcccgacatcagaacctgccacttctgcctggtggaggaccccagcgtgggctgcatcagcggcagcgagaagtgcaccatcagcagcagcagcctgtgcatggtgatcaccatctactacgacgtgaaggtgagattcatcgtgagaggctgcggccagtacatcagctacagatgccaggagaagagaaacacctacttcgccgagtactggtaccaggcccagtgctgccagtacgactactgcaacagctggagcagcccccagctgcagagcagcctgcccgagccccacgacagacccctggccctgcccctgagcgacagccagatccagtggttctaccaggccctgaacctgagcctgcccctgcccaacttccacgccggcaccgagcccgacggcctggaccccatggtgaccctgagcctgaacctgggcctgagcttcgccgagctgtgcagaatgtacctgttcctgaacagcagcggcctgctggtgctgccccaggccggcctgctgaccccccaccccagctag

SEQ ID NO: 22316 - DNA, 606 bp, Artificial Sequence; identical to SEQ ID NO: 22315
  Description of Artificial Sequence: Synthetic coding sequence

SEQ ID NO: 22317 - DNA, 303 bp, Artificial Sequence
  Description of Artificial Sequence: Synthetic coding sequence
atgggcaccagcagcatcttcctgtgcgtgctgttcctgtgcggcgccctgggcctgaccatgagccccgccagaggcagactgagatgctacatctgcggcttcaccaagccctgccaccccgtgcccaccgagtgcagagacgacgaggcctgcggcatcagcatcggcaccagcggcagaaccctggtgcagtggcccttcagcagaagactgcccaccagcatccaccccgccttccccgtggcccccgccagcgcctgcctgttccaccccaccgaccagagcgagatcaccgagtag

SEQ ID NO: 22318 - DNA, 378 bp, Artificial Sequence
  Description of Artificial Sequence: Synthetic coding sequence
atgggcaccagcagcatcttcctgtgcgtgctgttcctgtgcggcgccctgggcctgaccatgagccccgccagaggcagactgagatgctacatctgcggcttcaccaagccctgccaccccgtgcccaccgagtgcagagacgacgaggcctgcggcatcagcatcggcaccagcggcaagagctgcctgagcagagcccagtgccccctgcccggctacgccacctactggctgcacagctacaccctgtggcaccactgctgcgagcaggacctgtgcaacatcgccgccagcccccagcagctgaccagcctgctggccagcctgcccctgttcgtggccagcttcgccggcagaggccacctgctgcactag

SEQ ID NO: 22319 - DNA, 303 bp, Artificial Sequence; identical to SEQ ID NO: 22317
  Description of Artificial Sequence: Synthetic coding sequence

SEQ ID NO: 22320 - DNA, 201 bp, Artificial Sequence
  Description of Artificial Sequence: Synthetic coding sequence
atgggcaccagcagcatcttcctgtgcgtgctgttcctgtgcggcgccctgggcctgaccatgagccccgccagaggcagactgagatgctacatctgcggcttcaccaagccctgccaccccgtgcccaccgagtgcagagacgacgaggcctgcggcatcagcatcggcaccagcgaccagagcgagatcaccgagtag

SEQ ID NO: 22321 - DNA, 201 bp, Artificial Sequence; identical to SEQ ID NO: 22320
  Description of Artificial Sequence: Synthetic coding sequence

SEQ ID NO: 22322 - DNA, 201 bp, Artificial Sequence; identical to SEQ ID NO: 22320
  Description of Artificial Sequence: Synthetic coding sequence

SEQ ID NO: 22323 - DNA, 303 bp, Artificial Sequence; identical to SEQ ID NO: 22317
  Description of Artificial Sequence: Synthetic coding sequence

SEQ ID NO: 22324 - DNA, 303 bp, Artificial Sequence; identical to SEQ ID NO: 22317
  Description of Artificial Sequence: Synthetic coding sequence

SEQ ID NO: 22325 - DNA, 201 bp, Artificial Sequence; identical to SEQ ID NO: 22320
  Description of Artificial Sequence: Synthetic coding sequence

SEQ ID NO: 22326 - DNA, 201 bp, Artificial Sequence; identical to SEQ ID NO: 22320
  Description of Artificial Sequence: Synthetic coding sequence

SEQ ID NO: 22327 - DNA, 303 bp, Artificial Sequence; identical to SEQ ID NO: 22317
  Description of Artificial Sequence: Synthetic coding sequence

SEQ ID NO: 22328 - DNA, 201 bp, Artificial Sequence; identical to SEQ ID NO: 22320
  Description of Artificial Sequence: Synthetic coding sequence

SEQ ID NO: 22329 - DNA, 303 bp, Artificial Sequence; identical to SEQ ID NO: 22317
  Description of Artificial Sequence: Synthetic coding sequence

SEQ ID NO: 22330 - DNA, 387 bp, Artificial Sequence
  Description of Artificial Sequence: Synthetic coding sequence
atgggcaccagcagcatcttcctgtgcgtgctgttcctgtgcggcgccctgggcctgaccatgagccccgccagaggcagactgagatgctacatctgcggcttcaccaagccctgccaccccgtgcccaccgagtgcagagacgacgaggcctgcggcatcagcatcggcaccagcgtgaagaagctgcccctgaagggccccgtgcccagcgccagactgtgccacctgctggccgccctgctgcacagcgtggcccccctgctgagagccggccccgtgcagcacagcagattccccaccgccgcccaccagccccccagactgcccgcccccctgtgcggccagctgagatgggagagaacccccccccccctggccagctag

SEQ ID NO: 22331 - DNA, 378 bp, Artificial Sequence; identical to SEQ ID NO: 22318
  Description of Artificial Sequence: Synthetic coding sequence

SEQ ID NO: 22332 - DNA, 378 bp, Artificial Sequence; identical to SEQ ID NO: 22318
  Description of Artificial Sequence: Synthetic coding sequence

SEQ ID NO: 22333 - DNA, 378 bp, Artificial Sequence; identical to SEQ ID NO: 22318
  Description of Artificial Sequence: Synthetic coding sequence

SEQ ID NO: 22334 - DNA, 378 bp, Artificial Sequence; identical to SEQ ID NO: 22318
  Description of Artificial Sequence: Synthetic coding sequence

SEQ ID NO: 22335 - DNA, 378 bp, Artificial Sequence; identical to SEQ ID NO: 22318
  Description of Artificial Sequence: Synthetic coding sequence

SEQ ID NO: 22336 - DNA, 378 bp, Artificial Sequence; identical to SEQ ID NO: 22318
  Description of Artificial Sequence: Synthetic coding sequence

SEQ ID NO: 22337 - DNA, 894 bp, Artificial Sequence
  Description of Artificial Sequence: Synthetic coding sequence
atggccgtgctgttcctgctgctgttcctgtgcggcaccccccaggccgccgacaacatgcaggccatctacgtggccctgggcgaggccgtggagctgccctgccccagcccccccaccctgcacggcgacgagcacctgagctggttctgcagccccgccgccggcagcttcaccaccctggtggcccaggtgcaggtgggcagacccgcccccgaccccggcaagcccggcagagagagcagactgagactgctgggcaactacagcctgtggctggagggcagcaaggaggaggacgccggcagatactggtgcaccgtgctgggccagcaccacaactaccagaactggagagtgtacgacgtgctggtgctgaagggcagccagctgagcgccagagccgccgacggcagcccctgcaacgtgctgctgtgcagcgtggtgcccagcagaagaatggacagcgtgacctggcaggagggcaagggccccgtgagaggcagagtgcagagcttctggggcagcgaggccgccctgctgctggtgtgccccggcgagggcctgagcgagcccagaagcagaagacccagaatcatcagatgcctgatgacccacaacaagggcgtgagcttcagcctggccgccagcatcgacgccagccccgccctgtgcgcccccagcaccggctgggacatgccctggatcctgatgctgctgctgaccatgggccagggcgtggtgatcctggccctgagcatcgtgctgtggagacagagagtgagaggcgcccccggcagagacgccagcatcccccagttcaagcccgagatccaggtgtacgagaacatccacctggccagactgggcccccccgcccacaagcccagatag

SEQ ID NO: 22338 - DNA, 894 bp, Artificial Sequence; identical to SEQ ID NO: 22337
  Description of Artificial Sequence: Synthetic coding sequence

SEQ ID NO: 22339 - DNA, 1149 bp, Artificial Sequence
  Description of Artificial Sequence: Synthetic coding sequence
atggccgtgctgttcctgctgctgttcctgtgcggcaccccccaggccgccgacaacatgcaggccatctacgtggccctgggcgaggccgtggagctgccctgccccagcccccccaccctgcacggcgacgagcacctgagctggttctgcagccccgccgccggcagcttcaccaccctggtggcccaggtgcaggtgggcagacccgcccccgaccccggcaagcccggcagagagagcagactgagactgctgggcaactacagcctgtggctggagggcagcaaggaggaggacgccggcagatactggtgcaccgtgctgggccagcaccacaactaccagaactggagagtgtacgacgtgctggtgctgaagggcagccagctgagcgccagagccgccgacggcagcccctgcaacgtgctgctgtgcagcgtggtgcccagcagaagaatggacagcgtgacctggcaggagggcaagggccccgtgagaggcagagtgcagagcttctggggcagcgaggccgccctgctgctggtgtgccccggcgagggcctgagcgagcccagaagcagaagacccagaatcatcagatgcctgatgacccacaacaagggcgtgagcttcagcctggccgccagcatcgacgccagccccgccctgtgcgcccccagcaccggctgggacatgccctggatcctgatgctgctgctgaccatgggccagggcgtggtgatcctggccctgagcatcgtgctgtggagacagagagtgagaggcgcccccggcagaggcaacagaatgagatgctacaactgcggcggcagccccagcagcacctgcaaggaggccgtgaccacctgcggcgagggcagaccccagcccggcctggagcagatcaagctgcccggcaacccccccgtgaccctgatccaccagcaccccgcctgcgtggccgcccaccactgcaaccaggtggagaccgagagcgtgggcgacgtgacctaccccgcccacagagactgctacctgggcgacctgtgcaacagcgccgtggccagccacgtggcccccgccggcatcctggccgccgccgccaccgccctgacctgcctgctgcccggcctgtggagcggctag

SEQ ID NO: 22340 - DNA, 237 bp, Artificial Sequence; identical to SEQ ID NO: 18960
  Description of Artificial Sequence: Synthetic coding sequence

SEQ ID NO: 22341 - DNA, 1572 bp, Artificial Sequence
  Description of Artificial Sequence: Synthetic coding sequence
atggagaccatgaagagcaaggccaactgcgcccagaaccccaactgcaacatcatgatcttccaccccaccaaggaggagttcaacgacttcgacaagtacatcgcctacatggagagccagggcgcccacagagccggcctggccaagatcatcccccccaaggagtggaaggccagagagacctacgacaacatcagcgagatcctgatcgccacccccctgcagcaggtggccagcggcagagccggcgtgttcacccagtaccacaagaagaagaaggccatgaccgtgggcgagtacagacacctggccaacagcaagaagtaccagacccccccccaccagaacttcgaggacctggagagaaagtactggaagaacagaatctacaacagccccatctacggcgccgacatcagcggcagcctgttcgacgagaacaccaagcagtggaacctgggccacctgggcaccatccaggacctgctggagaaggagtgcggcgtggtgatcgagggcgtgaacaccccctacctgtacttcggcatgtggaagaccaccttcgcctggcacaccgaggacatggacctgtacagcatcaactacctgcacctgggcgagcccaagacctggtacgtggtgccccccgagcacggccagagactggagagactggccagagagctgttccccggcagcagcagaggctgcggcgccttcctgagacacaaggtggccctgatcagccccaccgtgctgaaggagaacggcatccccttcaacagaatcacccaggaggccggcgagttcatggtgaccttcccctacggctaccacgccggcttcaaccacggcttcaactgcgccgaggccatcaacttcgccacccccagatggatcgactacggcaagatggccagccagtgcagctgcggcgaggccagagtgaccttcagcatggacgccttcgtgagaatcctgcagcccgagagatacgacctgtggaagagaggccaggacagagccgtggtggaccacatggagcccagagtgcccgccagccaggagctgagcacccagaaggaggtgcagctgcccagaagagccgccctgggcctgagacagctgcccagccactgggccagacacagcccctggcccatggccgccagaagcggcaccagatgccacaccctggtgtgcagcagcctgcccagaagaagcgccgtgagcggcaccgccacccagcccagagccgccgccgtgcacagcagcaagaagcccagcagcacccccagcagcacccccggccccagcgcccagatcatccaccccagcaacggcagaagaggcagaggcagacccccccagaagctgagagcccaggagctgaccctgcagacccccgccaagagacccctgctggccggcaccacctgcaccgccagcggccccgagcccgagcccctgcccgaggacggcgccctgatggacaagcccgtgcccctgagccccggcctgcagcaccccgtgaaggccagcggctgcagctgggcccccgtgccctag

SEQ ID NO: 22342 - DNA, 780 bp, Artificial Sequence
  Description of Artificial Sequence: Synthetic coding sequence
atgaagcacagcaagaagacctacgacagcttccaggacgagctggaggactacatcaaggtgcagaaggccagaggcctggagcccaagacctgcttcagaaagatgaagggcgactacctggagacctgcggctacaagggcgaggtgaacagcagacccacctacagaatgttcgaccagagactgcccagcgagaccatccagacctaccccagaagctgcaacatcccccagaccgtggagaacagactgccccagtggctgcccgcccacgacagcagactgagactggacagcctgagctactgccagttcaccagagactgcttcagcgagaagcccgtgcccctgaacttcaaccagcaggagtacatctgcggcagccacggcgtggagcacagagtgtacaagcacttcagcagcgacaacagcaccagcacccaccaggccagccacaagcagatccaccagaagagaaagagacaccccgaggagggcagagagaagagcgaggaggagagaagcaagcacaagagaaagaagagctgcgaggagatcgacctggacaagcacaagagcatccagagaaagaagaccgaggtggagatcgagaccgtgcacgtgagcaccgagaagctgaagaacagaaaggagaagaagagcagagacgtggtgagcaagaaggaggagagaaagagaaccaagaagaagaaggagcagggccaggagagaaccgaggaggagatgctgtgggaccagagcatcctgggcttctag

SEQ ID NO: 22343 - DNA, 684 bp, Artificial Sequence
  Description of Artificial Sequence: Synthetic coding sequence
atggccagccccagcagacagcccccccccggcggcagcggcctgctgcagggcagcagagccagaagctacggcagcctggtgcagagcgcctgcagccccgtgagagagagaagactggagcaccagctggagcccggcgacaccctggccggcctggccctgaagtacggcgtgaccatggagcagatcaagagagccaacagactgtacaccaacgacagcatcttcctgaagaagaccctgtacatccccatcctgaccgagcccagagacctgttcaacggcctggacagcgaggaggagaaggacggcgaggagaaggtgcaccccagcaacagcgaggtgtggccccacagcaccgagagaaagaagcaggagaccggcgccggcagagccaacggcgaggtgctgcccacccccggccaggagacccccacccccatccacgacctgagcgccagcgacttcctgaagaagctggacagccagatcagcctgagcaagaaggccgccgcccagaagctgaagaagggcgagaacggcgtgcccggcgaggacgccggcctgcacctgagcagcccctggatgcagcagagagccgtgctgggccccgtgcccctgaccagaaccagcagaaccagaaccctgagagaccaggaggacgagatcttcaagctgtag

SEQ ID NO: 22344 - DNA, 540 bp, Artificial Sequence
  Description of Artificial Sequence: Synthetic coding sequence
atgagaagcggccccctgagaatcagcgagtggaagatggagcagatcaagagagccaacagactgtacaccaacgacagcatcttcctgaagaagaccctgtacatccccatcctgaccgagcccagagacctgttcaacggcctggacagcgaggaggagaaggacggcgaggagaaggtgcaccccagcaacagcgaggtgtggccccacagcaccgagagaaagaagcaggagaccggcgccggcagagccaacggcgaggtgctgcccacccccggccaggagacccccacccccatccacgacctgagcgccagcgacttcctgaagaagctggacagccagatcagcctgagcaagaaggccgccgcccagaagctgaagaagggcgagaacggcgtgcccggcgaggacgccggcctgcacctgagcagcccctggatgcagcagagagccgtgctgggccccgtgcccctgaccagaaccagcagaaccagaaccctgagagaccaggaggacgagatcttcaagctgtag

SEQ ID NO: 22345 - DNA, 648 bp, Artificial Sequence
  Description of Artificial Sequence: Synthetic coding sequence
atggccgacagcagccccgccctgagcctgagagagggcggccccagagcccccagacccagcgcccccagccccccccccagaagcagaagcggcagcgagagcgaggaggccgagctgagcctgagcctggccagaaccaagaccagaagctacggcagcaccgccagcgtgagagcccccctgggcgccggcgtgatcgagagacacgtggagcacagagtgagagccggcgacaccctgcagggcatcgccctgaagtacggcgtgaccatggagcagatcaagagagccaacaagctgttcaccaacgactgcatcttcctgaagaagaccctgaacatccccgtgatcagcgagaagcccctgctgttcaacggcctgaacagcatcgacagccccgagaacgagaccgccgacaacagcttcagccaggaggaggagcccgtggtggccggcgaggacctgcccccccccagcccccaggagagcgacgtgcagcccgtgcagcccgaggaggtgagcgccagagacttcctgcagagactggacctgcagatcaagctgagcacccaggccgccaagaagctgaaggaggagagcagagacgaggagagcccctacgccaccagcctgtaccacagctag

SEQ ID NO: 22346 - DNA, 375 bp, Artificial Sequence
  Description of Artificial Sequence: Synthetic coding sequence
atggagcagatcaagagagccaacaagctgttcaccaacgactgcatcttcctgaagaagaccctgaacatccccgtgatcagcgagaagcccctgctgttcaacggcctgaacagcatcgacagccccgagaacgagaccgccgacaacagcttcagccaggaggaggagcccgtggtggccggcgaggacctgcccccccccagcccccaggagagcgacgtgcagcccgtgcagcccgaggaggtgagcgccagagacttcctgcagagactggacctgcagatcaagctgagcacccaggccgccaagaagctgaaggaggagagcagagacgaggagagcccctacgccaccagcctgtaccacagctag

SEQ ID NO: 22347 - DNA, 375 bp, Artificial Sequence; identical to SEQ ID NO: 22346
  Description of Artificial Sequence: Synthetic coding sequence

SEQ ID NO: 22348 - DNA, 495 bp, Artificial Sequence
  Description of Artificial Sequence: Synthetic coding sequence
atgaagatggtgatgcccagctggttcgacctgatgggcctgagccccgacgcccccgaggacgaggccggcatcaagaaggccgccgagaacatcaaggccctgatcgagcacgagatgaagaacggcatccccgccaacagaatcgtgctgggcggcttcagccagggcggcgccctgagcctgtacaccgccctgacctgcccccaccccctggccggcatcgtggccctgagctgctggctgcccctgcacagagccttcccccaggccgccaacggcagcgccaaggacctggccatcctgcagtgccacggcgagctggaccccatggtgcccgtgagattcggcgccctgaccgccgagaagctgagaagcgtggtgacccccgccagagtgcagttcaagacctaccccggcgtgatgcacagcagctgcccccaggagatggccgccgtgaaggagttcctggagaagctgctgccccccgtgtag

SEQ ID NO: 22349 - DNA, 543 bp, Artificial Sequence
  Description of Artificial Sequence: Synthetic coding sequence
atgtgcggcaacaccatgagcgtgcccctgctgaccgacgccgccaccgtgagcggcgccgagagagagaccgccgccgtgatcttcctgcacggcctgggcgacaccggccacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggcatcaagaaggccgccgagaacatcaaggccctgatcgagcacgagatgaagaacggcatccccgccaacagaatcgtgctgggcggcttcagccagggcggcgccctgagcctgtacaccgccctgacctgcccccaccccctggccggcatcgtggccctgagctgctggctgcccctgcacagagccttcccccaggtgaacgtgcccaccgacccccccgccctgtgcgtgtgcatcctggtggcctggggcctgctgcagcactag

SEQ ID NO: 22350 - DNA, 549 bp, Artificial Sequence
  Description of Artificial Sequence: Synthetic coding sequence
atgtgcggcaacaccatgagcgtgcccctgctgaccgacgccgccaccgtgagcggcgccgagagagagaccgccgccgtgatcttcctgcacggcctgggcgacaccggccacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggcatcaagaaggccgccgagaacatcaaggccctgatcgagcacgagatgaagaacggcatccccgccaacagaatcgtgctgggcggcttcagccagggcggcgccctgagcctgtacaccgccctgacctgcccccaccccctggccggcatcgtggccctgagctgctggctgcccctgcacagagccttcccccagggccccgtgcaggacatccccggctgccacgcccagctgctgagcagcggcgacggcagctgcgagggcatcagctag

SEQ ID NO: 22351 - DNA, 414 bp, Artificial Sequence
  Description of Artificial Sequence: Synthetic coding sequence
atgtgcggcaacaccatgagcgtgcccctgctgaccgacgccgccaccgtgagcggcgccgagagagagaccgccgccgtgatcttcctgcacggcctgggcgacaccggccacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggcatcaagaaggccgccgagaacagaagaggccccgtgcccctgcacggcccccacctgcccccccccagcggctggcacagaggcgtggagctgctggccgccagcgcccccggcctgccccccggcgagtgcccccactag

SEQ ID NO: 22352 - DNA, 627 bp, Artificial Sequence
  Description of Artificial Sequence: Synthetic coding sequence
atgctgcccccctgcctggagctgagcggcaagagacccagacacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggcatcaagaaggccgccgagaacatcaaggccctgatcgagcacgagatgaagaacggcatccccgccaacagaatcgtgctgggcggcttcagccagggcggcgccctgagcctgtacaccgccctgacctgcccccaccccctggccggcatcgtggccctgagctgctggctgcccctgcacagagccttcccccaggccgccaacggcagcgccaaggacctggccatcctgcagtgccacggcgagctggaccccatggtgcccgtgagattcggcgccctgaccgccgagaagctgagaagcgtggtgacccccgccagagtgcagttcaagacctaccccggcgtgatgcacagcagctgcccccaggagatggccgccgtgaaggagttcctggagaagctgctgccccccgtgtag

SEQ ID NO: 22353 - DNA, 696 bp, Artificial Sequence
  Description of Artificial Sequence: Synthetic coding sequence
atgtgcggcaacaccatgagcgtgcccctgctgaccgacgccgccaccgtgagcggcgccgagagagagaccgccgccgtgatcttcctgcacggcctgggcgacaccggccacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggcatcaagaaggccgccgagaacatcaaggccctgatcgagcacgagatgaagaacggcatccccgccaacagaatcgtgctgggcggcttcagccagggcggcgccctgagcctgtacaccgccctgacctgcccccaccccctggccggcatcgtggccctgagctgctggctgcccctgcacagagccttcccccaggccgccaacggcagcgccaaggacctggccatcctgcagtgccacggcgagctggaccccatggtgcccgtgagattcggcgccctgaccgccgagaagctgagaagcgtggtgacccccgccagagtgcagttcaagacctaccccggcgtgatgcacagcagctgcccccaggagatggccgccgtgaaggagttcctggagaagctgctgccccccgtgtag

SEQ ID NO: 22354 - DNA, 405 bp, Artificial Sequence
  Description of Artificial Sequence: Synthetic coding sequence
atgtgcggcaacaccatgagcgtgcccctgctgaccgacgccgccaccgtgagcggcgccgagagagagaccgccgccgtgatcttcctgcacggcctgggcgacaccggccacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggcatcaagaaggccgccgagaacagaagaggccccgtgcccctgcacggcccccacctgcccccccccagcggctggcacagaggcgtggagctgctggccgccagcgcccccggcctgccccccggcagctag

SEQ ID NO: 22355 - DNA, 489 bp, Artificial Sequence
  Description of Artificial Sequence: Synthetic coding sequence
atgctgcccccctgcctggagctgagcggcaagagacccagacacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggcatcaagaaggccgccgagaacatcaaggccctgatcgagcacgagatgaagaacggcatccccgccaacagaatcgtgctgggcggcttcagccagggcggcgccctgagcctgtacaccgccctgacctgcccccaccccctggccggcatcgtggccctgagctgctggctgcccctgcacagagccttcccccaggccgccaacggcagcgccaaggacctggccatcctgcagtgccacggcgagctggaccccatggtgcccgtgagattcggcgcctag

SEQ ID NO: 22356 - DNA, 276 bp, Artificial Sequence
  Description of Artificial Sequence: Synthetic coding sequence
atgtgcggcaacaccatgagcgtgcccctgctgaccgacgccgccaccgtgagcggcgccgagagagagaccgccgccgtgatcttcctgcacggcctgggcgacaccggccacagctgggccgacgccctgagcaccatcagactgccccacgtgaagtacatctgcccccacgcccccagaatccccgtgaccctgaacatgaagatggtgatgcccagctggttcgacctgatgggcctgagccccgacgcccccgaggacgaggccggctag

SEQ ID NO: 22357 - DNA, 1476 bp, Artificial Sequence
  Description of Artificial Sequence: Synthetic coding sequence
atgaagatggccgcccccaccgccaacaaggccgccagcctgggctgcaacaacaagcccgccttccccgagctggacttcagaagcggcgccagagtggaggagctgaacaagctgatccaggagttcaccaagcacgaccagagagagtacgacgaccagagagccctggagatccacaccgccaaggacttcatcttcagcatgctgggcatggtgcagaagctggaccagaagctgcccgtggccaacgagtacctgctgctgagcggcggcgtgagagagggcgtggtggacctggacctggacgagctgaacgtgtacgccagaggcaccgactacgacatggacttcaccctgctggtgcccgccctgaagctgcacgacagaaaccagcccgtgaccctggacatgagacacagcgccctgtgccacagctggctgagcctgagactgttcgacgagggcaccatcagcaagtggaaggactgctgcaccatcgtggaccacatcaacggcgccaccaactacttcttcagccccaccaaggtggccgactggttctacgacagcatcagcatcgtgctgagcgagatccagaagaagccccagagaggcatgcccaaggtggagaaggtggagaagaacggcaccatcatcagcatcatcctgggcgtgggcagcagcagaatgctgtacgacatcgtgcccgtggtgagcttcaagggctggcccgccgtggcccagagctggctgatggagaaccacttctgggacggcaagatcaccgaggaggaggtgatcagcggcttctacctggtgcccgcctgcagctacaagggcaagaaggacaacgagtggagactgagcttcgccagaagcgaggtgcagctgaagaagtgcatcagcagcagcctgatgcaggcctaccaggcctgcaaggccatcatcatcaagctgctgagcagacccaaggccatcagcccctaccacctgagaagcatgatgctgtgggcctgcgacagactgcccgccaactacctggcccaggaggactacgccgcccacttcctgctgggcctgatcgacgacctgcagcactgcctggtgaacaagatgtgccccaactacttcatcccccagtgcaacatgctggagcacctgagcgaggagaccgtgatgctgcacgccagaaagctgagcagcgtgagaagcgaccccgccgagcacctgagaaccgccatcgagcacgtgaaggccgccaacagactgaccctggagctgcagagaagaggcagcaccaccagcatccccagcccccagagcgacggcggcgaccccaaccagcccgacgacagactggccaagaagctgcagcagctggtgaccgagaaccccggcaagagcatcagcgtgttcatcaaccccgacgacgtgaccagaccccacttcagaatcgacgacaagttcttctag

SEQ ID NO: 22358 - DNA, 1089 bp, Artificial Sequence
  Description of Artificial Sequence: Synthetic coding sequence
atgaagtacctgaccgtgggcgacctggaggactgcctgctgaacaaggtggacctgagaagacagcagatcagccaggccgtggaggaggtgcagaaggtggtgcaccacctgaccaccaacatcagcaaccaggacatcagattccaggccgtgccctacagcgacacctacaacgagaacatcaaggtgctggcccccagccagttcctggtgaccgtgcccatcaagggcctggccggctacagagaggccagagagcagcactggagatactacaccctgcagggcaccagactgccctgccccctgagagaccccgagggcctgcagcagtggctggaggtggagcagttcatgaagagcctgtggcagtggcacgagaccgacgtgaacatcgacggcgacatcgtgcccgccaaggtgctgctggtgttcagaaagctggtggagaacgccgtgagaacctgccacctgagcggcaaggtgagcctgctgggcaacagaagcgccgtgtgggtggccgtggagaccagcgcctaccaggtggagctggagctggtgcccgccgtggagatccccaccacctggagcaagaaggccagatggcccagatgcctgcagagatggcccagccaggagagagtggagtgcatcaagagcttcggcttcaacctgctggcctgcagcaactaccactggcagctgagcttcctgagagccgagcaggtgctgctggagcagctggacgaggacggcggctgcagaagaaagtgcttccaggtgatgagacacctgaaggaggacatctggtgccccggcaacagacccgtgatcaccagccaccacctgcagaccgtgctgttctggacctgcgagaagtacccccacttcaaggactggcaggtgttcagcaaggccttcctgagactggtgagaaagctgcacaagtgcgtgagccagcacttcctgaagcactacttcgtgagaaacagcaacctgttccagtgcaccaaccccaccgagctggacaccgtggcccagaagctggccaccttcctgaagaacccccagatcggccccccctag

SEQ ID NO: 22359 - DNA, 4371 bp, Artificial Sequence
  Description of Artificial Sequence: Synthetic coding sequence
atgagactgcccctgctgctggtgttcgccagcgtgatccccggcgccgtgctgctgctggacaccagacagttcctgatctacaacgaggaccacaagagatgcgtggacgccgtgagccccagcgccgtgcagaccgccgcctgcaaccaggacgccgagagccagaagttcagatgggtgagcgagagccagatcatgagcgtggccttcaagctgtgcctgggcgtgcccagcaagaccgactgggtggccatcaccctgtacgcctgcgacagcaagagcgagttccagaagtgggagtgcaagaacgacaccctgctgggcatcaagggcgaggacctgttcttcaactacggcaacagacaggagaagaacatcatgctgtacaagggcagcggcctgtggagcagatggaagatctacggcaccaccgacaacctgtgcagcagaggctacgaggccatgtacaccctgctgggcaacgccaacggcgccacctgcgccttccccttcaagttcgagaacaagtggtacgccgactgcaccagcgccggcagaagcgacggctggctgtggtgcggcaccaccaccgactacgacaccgacaagctgttcggctactgccccctgaagttcgagggcagcgagagcctgtggaacaaggaccccctgaccagcgtgagctaccagatcaacagcaagagcgccctgacctggcaccaggccagaaagagctgccagcagcagaacgccgagctgctgagcatcaccgagatccacgagcagacctacctgaccggcctgaccagcagcctgaccagcggcctgtggatcggcctgaacagcctgagcttcaacagcggctggcagtggagcgacagaagccccttcagatacctgaactggctgcccggcagccccagcgccgagcccggcaagagctgcgtgagcctgaaccccggcaagaacgccaagtgggagaacctggagtgcgtgcagaagctgggctacatctgcaagaagggcaacaccaccctgaacagcttcgtgatccccagcgagagcgacgtgcccacccactgccccagccagtggtggccctacgccggccactgctacaagatccacagagacgagaagaagatccagagagacgccctgaccacctgcagaaaggagggcagcgacctggccagcatccacaccatcgaggagttcgacttcatcatcagccagctgggctacgagcccaacgacgagctgtggatcggcctgaacgacatcaagatccagatgtacttcgagtggagcgacggcacccccgtgaccttcaccaagtggctgagaggcgagcccagccacgagaacaacagacaggaggactgcgtggtgatgaagggcaaggacggctactgggccgacagaggctgcgagtggcccctgggctacatctgcaagatgaagagcagaagccagggccccgagatcgtggaggtggagaagggctgcagaaagggctggaagaagcaccacttctactgctacatgatcggccacaccctgagcaccttcgccgaggccaaccagacctgcaacaacgagaacgcctacctgaccaccatcgaggacagatacgagcaggccttcctgaccagcttcgtgggcctgagacccgagaagtacttctggaccggcctgagcgacatccagaccaagggcaccttccagtggaccatcgaggaggaggtgagattcacccactggaacagcgacatgcccggcagaaagcccggctgcgtggccatgagaaccggcatcgccggcggcctgtgggacgtgctgaagtgcgacgagaaggccaagttcgtgtgcaagcactgggccgagggcgtgacccacccccccaagcccaccaccacccccgagcccaagtgccccgaggactggggcgccagcagcagaaccagcctgtgcttcaagctgtacgccaagggcaagcacgagaagaagacctggttcgagagcagagacttctgcagagccctgggcggcgacctggccagcatcaacaacaaggaggagcagcagaccatctggagactgatcaccgccagcggcagctaccacaagctgttctggctgggcctgacctacggcagccccagcgagggcttcacctggagcgacggcagccccgtgagctacgagaactgggcctacggcgagcccaacaactaccagaacgtggagtactgcggcgagctgaagggcgaccccaccatgagctggaacgacatcaactgcgagcacctgaacaactggatctgccagatccagaagggccagacccccaagcccgagcccacccccgccccccaggacaacccccccgtgaccgaggacggctgggtgatctacaaggactaccagtactacttcagcaaggagaaggagaccatggacaacgccagagccttctgcaagagaaacttcggcgacctggtgagcatccagagcgagagcgagaagaagttcctgtggaagtacgtgaacagaaacgacgcccagagcgcctacttcatcggcctgctgatcagcctggacaagaagttcgcctggatggacggcagcaaggtggactacgtgagctgggccaccggcgagcccaacttcgccaacgaggacgagaactgcgtgaccatgtacagcaacagcggcttctggaacgacatcaactgcggctaccccaacgccttcatctgccagagacacaacagcagcatcaacgccaccaccgtgatgcccaccatgcccagcgtgcccagcggctgcaaggagggctggaacttctacagcaacaagtgcttcaagatcttcggcttcatggaggaggagagaaagaactggcaggaggccagaaaggcctgcatcggcttcggcggcaacctggtgagcatccagaacgagaaggagcaggccttcctgacctaccacatgaaggacagcaccttcagcgcctggaccggcctgaacgacgtgaacagcgagcacaccttcctgtggaccgacggcagaggcgtgcactacaccaactggggcaagggctaccccggcggcagaagaagcagcctgagctacgaggacgccgactgcgtggtgatcatcggcggcgccagcaacgaggccggcaagtggatggacgacacctgcgacagcaagagaggctacatctgccagaccagaagcgaccccagcctgaccaacccccccgccaccatccagaccgacggcttcgtgaagtacggcaagagcagctacagcctgatgagacagaagttccagtggcacgaggccgagacctactgcaagctgcacaacagcctgatcgccagcatcctggacccctacagcaacgccttcgcctggctgcagatggagaccagcaacgagagagtgtggatcgccctgaacagcaacctgaccgacaaccagtacacctggaccgacaagtggagagtgagatacaccaactgggccgccgacgagcccaagctgaagagcgcctgcgtgtacctggacctggacggctactggaagaccgcccactgcaacgagagcttctacttcctgtgcaagagaagcgacgagatccccgccaccgagcccccccagctgcccggcagatgccccgagagcgaccacaccgcctggatccccttccacggccactgctactacatcgagagcagctacaccagaaactggggccaggccagcctggagtgcctgagaatgggcagcagcctggtgagcatcgagagcgccgccgagagcagcttcctgagctacagagtggagcccctgaagagcaagaccaacttctggatcggcctgttcagaaacgtggagggcacctggctgtggatcaacaacagccccgtgagcttcgtgaactggaacaccggcgaccccagcggcgagagaaacgactgcgtggccctgcacgccagcagcggcttctggagcaacatccactgcagcagctacaagggctacatctgcaagagacccaagatcatcgacgccaagcccacccacgagctgctgaccaccaaggccgacaccagaaagatggaccccagcaagcccagcagcaacgtggccggcgtggtgatcatcgtgatcctgctgatcctgaccggcgccggcctggccgcctacttcttctacaagaagagaagagtgcacctgccccaggagggcgccttcgagaacaccctgtacttcaacagccagagcagccccggcaccagcgacatgaaggacctggtgggcaacatcgagcagaacgagcacagcgtgatctag

SEQ ID NO: 22360 - DNA, 1497 bp, Artificial Sequence
  Description of Artificial Sequence: Synthetic coding sequence
atgagactgcccctgctgctggtgttcgccagcgtgatccccggcgccgtgctgctgctggacaccagacagttcctgatctacaacgaggaccacaagagatgcgtggacgccgtgagccccagcgccgtgcagaccgccgcctgcaaccaggacgccgagagccagaagttcagatgggtgagcgagagccagatcatgagcgtggccttcaagctgtgcctgggcgtgcccagcaagaccgactgggtggccatcaccctgtacgcctgcgacagcaagagcgagttccagaagtgggagtgcaagaacgacaccctgctgggcatcaagggcgaggacctgttcttcaactacggcaacagacaggagaagaacatcatgctgtacaagggcagcggcctgtggagcagatggaagatctacggcaccaccgacaacctgtgcagcagaggctacgaggccatgtacaccctgctgggcaacgccaacggcgccacctgcgccttccccttcaagttcgagaacaagtggtacgccgactgcaccagcgccggcagaagcgacggctggctgtggtgcggcaccaccaccgactacgacaccgacaagctgttcggctactgccccctgaagttcgagggcagcgagagcctgtggaacaaggaccccctgaccagcgtgagctaccagatcaacagcaagagcgccctgacctggcaccaggccagaaagagctgccagcagcagaacgccgagctgctgagcatcaccgagatccacgagcagacctacctgaccggcctgaccagcagcctgaccagcggcctgtggatcggcctgaacagcctgagcttcaacagcggctggcagtggagcgacagaagccccttcagatacctgaactggctgcccggcagccccagcgccgagcccggcaagagctgcgtgagcctgaaccccggcaagaacgccaagtgggagaacctggagtgcgtgcagaagctgggctacatctgcaagaagggcaacaccaccctgaacagcttcgtgatccccagcgagagcgacgtgcccacccactgccccagccagtggtggccctacgccggccactgctacaagatccacagagacgagaagaagatccagagagacgccctgaccacctgcagaaaggagggcagcgacctggccagcatccacaccatcgaggagttcgacttcatcatcagccagctgggctacgagcccaacgacgagctgtggatcggcctgaacgacatcaagatccagatgtacttcgagtggagcgacggcacccccgtgaccttcaccaagtggctgagaggcgagcccagccacgagaacaacagacaggaggactgcgtggtgatgaagggcaaggccggcgtgcagtggcacaacctgggcagcatgcagcccctgcccagagagttcaagagattcagctgcctgagcctgcccagcagctag

SEQ ID NO: 22361 - DNA, 507 bp, Artificial Sequence
  Description of Artificial Sequence: Synthetic coding sequence
accggccagggcggcgtgagaagcgcccccggcaccggcagaatcgccttcccccccaaggccagcagaggcagcaccaacaccgcccacctgagcatcgccaacagctggcccagaagcgccagcacccccgagaccagaaccaagttcacccaggacaacctgtgccacgcccagagagagagactggacagcgccaacctgtgggtgctggtggactgcatcctgagagacaccagcgaggacctgggcctgcagtgcgacgccgtgaacctggccttcggcagaagatgcgaggagctggaggacgccagacacaagctgcagcaccacctgcacaaggtgggccaccccgagcccagaagaagactgagaagactgcccaccaccctgccccccctgatcacctggcccggccccagcacccccttcagcagcgtgcccctgatccccagagaccccagaagcaagtgccacctgagcgtgaacctgtgcaagaccagatag

SEQ ID NO: 22362 - DNA, 1941 bp, Artificial Sequence
  Description of Artificial Sequence: Synthetic coding sequence
atggagttccaggaggtgcagcagacccaggccctggcctggcaggcccagaaggcccccacccacatctggcagcccctgcccgcccaggaggcccagagacaggccccccccctggtgcagctggagcagcccttccagggcgccccccccagccagaaggccgtgcagatccagctgcccccccagcaggcccaggccagcggcccccaggccgaggtgcccaccctgcccctgcagcccagctggcaggccccccccgccgtgctgcaggcccagcccggcccccccgtggccgccgccaacttccccctgggcagcgccaagagcctgatgacccccagcggcgagtgcagagccagcagcatcgacagaagaggcagcagcaaggagagaagaaccagcagcaaggagagaagagcccccagcaaggacagaatgatcttcgccgccaccttctgcgcccccaaggccgtgagcgccgccagagcccacctgcccgccgcctggaagaacctgcccgccacccccgagaccttcgcccccagcagcagcgtgttccccgccaccagccagttccagcccgccagcctgaacgccttcaagggccccagcgccgccagcgagacccccaagagcctgccctacgccctgcaggaccccttcgcctgcgtggaggccctgcccgccgtgccctgggtgccccagcccaacatgaacgccagcaaggccagccaggccgtgcccaccttcctgatggccaccgccgccgccccccaggccaccgccaccacccaggaggccagcaagaccagcgtggagccccccagaagaagcggcaaggccaccagaaagaagaagcacctggaggcccaggaggacagcagaggccacaccctggccttccacgactggcagggccccagaccctgggagaacctgaacctgagcgactgggaggtgcagagccccatccaggtgagcggcgactgggagcaccccaacacccccagaggcctgagcggctgggagggccccagcaccagcagaatcctgagcggctgggagggccccagcgccagctgggccctgagcgcctgggagggccccagcaccagcagagccctgggcctgagcgagagccccggcagcagcctgcccgtggtggtgagcgaggtggccagcgtgagccccggcagcagcgccacccaggacaacagcaaggtggaggcccagcccctgagccccctggacgagagagccaacgccctggtgcagttcctgctggtgaaggaccaggccaaggtgcccgtgcagagaagcgagatggtgaaggtgatcctgagagagtacaaggacgagtgcctggacatcatcaacagagccaacaacaagctggagtgcgccttcggctaccagctgaaggagatcgacaccaagaaccacgcctacatcatcatcaacaagctgggctaccacaccggcaacctggtggccagctacctggacagacccaagttcggcctgctgatggtggtgctgagcctgatcttcatgaagggcaactgcgtgagagaggacctgatcttcaacttcctgttcaagctgggcctggacgtgagagagaccaacggcctgttcggcaacaccaagaagctgatcaccgaggtgttcgtgagacagaagtacctggagtacagaagaatcccctacaccgagcccgccgagtacgagttcctgtggggccccagagccttcctggagaccagcaagatgctggtgctgagattcctggccaagctgcacaagaaggacccccagagctggcccttccactacctggaggccctggccgagtgcgagtgggaggacaccgacgaggacgagcccgacaccggcgacagcgcccacggccccaccagcagacccccccccagatag

SEQ ID NO: 22363 - DNA, 828 bp, Artificial Sequence
  Description of Artificial Sequence: Synthetic coding sequence
atgcccctgctgtggatcaccggccccagataccacctgatcctgctgagcgaggccagctgcctgagagccaactacgtgcacctgtgccccctgttccagcacagatggctggagacctgcaacgcccccccccagctgatccagggcaaggcccacagcgcccccaagcccagccaggccagcggccacttcagcgtggagctggtgagaggctacgccggcttcggcctgaccctgggcggcggcagagacgtggccggcgacacccccctggccgtgagaggcctgctgaaggacggccccgcccagagatgcggcagactggaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggtgcccagctggcccgacagaagccccgaccccggcggccccgaggtgaccggcagcagaagcagcagcaccagcctggtgcagcacccccccagcagaaccaccctgaagaagaccagaggcagccccgagcccagccccgaggccgccgccgacggccccaccgtgagcccccccgagagaagagccgaggaccccaacgaccagatccccggcagccccggcccctggctggtgcccagcgaggagagactgagcagagccctgggcgtgagaggcgccgcccagttcgcccaggagatggccgccggcagaagaagacactag

SEQ ID NO: 22364 - DNA, 813 bp, Artificial Sequence
  Description of Artificial Sequence: Synthetic coding sequence
atgcccctgctgtggatcaccggccccagataccacctgatcctgctgagcgaggccagctgcctgagagccaactacgtgcacctgtgccccctgttccagcacagatggctggagacctgcaacgcccccccccagctgatccagggcaaggcccacagcgcccccaagcccagccaggccagcggccacttcagcgtggagctggtgagaggctacgccggcttcggcctgaccctgggcggcggcagagacgtggccggcgacacccccctggccgtgagaggcctgctgaaggacggccccgcccagagatgcggcagactggaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggacagaagccccgaccccggcggccccgaggtgaccggcagcagaagcagcagcaccagcctggtgcagcacccccccagcagaaccaccctgaagaagaccagaggcagccccgagcccagccccgaggccgccgccgacggccccaccgtgagcccccccgagagaagagccgaggaccccaacgaccagatccccggcagccccggcccctggctggtgcccagcgaggagagactgagcagagccctgggcgtgagaggcgccgcccagttcgcccaggagatggccgccggcagaagaagacactag

SEQ ID NO: 22365 - DNA, 1005 bp, Artificial Sequence
  Description of Artificial Sequence: Synthetic coding sequence
atggagcccagaaccggcggcgccgccaaccccaagggcagcagaggcagcagaggccccagccccctggccggccccagcgccagacagctgctggccagactggacgccagacccctggccgccagagccgccgtggacgtggccgccctggtgagaagagccggcgccaccctgagactgagaagaaaggaggccgtgagcgtgctggacagcgccgacatcgaggtgaccgacagcagactgccccacgccaccatcgtggaccacagaccccagcacagatggctggagacctgcaacgcccccccccagctgatccagggcaaggcccacagcgcccccaagcccagccaggccagcggccacttcagcgtggagctggtgagaggctacgccggcttcggcctgaccctgggcggcggcagagacgtggccggcgacacccccctggccgtgagaggcctgctgaaggacggccccgcccagagatgcggcagactggaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggtgcccagctggcccgacagaagccccgaccccggcggccccgaggtgaccggcagcagaagcagcagcaccagcctggtgcagcacccccccagcagaaccaccctgaagaagaccagaggcagccccgagcccagccccgaggccgccgccgacggccccaccgtgagcccccccgagagaagagccgaggaccccaacgaccagatccccggcagccccggcccctggctggtgcccagcgaggagagactgagcagagccctgggcgtgagaggcgccgcccagttcgcccaggagatggccgccggcagaagaagacactag

SEQ ID NO: 22366 - DNA, 714 bp, Artificial Sequence
  Description of Artificial Sequence: Synthetic coding sequence
tgaagaggccccagccccctggccggccccagcgccagacagctgctggccagactggacgccagacccctggccgccagagccgccgtggacgtggccgccctggtgagaagagccggcgccaccctgagactgagaagaaaggaggccgtgagcgtgctggacagcgccgacatcgaggtgaccgacagcagactgccccacgccaccatcgtggaccacagaccccagggcaaggcccacagcgcccccaagcccagccaggccagcggccacttcagcgtggagctggtgagaggctacgccggcttcggcctgaccctgggcggcggcagagacgtggccggcgacacccccctggccgtgagaggcctgctgaaggacggccccgcccagagatgcggcagactggaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggacagaagccccgaccccggcggccccgaggtgaccggcagcagaagcagcagcaccagcctggtgcagcacccccccagcagaaccaccctgaagaagaccagaggcagccccgagcccagcccctag

SEQ ID NO: 22367 - DNA, 645 bp, Artificial Sequence
  Description of Artificial Sequence: Synthetic coding sequence
gcctggggcgtgagcagctactgccccgtgctggccgtgagcgtgctggacagcgccgacatcgaggtgaccgacagcagactgccccacgccaccatcgtggaccacagaccccagcacagatggctggagacctgcaacgcccccccccagctgatccagggcaaggcccacagcgcccccaagcccagccaggccagcggccacttcagcgtggagctggtgagaggctacgccggcttcggcctgaccctgggcggcggcagagacgtggccggcgacacccccctggccgtgagaggcctgctgaaggacggccccgcccagagatgcggcagactggaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggacagaagccccgaccccggcggccccgaggtgaccggcagcagaagcagcagcaccagcctggtgcagcacccccccagcagaaccaccctgaagaagaccagaggcagccccgagcccagcccctag

SEQ ID NO: 22368 - DNA, 777 bp, Artificial Sequence
  Description of Artificial Sequence: Synthetic coding sequence
atggagcccagaaccggcggcgccgccaaccccaagggcagcagaggcagcagaggccccagccccctggccggccccagcgccagacagctgctggccagactggacgccagacccctggccgccagagccgccgtggacgtggccgccctggtgagaagagccggcgccaccctgagactgagaagaaaggaggccgtgagcgtgctggacagcgccgacatcgaggtgaccgacagcagactgccccacgccaccatcgtggaccacagaccccaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggtgcccagctggcccgacagaagccccgaccccggcggccccgaggtgaccggcagcagaagcagcagcaccagcctggtgcagcacccccccagcagaaccaccctgaagaagaccagaggcagccccgagcccagccccgaggccgccgccgacggccccaccgtgagcccccccgagagaagagccgaggaccccaacgaccagatccccggcagccccggcccctggctggtgcccagcgaggagagactgagcagagccctgggcgtgagaggcgccgcccagttcgcccaggagatggccgccggcagaagaagacactag

SEQ ID NO: 22369 - DNA, 432 bp, Artificial Sequence
  Description of Artificial Sequence: Synthetic coding sequence
atgagccccaacagccccctgcactgcttctacctgcccgccgtgagcgtgctggacagcgccgacatcgaggtgaccgacagcagactgccccacgccaccatcgtggaccacagaccccaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggacagaagccccgaccccggcggccccgaggtgaccggcagcagaagcagcagcaccagcctggtgcagcacccccccagcagaaccaccctgaagaagaccagaggcagccccgagcccagccccgaggccgcctag

SEQ ID NO: 22370 - DNA, 606 bp, Artificial Sequence
  Description of Artificial Sequence: Synthetic coding sequence
tgaggcagactgctggccatggagcccagaaccggcggcgccgccaaccccaagggcagcagaggcagcagaggccccagccccctggccggccccagcgccagacagctgctggccagactggacgccagacccctggccgccagagccgccgtggacgtggccgccctggtgagaagagccggcgccaccctgagactgagaagaaaggaggccgtgagcgtgctggacagcgccgacatcgaggtgaccgacagcagactgccccacgccaccatcgtggaccacagaccccaggtgggcgacgtggtgctgcacatcaacggcgagagcacccagggcctgacccacgcccaggccgtggagagaatcagagccggcggcccccagctgcacctggtgatcagaagacccctggagacccaccccggcaagcccagaggcgtgggcgagcccagaaagggcgtggacagaagccccgaccccggcggccccgaggtgaccggcagcagaagcagcagcaccagcctggtgcagcacccccccagcagaaccaccctgaagaagaccagaggcagccccgagcccagccccgaggccgcctag

SEQ ID NO: 22371 - DNA, 531 bp, Artificial Sequence
  Description of Artificial Sequence: Synthetic coding sequence
atggccagactgcccaagctggccgtgttcgacctggactacaccctgtggcccttctgggtggacacccacgtggacccccccttccacaagagcagcgacggcaccgtgagagacagaagaggccaggacgtgagactgtaccccgaggtgcccgaggtgctgaagagactgcagagcctgggcgtgcccggcgccgccgccagcagaaccagcgagatcgagggcgccaaccagctgctggagctgttcgacctgttcagatacttcgtgcacagagagatctaccccggcagcaagatcacccacttcgagagactgcagcagaagaccggcatccccttcagccagatgatcttcttcgacgacgagagaagaaacatcgtggacgtgagcaagctgggcgtgacctgcatccacatccagaacggcatgaacctgcagaccctgagccagggcctggagaccttcgccaaggcccagaccggccccctgagaagcagcctggaggagagccccttcgaggcctag

SEQ ID NO: 22372 - DNA, 369 bp, Artificial Sequence
  Description of Artificial Sequence: Synthetic coding sequence
atggccagactgcccaagctggccgtgttcgacctggactacaccctgtggcccttctgggtggacacccacgtggacccccccttccacaagagcagcgacggcaccgtgagagacagaagaggccaggacgtgagactgtaccccgaggtgcccgaggtgctgaagagactgcagagcctgggcgtgcccggcgccgccgccagcagaaccagcgagatcgagggcgccaaccagctgctggagctgttcgacctgttcagatgctacctgcacagccaccccgagtggaacgagagcagcaacagcaagagcagagtgagagacatctgcgagggccccaactgggccttcgaggtgcagccctag

SEQ ID NO: 22373 - DNA, 1515 bp, Artificial Sequence
  Description of Artificial Sequence: Synthetic coding sequence
atggccgccccccccgcccccgccgccaagggcagcccccagcccgagccccacgcccccgagcccggccccggcagcgccaagagaggcagagaggacagcagagccggcagactgagcttctgcaccaaggtgtgctacggcatcggcggcgtgcccaaccagatcgccagcagcgccaccgccttctacctgcagctgttcctgctggacatcgcccagatccccgccgcccaggtgagcctggtgctgttcggcggcaaggtgagcggcgccgccgccgaccccgtggccggcttcttcatcaacagaagccagagaaccggcagcggcagactgatgccctgggtgctgggctgcacccccttcatcgccctggcctacttcttcctgtggttcctgccccccttcaccagcctgagaggcctgtggtacaccaccttctactgcctgttccaggccctggccaccttcttccaggtgccctacaccgccctgaccatgctgctgaccccctgccccagagagagagacagcgccaccgcctacagaatgaccgtggagatggccggcaccctgatgggcgccaccgtgcacggcctgatcgtgagcggcgcccacagaccccacagatgcgaggccaccgccacccccggccccgtgaccgtgagccccaacgccgcccacctgtactgcatcgccgccgccgtggtggtggtgacctaccccgtgtgcatcagcctgctgtgcctgggcgtgaaggagagacccgaccccagcgcccccgccagcggccccggcctgagcttcctggccggcctgagcctgaccaccagacaccccccctacctgaagctggtgatcagcttcctgttcatcagcgccgccgtgcaggtggagcagagctacctggtgctgttctgcacccacgccagccagctgcacgaccacgtgcagggcctggtgctgaccgtgctggtgagcgccgtgctgagcacccccctgtgggagtgggtgctgcagagattcggcaagaagaccagcgccttcggcatcttcgccatggtgcccttcgccatcctgctggccgccgtgcccaccgcccccgtggcctacgtggtggccttcgtgagcggcgtgagcatcgccgtgagcctgctgctgccctggagcatgctgcccgacgtggtggacgacttccagctgcagcacagacacggccccggcctggagaccatcttctacagcagctacgtgttcttcaccaagctgagcggcgcctgcgccctgggcatcagcaccctgagcctggagttcagcggctacaaggccggcgtgtgcaagcaggccgaggaggtggtggtgaccctgaaggtgctgatcggcgccgtgcccacctgcatgatcctggccggcctgtgcatcctgatggtgggcagcacccccaagacccccagcagagacgccagcagcagactgagcctgagaagaagaaccagctacagcctggcctag

SEQ ID NO: 22374 - DNA, 1494 bp, Artificial Sequence
  Description of Artificial Sequence: Synthetic coding sequence
atggccgccccccccgcccccgccgccaagggcagcccccagcccgagccccacgcccccgagcccggccccggcagcgccaagagaggcagagaggacagcagagccggcagactgagcttctgcaccaaggtgtgctacggcatcggcggcgtgcccaaccagatcgccagcagcgccaccgccttctacctgcagctgttcctgctggacatcgcccagatccccgccgcccaggtgagcctggtgctgttcggcggcaaggtgagcggcgccgccgccgaccccgtggccggcttcttcatcaacagaagccagagaaccggcagcggcagactgatgccctgggtgctgggctgcacccccttcatcgccctggcctacttcttcctgtggttcctgccccccttcaccagcctgagaggcctgtggtacaccaccttctactgcctgttccaggccctggccaccttcttccaggtgccctacaccgccctgaccatgctgctgaccccctgccccagagagagagacagcgccaccgcctacagaatgaccgtggagatggccggcaccctgatgggcgccaccgtgcacggcctgatcgtgagcggcgcccacagaccccacagatgcgaggccaccgccacccccggccccgtgaccgtgagccccaacgccgcccacctgtactgcatcgccgccgccgtggtggtggtgacctaccccgtgtgcatcagcctgctgtgcctgggcgtgaaggagagacccgaccccagcgcccccgccagcggccccggcctgagcttcctggccggcctgagcctgaccaccagacaccccccctacctgaagctggtgatcagcttcctgttcatcagcgccgccgtgcaggtggagcagagctacctggtgctgttctgcacccacgccagccagctgcacgaccacgtgcagggcctggtgctgaccgtgctggtgagcgccgtgctgagcacccccctgtgggagtgggtgctgcagagattcggcaagaagaccagcgccttcggcatcttcgccatggtgcccttcgccatcctgctggccgccgtgcccaccgcccccgtggcctacgtggtggccttcgtgagcggcgtgagcatcgccgtgagcctgctgctgccctggagcatgctgcccgacgtggtggacgacttccagctgcagcacagacacggccccggcctggagaccatcttctacagcagctacgtgttcttcaccaagctgagcggcgcctgcgccctgggcatcagcaccctgagcctggagttcagcggctacaaggccggcgtgtgcaagcaggccgaggaggtggtggtgaccctgaaggtgctgatcggcgccgtgcccacctgcatgatcctggccggcctgtgcatcctgatggtgggcagcacccccaagacccccagcagagacgccagcagcagactgagcctgagaagatag

SEQ ID NO: 22375 - DNA, 1449 bp, Artificial Sequence
  Description of Artificial Sequence: Synthetic coding sequence
atggccgaggccgccacccccggcaccaccgccaccaccagcggcgccggcgccgccgccgccaccgccgccgccgccagccccacccccatccccaccgtgaccgcccccagcctgggcgccggcggcggcggcggcggcagcgacggcagcggcggcggctggaccaagcaggtgacctgcagatacttcatgcacggcgtgtgcaaggagggcgacaactgcagatacagccacgacctgagcgacagcccctacagcgtggtgtgcaagtacttccagagaggctactgcatctacggcgacagatgcagatacgagcacagcaagcccctgaagcaggaggaggccaccgccaccgagctgaccaccaagagcagcctggccgccagcagcagcctgagcagcatcgtgggccccctggtggagatgaacaccggcgaggccgagagcagaaacagcaacttcgccaccgtgggcgccggcagcgaggactgggtgaacgccatcgagttcgtgcccggccagccctactgcggcagaaccgcccccagctgcaccgaggcccccctgcagggcagcgtgaccaaggaggagagcgagaaggagcagaccgccgtggagaccaagaagcagctgtgcccctacgccgccgtgggcgagtgcagatacggcgagaactgcgtgtacctgcacggcgacagctgcgacatgtgcggcctgcaggtgctgcaccccatggacgccgcccagagaagccagcacatcaagagctgcatcgaggcccacgagaaggacatggagctgagcttcgccgtgcagagaagcaaggacatggtgtgcggcatctgcatggaggtggtgtacgagaaggccaaccccagcgagagaagattcggcatcctgagcaactgcaaccacacctactgcctgaagtgcatcagaaagtggagaagcgccaagcagttcgagagcaagatcatcaagagctgccccgagtgcagaatcaccagcaacttcgtgatccccagcgagtactgggtggaggagaaggaggagaagcagaagctgatcctgaagtacaaggaggccatgagcaacaaggcctgcagatacttcgacgagggcagaggcagctgccccttcggcggcaactgcttctacaagcacgcctaccccgacggcagaagagaggagccccagagacagaaggtgggcaccagcagcagatacagagcccagagaagaaaccacttctgggagctgatcgaggagagagagaacagcaaccccttcgacaacgacgaggaggaggtggtgaccttcgagctgggcgagatgctgctgatgctgctggccgccggcggcgacgacgagctgaccgacagcgaggacgagtgggacctgttccacgacgagctggaggacttctacgacctggacctgtag

SEQ ID NO: 22376 - DNA, 651 bp, Artificial Sequence
  Description of Artificial Sequence: Synthetic coding sequence
atggagctgagcttcgccgtgcagagaagcaaggacatggtgtgcggcatctgcatggaggtggtgtacgagaaggccaaccccagcgagagaagattcggcatcctgagcaactgcaaccacacctactgcctgaagtgcatcagaaagtggagaagcgccaagcagttcgagagcaagatcatcaagagctgccccgagtgcagaatcaccagcaacttcgtgatccccagcgagtactgggtggaggagaaggaggagaagcagaagctgatcctgaagtacaaggaggccatgagcaacaaggcctgcagatacttcgacgagggcagaggcagctgccccttcggcggcaactgcttctacaagcacgcctaccccgacggcagaagagaggagccccagagacagaaggtgggcaccagcagcagatacagagcccagagaagaaaccacttctgggagctgatcgaggagagagagaacagcaaccccttcgacaacgacgaggaggaggtggtgaccttcgagctgggcgagatgctgctgatgctgctggccgccggcggcgacgacgagctgaccgacagcgaggacgagtgggacctgttccacgacgagctggaggacttctacgacctggacctgtag

SEQ ID NO: 22377 - DNA, 1257 bp, Artificial Sequence
  Description of Artificial Sequence: Synthetic coding sequence
atgcacggcgtgtgcaaggagggcgacaactgcagatacagccacgacctgagcgacagcccctacagcgtggtgtgcaagtacttccagagaggctactgcatctacggcgacagatgcagatacgagcacagcaagcccctgaagcaggaggaggccaccgccaccgagctgaccaccaagagcagcctggccgccagcagcagcctgagcagcatcgtgggccccctggtggagatgaacaccggcgaggccgagagcagaaacagcaacttcgccaccgtgggcgccggcagcgaggactgggtgaacgccatcgagttcgtgcccggccagccctactgcggcagaaccgcccccagctgcaccgaggcccccctgcagggcagcgtgaccaaggaggagagcgagaaggagcagaccgccgtggagaccaagaagcagctgtgcccctacgccgccgtgggcgagtgcagatacggcgagaactgcgtgtacctgcacggcgacagctgcgacatgtgcggcctgcaggtgctgcaccccatggacgccgcccagagaagccagcacatcaagagctgcatcgaggcccacgagaaggacatggagctgagcttcgccgtgcagagaagcaaggacatggtgtgcggcatctgcatggaggtggtgtacgagaaggccaaccccagcgagagaagattcggcatcctgagcaactgcaaccacacctactgcctgaagtgcatcagaaagtggagaagcgccaagcagttcgagagcaagatcatcaagagctgccccgagtgcagaatcaccagcaacttcgtgatccccagcgagtactgggtggaggagaaggaggagaagcagaagctgatcctgaagtacaaggaggccatgagcaacaaggcctgcagatacttcgacgagggcagaggcagctgccccttcggcggcaactgcttctacaagcacgcctaccccgacggcagaagagaggagccccagagacagaaggtgggcaccagcagcagatacagagcccagagaagaaaccacttctgggagctgatcgaggagagagagaacagcaaccccttcgacaacgacgaggaggaggtggtgaccttcgagctgggcgagatgctgctgatgctgctggccgccggcggcgacgacgagctgaccgacagcgaggacgagtgggacctgttccacgacgagctggaggacttctacgacctggacctgtag

SEQ ID NO: 22378 - DNA, 990 bp, Artificial Sequence
  Description of Artificial Sequence: Synthetic coding sequence
atggccgaggccgccacccccggcaccaccgccaccaccagcggcgccggcgccgccgccgccaccgccgccgccgccagccccacccccatccccaccgtgaccgcccccagcctgggcgccggcggcggcggcggcggcagcgacggcagcggcggcggctggaccaagcaggtgacctgcagatacttcatgcacggcgtgtgcaaggagggcgacaactgcagatacagccacgacctgagcgacagcccctacagcgtggtgtgcaagtacttccagagaggctactgcatctacggcgacagatgcagatacgagcacagcaagcccctgaagcaggaggaggccaccgccaccgagctgaccaccaagagcagcctggccgccagcagcagcctgagcagcatcgtgggccccctggtggagatgaacaccggcgaggccgagagcagaaacagcaacttcgccaccgtgggcgccggcagcgaggactgggtgaacgccatcgagttcgtgcccggccagccctactgcggcagaaccgcccccagctgcaccgaggcccccctgcagggcagcgtgaccaaggaggagagcgagaaggagcagaccgccgtggagaccaagaagcagctgtgcccctacgccgccgtgggcgagtgcagatacggcgagaactgcgtgtacctgcacggcgacagctgcgacatgtgcggcctgcaggtgctgcaccccatggacgccgcccagagaagccagcacatcaagagctgcatcgaggcccacgagaaggacatggagctgagcttcgccgtgcagagaagcaaggacatggtgtgcggcatctgcatggaggtggtgtacgagaaggccaaccccagcgagagaagattcggcatcctgagcaactgcaaccacacctactgcctgaagtgcatcagaaagtggagaagcgccaagcagttcgagagcaagatcatcaagtag

SEQ ID NO: 22379 - DNA, 1557 bp, Artificial Sequence
  Description of Artificial Sequence: Synthetic coding sequence
atggccaagttcgtgatcgccggcagagccgactgcccctactacgccaagaccgagctggtggccgactacctgcagaagaacctgcccgacttcagaatccacaagatcacccagagacccgaggtgtgggaggactggctgaaggacgtgtgcgagaagaacaagtggagccacaagaacagccccatcatctggagagagctgctggacagaggcggcaagggcctgctgctgggcggctacaacgagttcctggagcacgcccagctgtactacgacgtgaccagcagcatgaccaccgagctgatgatggtgatcgcccaggagaacctgggcgcccacatcgagaaggagcaggaggaggaggccctgaagacctgcatcaaccccctgcaggtgtggatcaccagcgccagcgcccccgcctgctacaacctgatccccatcctgaccagcggcgaggtgttcggcatgcacaccgagatcagcatcaccctgttcgacaacaagcaggccgaggagcacctgaagagcctggtggtggagacccaggacctggccagccccgtgctgagaagcgtgagcatctgcaccaaggtggaggaggccttcagacaggcccacgtgatcgtggtgctggacgacagcaccaacaaggaggtgttcaccctggaggactgcctgagaagcagagtgcccctgtgcagactgtacggctacctgatcgagaagaacgcccacgagagcgtgagagtgatcgtgggcggcagaaccttcgtgaacctgaagaccgtgctgctgatgagatacgcccccagaatcgcccacaacatcatcgccgtggccctgggcgtggagggcgaggccaaggccatcctggccagaaagctgaagaccgcccccagctacatcaaggacgtgatcatctggggcaacatcagcggcaacaactacgtggacctgagaaagaccagagtgtacagatacgagagcgccatctggggccccctgcactacagcagacccgtgctgaacctgatcttcgacagcgagtgggtgaagagagagttcgtggccatcctgaagaacctgaccaccaccggcagacagttcggcggcatcctggccgcccacagcatcgccaccaccctgaagtactggtaccacggcagcccccccggcgagatcgtgagcctgggcatcctgagcgagggccagttcggcatccccaagggcatcgtgttcagcatgcccgtgaagttcgagaacggcacctgggtggtgctgaccgacctgaaggacgtggagatcagcgagcagatcatgaccagaatgaccagcgacctgatccaggagaagctggtggccctgggcgacaagatccacttccagccctaccagagcggccacaaggacctggtgcccgacgaggagaagaacctggccatgagcgacgccgccgagttccccaaccagatcccccagaccaccttcgagaagccccagagcctggagttcctgaacgagttcgagggcaagaccgtggagagctag

SEQ ID NO: 22380 - DNA, 852 bp, Artificial Sequence
  Description of Artificial Sequence: Synthetic coding sequence
atggccaagttcgtgatcgccggcagagccgactgcccctactacgccaagaccgagctggtggccgactacctgcagaagaacctgcccgacttcagaatccacaagatcacccagagacccgaggtgtgggaggactggctgaaggacgtgtgcgagaagaacaagtggagccacaagaacagccccatcatctggagagagctgctggacagaggcggcaagggcctgctgctgggcggctacaacgagttcctggagcacgcccagctgtactacgacgtgaccagcagcatgaccaccgagctgatgatggtgatcgcccaggagaacctgggcgcccacatcgagaaggagcaggaggaggaggccctgaagacctgcatcaaccccctgcaggtgtggatcaccagcgagtgggtgaagagagagttcgtggccatcctgaagaacctgaccaccaccggcagacagttcggcggcatcctggccgcccacagcatcgccaccaccctgaagtactggtaccacggcagcccccccggcgagatcgtgagcctgggcatcctgagcgagggccagttcggcatccccaagggcatcgtgttcagcatgcccgtgaagttcgagaacggcacctgggtggtgctgaccgacctgaaggacgtggagatcagcgagcagatcatgaccagaatgaccagcgacctgatccaggagaagctggtggccctgggcgacaagatccacttccagccctaccagagcgacacccccagaatcaacaccctgcaccccagcatccagagcagctggcacagcgtgctgaccatcaccatcagaaagagatag

SEQ ID NO: 22381 - DNA, 1554 bp, Artificial Sequence
  Description of Artificial Sequence: Synthetic coding sequence
atggccaagttcgtgatcgccggcagagccgactgcccctactacgccaagaccgagctggtggccgactacctgcagaagaacctgcccgacttcagaatccacaagatcacccagagacccgaggtgtgggaggactggctgaaggacgtgtgcgagaagaacaagtggagccacaagaacagccccatcatctggagagagctgctggacagaggcggcaagggcctgctgctgggcggctacaacgagttcctggagcacgcccagctgtactacgacgtgaccagcagcatgaccaccgagctgatgatggtgatcgcccaggagaacctgggcgcccacatcgagaaggagcaggaggaggaggccctgaagacctgcatcaaccccctgcaggtgtggatcaccagcgccagcgcccccgcctgctacaacctgatccccatcctgaccagcggcgaggtgttcggcatgcacaccgagatcagcatcaccctgttcgacaacaagcaggccgaggagcacctgaagagcctggtggtggagacccaggacctggccagccccgtgctgagaagcgtgagcatctgcaccaaggtggaggaggccttcagacaggcccacgtgatcgtggtgctggacgacagcaccaacaaggaggtgttcaccctggaggactgcctgagaagcagagtgcccctgtgcagactgtacggctacctgatcgagaagaacgcccacgagagcgtgagagtgatcgtgggcggcagaaccttcgtgaacctgaagaccgtgctgctgatgagatacgcccccagaatcgcccacaacatcatcgccgtggccctgggcgtggagggcgaggccaaggccatcctggccagaaagctgaagaccgcccccagctacatcaaggacgtgatcatctggggcaacatcagcggcaacaactacgtggacctgagaaagaccagagtgtacagatacgagagcgccatctggggccccctgcactacagcagacccgtgctgaacctgatcttcgacagcgagtgggtgaagagagagttcgtggccatcctgaagaacctgaccaccaccggcagacagttcggcggcatcctggccgcccacagcatcgccaccaccctgaagtactggtaccacggcagcccccccggcgagatcgtgagcctgggcatcctgagcgagggccagttcggcatccccaagggcatcgtgttcagcatgcccgtgaagttcgagaacggcacctgggtggtgctgaccgacctgaaggacgtggagatcagcgagcagatcatgaccagaatgaccagcgacctgatccaggagaagctggtggccctgggcgacaagatccacttccagccctaccagagcggccacaaggacctggtgcccgacgaggagaagaacctggccatgagcgacgccgagttccccaaccagatcccccagaccaccttcgagaagccccagagcctggagttcctgaacgagttcgagggcaagaccgtggagagctag

SEQ ID NO: 22382 - DNA, 705 bp, Artificial Sequence
  Description of Artificial Sequence: Synthetic coding sequence
atggagagaggcggcggcggcagcggcaccggcagcagacccgagggcaccgccagaggcaccagcctgcccggcaagatcgccgagcccggcgccgtgagaaccagccagcccaactacagaccccagggcatggagggcttcctgaagagcgacgagagacagagactggccaaggagagaagagaggagagagagaagtgcctggccgccagagagcagcagatcctggagaagcagaagagagccagactgcagtacgagaagcagatggaggagagatggagaaagctggaggagcagagacagagagaggaccagaagagagccgccgtggaggagaagagaaagcagaagctgagagaggaggaggagagactggaggccatgatgagaagaagcctggagagaacccagcagctggagctgaagaagaagtacagctggggcgcccccctggccatcggccccggcggccacgacggcgagagcgagaacaccccccccccccccctgggcctggccgccagcaccctgccccccgacgccggcaccaccgccgccgccgccgagagcaccaacgcctgcgacaagctgagcaccagcaccatgagcctgcccaagcccaccgagccccccatgaacaagagactgagcagcagcaccgtggccatcagctacagccccgacagagacgagaagtag

SEQ ID NO: 22383 - DNA, 2322 bp, Artificial Sequence
  Description of Artificial Sequence: Synthetic coding sequence
atggagagaggcggcggcggcagcggcaccggcagcagacccgagggcaccgccagaggcaccagcctgcccggcaagatcgccgagcccggcgccgtgagaaccagccagcccaactacagaccccagggcatggagggcttcctgaagagcgacgagagacagagactggccaaggagagaagagaggagagagagaagtgcctggccgccagagagcagcagatcctggagaagcagaagagagccagactgcagtacgagaagcagatggaggagagatggagaaagctggaggagcagagacagagagaggaccagaagagagccgccgtggaggagaagagaaagcagaagctgagagaggaggaggagagactggaggccatgatgagaagaagcctggagagaacccagcagctggagctgaagaagaagtacagctggggcgcccccctggccatcggccccggcggccacgacgcctgcgacaagctgagcaccagcaccatgagcctgcccaagcccaccgagccccccatgaacaagagactgagcagcagcaccgtggccatcagctacagccccgacagagcccaccacatgcacctgagccccatggaggccatcctggtgagcagactgctgacccccacccagagcagcctggccagaagcagagccagcgtgatgctgagcggccaggccaacgacagcgtgttccacgtgtgccccagactggcccccctgggccccctgaaccccagctacaagagcagccccaccagaaacatcgagaagaagaaggccaccagcaccagcaccagcggcgccggcgacgtgggcaaggaggccctgagcggcggcgaggccagcctggtggagaaggtgaagagaggccagagaaccgccaccagcctgcccgtggtgaacttcggcagccccctgagaagatgcgagttcagcggcggcatccccaagagacccagcagccccgtgatcagcaagaccgccaccaaggcctacccccagagccccaagaccaccaagcccccctaccccggcagccccgtgaagtacagactgcccgccctgagcggccaggacatgcccaagagaaaggccgagaaggagaagagcaacaaggagagagagggcaccctggcccagcaggccgccggcccccagggcgaggaggccctggagaagcacgtggtggacaagcacgccagcgagaagcacgccgccgccgccggcggcaaggccgagaacagcgccgccctgggcaagcccaccgccggcaccaccgacgccggcgaggccgccaagatcctggccgagaagagaagacaggccagactgcagaaggagcaggaggagcaggagagactggagaaggaggagcaggacagactggagagagaggagctgaagagaaaggccgaggaggagagactgagactggaggaggaggccagaaagcaggaggaggagagaaagagacaggaggaggagaagaagaagcaggagggcgaggagaagagaaaggccggcgaggaggccaagagaaaggccgaggaggagctgctgctgaaggagaagcaggagcaggagaagcaggagaaggccatgatcgagaagcagaaggaggccgccgagaccaaggccagagaggtggccgagcagatgagactggagagagagcagatcatgctgcagatcgagcaggagagactggagagaaagaagagaatcgacgagatcatgaagagaaccagaaagagcgacgtgagcccccaggtgaagaaggaggaccccaaggtgggcgtgcagcccgccgtgtgcgtggagaagaagaccaagctggtggtgcccaacaagatggagatcaacggcctgaacacctgccaggaggtgaacggcgtggaccacgccgcccccgagacctacccccaggacatcttcagcaacggcctgaagcccgccggcggcctgatccacctggacgccctggacggcaagagcaacagcctggacgacagcaccgaggaggtgcagagcatggacgtgagccccgtgagcaaggaggagctgatcagcatccccgagttcagccccgtgagcgagatgatccccggcgtgagcctggaccagaacggcaccggcaacgccagagccctgcaggacctgctggacttcaccggcccccccaccttccccaagagaagcagcgagaacctgagcctggacgactgcaacaagaacctgatcgagggcttcaacagccccggccaggagacccccctgaacaccttctgctag

SEQ ID NO: 22384 - DNA, 2199 bp, Artificial Sequence
  Description of Artificial Sequence: Synthetic coding sequence
atggagagaggcggcggcggcagcggcaccggcagcagacccgagggcaccgccagaggcaccagcctgcccggcaagatcgccgagcccggcgccgtgagaaccagccagcccaactacagaccccagggcatggagggcttcctgaagagcgacgagagacagagactggccaaggagagaagagaggagagagagaagtgcctggccgccagagagcagcagatcctggagaagcagaagagagccagactgcagtacgagaagcagatggaggagagatggagaaagctggaggagcagagacagagagaggaccagaagagagccgccgtggaggagaagagaaagcagaagctgagagaggaggaggagagactggaggccatgatgagaagaagcctggagagaacccagcagctggagctgaagaagaagtacagctggggcgcccccctggccatcggccccggcggccacgacgcctgcgacaagctgagcaccagcaccatgagcctgcccaagcccaccgagccccccatgaacaagagactgagcagcagcaccgtggccatcagctacagccccgacagagtgttccacgtgtgccccagactggcccccctgggccccctgaaccccagctacaagagcagccccaccagaaacatcgagaagaagaaggccaccagcaccagcaccagcggcgccggcgacgtgggcaaggaggccctgagcggcggcgaggccagcctggtggagaaggtgaagagaggccagagaaccgccaccagcctgcccgtggtgaacttcggcagccccctgagaagatgcgagttcagcggcggcatccccaagagacccagcagccccgtgatcagcaagaccgccaccaaggcctacccccagagccccaagaccaccaagcccccctaccccggcagccccgtgaagtacagactgcccgccctgagcggccaggacatgcccaagagaaaggccgagaaggagaagagcaacaaggagagagagggcaccctggcccagcaggccgccggcccccagggcgaggaggccctggagaagcacgtggtggacaagcacgccagcgagaagcacgccgccgccgccggcggcaaggccgagaacagcgccgccctgggcaagcccaccgccggcaccaccgacgccggcgaggccgccaagatcctggccgagaagagaagacaggccagactgcagaaggagcaggaggagcaggagagactggagaaggaggagcaggacagactggagagagaggagctgaagagaaaggccgaggaggagagactgagactggaggaggaggccagaaagcaggaggaggagagaaagagacaggaggaggagaagaagaagcaggagggcgaggagaagagaaaggccggcgaggaggccaagagaaaggccgaggaggagctgctgctgaaggagaagcaggagcaggagaagcaggagaaggccatgatcgagaagcagaaggaggccgccgagaccaaggccagagaggtggccgagcagatgagactggagagagagcagatcatgctgcagatcgagcaggagagactggagagaaagaagagaatcgacgagatcatgaagagaaccagaaagagcgacgtgagcccccaggtgaagaaggaggaccccaaggtgggcgtgcagcccgccgtgtgcgtggagaagaagaccaagctggtggtgcccaacaagatggagatcaacggcctgaacacctgccaggaggtgaacggcgtggaccacgccgcccccgagacctacccccaggacatcttcagcaacggcctgaagcccgccggcggcctgatccacctggacgccctggacggcaagagcaacagcctggacgacagcaccgaggaggtgcagagcatggacgtgagccccgtgagcaaggaggagctgatcagcatccccgagttcagccccgtgagcgagatgatccccggcgtgagcctggaccagaacggcaccggcaacgccagagccctgcaggacctgctggacttcaccggcccccccaccttccccaagagaagcagcgagaacctgagcctggacgactgcaacaagaacctgatcgagggcttcaacagccccggccaggagacccccctgaacaccttctgctag

SEQ ID NO: 22385 - DNA, 2064 bp, Artificial Sequence
  Description of Artificial Sequence: Synthetic coding sequence
atggagagaggcggcggcggcagcggcaccggcagcagacccgagggcaccgccagaggcaccagcctgcccggcaagatcgccgagcccggcgccgtgagaaccagccagcccaactacagaccccagggcatggagggcttcctgaagagcgacgagagacagagactggccaaggagagaagagaggagagagagaagtgcctggccgccagagagcagcagatcctggagaagcagaagagagccagactgcagtacgagaagcagatggaggagagatggagaaagctggaggagcagagacagagagaggaccagaagagagccgccgtggaggagaagagaaagcagaagctgagagaggaggaggagagactggaggccatgatgagaagaagcctggagagaacccagcagctggagctgaagaagaagtacagctggggcgcccccctggccatcggccccggcggccacgacgcccccctgggccccctgaaccccagctacaagagcagccccaccagaaacatcgagaagaagaaggccaccagcaccagcaccagcggcgccggcgacgtgggcaaggaggccctgagcggcggcgaggccagcctggtggagaaggtgaagagaggccagagaaccgccaccagcctgcccgtggtgaacttcggcagccccctgagaagatgcgagttcagcggcggcatccccaagagacccagcagccccgtgatcagcaagaccgccaccaaggcctacccccagagccccaagaccaccaagcccccctaccccggcagccccgtgaagtacagactgcccgccctgagcggccaggacatgcccaagagaaaggccgagaaggagaagagcaacaaggagagagagggcaccctggcccagcaggccgccggcccccagggcgaggaggccctggagaagcacgtggtggacaagcacgccagcgagaagcacgccgccgccgccggcggcaaggccgagaacagcgccgccctgggcaagcccaccgccggcaccaccgacgccggcgaggccgccaagatcctggccgagaagagaagacaggccagactgcagaaggagcaggaggagcaggagagactggagaaggaggagcaggacagactggagagagaggagctgaagagaaaggccgaggaggagagactgagactggaggaggaggccagaaagcaggaggaggagagaaagagacaggaggaggagaagaagaagcaggagggcgaggagaagagaaaggccggcgaggaggccaagagaaaggccgaggaggagctgctgctgaaggagaagcaggagcaggagaagcaggagaaggccatgatcgagaagcagaaggaggccgccgagaccaaggccagagaggtggccgagcagatgagactggagagagagcagatcatgctgcagatcgagcaggagagactggagagaaagaagagaatcgacgagatcatgaagagaaccagaaagagcgacgtgagcccccaggtgaagaaggaggaccccaaggtgggcgtgcagcccgccgtgtgcgtggagaagaagaccaagctggtggtgcccaacaagatggagatcaacggcctgaacacctgccaggaggtgaacggcgtggaccacgccgcccccgagacctacccccaggacatcttcagcaacggcctgaagcccgccggcggcctgatccacctggacgccctggacggcaagagcaacagcctggacgacagcaccgaggaggtgcagagcatggacgtgagccccgtgagcaaggaggagctgatcagcatccccgagttcagccccgtgagcgagatgatccccggcgtgagcctggaccagaacggcaccggcaacgccagagccctgcaggacctgctggacttcaccggcccccccaccttccccaagagaagcagcgagaacctgagcctggacgactgcaacaagaacctgatcgagggcttcaacagccccggccaggagacccccctgaacaccttctgctag

SEQ ID NO: 22386 - DNA, 2043 bp, Artificial Sequence
  Description of Artificial Sequence: Synthetic coding sequence
atggagggcttcctgaagagcgacgagagacagagactggccaaggagagaagagaggagagagagaagtgcctggccgccagagagcagcagatcctggagaagcagaagagagccagactgcagtacgagaagcagatggaggagagatggagaaagctggaggagcagagacagagagaggaccagaagagagccgccgtggaggagaagagaaagcagaagctgagagaggaggaggagagactggaggccatgatgagaagaagcctggagagaacccagcagctggagctgaagaagaagtacagctggggcgcccccctggccatcggccccggcggccacgacgcctgcgacaagctgagcaccagcaccatgagcctgcccaagcccaccgagccccccatgaacaagagactgagcagcagcaccgtggccatcagctacagccccgacagagcccccctgggccccctgaaccccagctacaagagcagccccaccagaaacatcgagaagaagaaggccaccagcaccagcaccagcggcgccggcgacgtgggcaaggaggccctgagcggcggcgaggccagcctggtggagaaggtgaagagaggccagagaaccgccaccagcctgcccgtggtgaacttcggcagccccctgagaagatgcgagttcagcggcggcatccccaagagacccagcagccccgtgatcagcaagaccgccaccaaggcctacccccagagccccaagaccaccaagcccccctaccccggcagccccgtgaagtacagactgcccgccctgagcggccaggacatgcccaagagaaaggccgagaaggagaagagcaacaaggagagagagggcaccctggcccagcaggccgccggcccccagggcgaggaggccctggagaagcacgtggtggacaagcacgccagcgagaagcacgccgccgccgccggcggcaaggccgagaacagcgccgccctgggcaagcccaccgccggcaccaccgacgccggcgaggccgccaagatcctggccgagaagagaagacaggccagactgcagaaggagcaggaggagcaggagagactggagaaggaggagcaggacagactggagagagaggagctgaagagaaaggccgaggaggagagactgagactggaggaggaggccagaaagcaggaggaggagagaaagagacaggaggaggagaagaagaagcaggagggcgaggagaagagaaaggccggcgaggaggccaagagaaaggccgaggaggagctgctgctgaaggagaagcaggagcaggagaagcaggagaaggccatgatcgagaagcagaaggaggccgccgagaccaaggccagagaggtggccgagcagatgagactggagagagagcagatcatgctgcagatcgagcaggagagactggagagaaagaagagaatcgacgagatcatgaagagaaccagaaagagcgacgtgagcccccaggtgaagaaggaggaccccaaggtgggcgtgcagcccgccgtgtgcgtggagaagaagaccaagctggtggtgcccaacaagatggagatcaacggcctgaacacctgccaggaggtgaacggcgtggaccacgccgcccccgagacctacccccaggacatcttcagcaacggcctgaagcccgccggcggcctgatccacctggacgccctggacggcaagagcaacagcctggacgacagcaccgaggaggtgcagagcatggacgtgagccccgtgagcaaggaggagctgatcagcatccccgagttcagccccgtgagcgagatgatccccggcgtgagcctggaccagaacggcaccggcaacgccagagccctgcaggacctgctggacttcaccggcccccccaccttccccaagagaagcagcgagaacctgagcctggacgactgcaacaagaacctgatcgagggcttcaacagccccggccaggagacccccctgaacaccttctgctag

SEQ ID NO: 22387 - DNA, 1854 bp, Artificial Sequence
  Description of Artificial Sequence: Synthetic coding sequence
atgatgagaagaagcctggagagaacccagcagctggagctgaagaagaagtacagctggggcgcccccctggccatcggccccggcggccacgacggcctggccgccagcaccctgccccccgacgccggcaccaccgccgccgccgccgagagcaccaacgcctgcgacaagctgagcaccagcaccatgagcctgcccaagcccaccgagccccccatgaacaagagactgagcagcagcaccgtggccatcagctacagccccgacagagcccccctgggccccctgaaccccagctacaagagcagccccaccagaaacatcgagaagaagaaggccaccagcaccagcaccagcggcgccggcgacgtgggcaaggaggccctgagcggcggcgaggccagcctggtggagaaggtgaagagaggccagagaaccgccaccagcctgcccgtggtgaacttcggcagccccctgagaagatgcgagttcagcggcggcatccccaagagacccagcagccccgtgatcagcaagaccgccaccaaggcctacccccagagccccaagaccaccaagcccccctaccccggcagccccgtgaagtacagactgcccgccctgagcggccaggacatgcccaagagaaaggccgagaaggagaagagcaacaaggagagagagggcaccctggcccagcaggccgccggcccccagggcgaggaggccctggagaagcacgtggtggacaagcacgccagcgagaagcacgccgccgccgccggcggcaaggccgagaacagcgccgccctgggcaagcccaccgccggcaccaccgacgccggcgaggccgccaagatcctggccgagaagagaagacaggccagactgcagaaggagcaggaggagcaggagagactggagaaggaggagcaggacagactggagagagaggagctgaagagaaaggccgaggaggagagactgagactggaggaggaggccagaaagcaggaggaggagagaaagagacaggaggaggagaagaagaagcaggagggcgaggagaagagaaaggccggcgaggaggccaagagaaaggccgaggaggagctgctgctgaaggagaagcaggagcaggagaagcaggagaaggccatgatcgagaagcagaaggaggccgccgagaccaaggccagagaggtggccgagcagatgagactggagagagagcagatcatgctgcagatcgagcaggagagactggagagaaagaagagaatcgacgagatcatgaagagaaccagaaagagcgacgtgagcccccaggtgaagaaggaggaccccaaggtgggcgtgcagcccgccgtgtgcgtggagaagaagaccaagctggtggtgcccaacaagatggagatcaacggcctgaacacctgccaggaggtgaacggcgtggaccacgccgcccccgagacctacccccaggacatcttcagcaacggcctgaagcccgccggcggcctgatccacctggacgccctggacggcaagagcaacagcctggacgacagcaccgaggaggtgcagagcatggacgtgagccccgtgagcaaggaggagctgatcagcatccccgagttcagccccgtgagcgagatgatccccggcgtgagcctggaccagaacggcaccggcaacgccagagccctgcaggacctgctggacttcaccggcccccccaccttccccaagagaagcagcgagaacctgagcctggacgactgcaacaagaacctgatcgagggcttcaacagccccggccaggagacccccctgaacaccttctgctag

SEQ ID NO: 22388 - DNA, 1248 bp, Artificial Sequence
  Description of Artificial Sequence: Synthetic coding sequence
atgagaggcagagactggcccaagaaggacgagaagaaggagaagaacgtgtggctgctgggcagcaacagaagctggagaaacagaaaggagcccggctgcagcaccaagagcaagtggagaagcgacggcgagaactggaagagcagcggcagcggcagaaccaagagagagctgctgtggaagagaaagggcaacagcgccgccctgggcaagcccaccgccggcaccaccgacgccggcgaggccgccaagatcctggccgagaagagaagacaggccagactgcagaaggagcaggaggagcaggagagactggagaaggaggagcaggacagactggagagagaggagctgaagagaaaggccgaggaggagagactgagactggaggaggaggccagaaagcaggaggaggagagaaagagacaggaggaggagaagaagaagcaggagggcgaggagaagagaaaggccggcgaggaggccaagagaaaggccgaggaggagctgctgctgaaggagaagcaggagcaggagaagcaggagaaggccatgatcgagaagcagaaggaggccgccgagaccaaggccagagaggtggccgagcagatgagactggagagagagcagatcatgctgcagatcgagcaggagagactggagagaaagaagagaatcgacgagatcatgaagagaaccagaaagagcgacgtgagcccccaggtgaagaaggaggaccccaaggtgggcgtgcagcccgccgtgtgcgtggagaagaagaccaagctggtggtgcccaacaagatggagatcaacggcctgaacacctgccaggaggtgaacggcgtggaccacgccgcccccgagacctacccccaggacatcttcagcaacggcctgaagcccgccggcggcctgatccacctggacgccctggacggcaagagcaacagcctggacgacagcaccgaggaggtgcagagcatggacgtgagccccgtgagcaaggaggagctgatcagcatccccgagttcagccccgtgagcgagatgatccccggcgtgagcctggaccagaacggcaccggcaacgccagagccctgcaggacctgctggacttcaccggcccccccaccttccccaagagaagcagcgagaacctgagcctggacgactgcaacaagaacctgatcgagggcttcaacagccccggccaggagacccccctgaacaccttctgctag

SEQ ID NO: 22389 - DNA, 522 bp, Artificial Sequence
  Description of Artificial Sequence: Synthetic coding sequence
atgctgccccccccccccagacagccccccccccaggccagagccgccagaggcgccgtgagactgcagagacccttcctgagaagccccctgggcgtgctgagactgctgcagctgctggccggcgccgccttctggatcaccatcgccaccagcaagtaccagggccccgtgcacttcgccctgttcgtgagcgtgctgttctggctgctgaccctgggcctgtacttcctgaccctgctgggcaagcacgagctggtgcccgtgctgggcagcagatggctgatggtgaacgtggcccacgacgtgctggccgccgccctgtacggcgccgccaccggcatcatgagcgaccagatgcagagacacagctactgcaacctgaaggactaccccctgccctgcgcctaccacgccttcctggccgccgccgtgtgcggcggcgtgtgccacggcctgtacctgctgagcgccctgtacggctgcggcagaagatgccagggcaagcaggaggtggcctag

SEQ ID NO: 22390 - DNA, 1158 bp, Artificial Sequence
  Description of Artificial Sequence: Synthetic coding sequence
atgcagaccagcagcaagcccagcgacttcctgaacctggccaagaagaagagaaagttcagcgagctgctgaccaccgtggtgctgctgtgcctgctgacccccagctggaccagcaccggcagaatgtggagccacctgaacagactgctgttctggagcatcttcagcagcgtgacctgcagaaaggccgtgctggactgcgaggccatgaagaccaacgagttccccagcccctgcctggacagcaagaccaaggtggtgatgaagggccagaacgtgagcatgttctgcagccacaagaacaagagcctgcagatcacctacagcctgttcagaagaaagacccacctgggcacccaggacggcaagggcgagcccgccatcttcaacctgagcatcaccgaggcccacgagagcggcccctacaagtgcaaggcccaggtgaccagctgcagcaagtacagcagagacttcagcttcaccatcgtggaccccgtgaccagccccgtgctgaacatcatggtgatccagaccgagaccgacagacacatcaccctgcactgcctgagcgtgaacggcagcctgcccatcaactacaccttcttcgagaaccacgtggccatcagccccgccatcagcaagtacgacagagagcccgccgagttcaacctgaccaagaagaaccccggcgaggaggaggagtacagatgcgaggccaagaacagactgcccaactacgccacctacagccaccccgtgaccatgcccagcaccggcggcgacagctgccccttctgcctgaagctgctgctgcccggcctgctgctgctgctggtggtgatcatcctgatcctggccttctgggtgctgcccaagtacaagaccagaaaggccatgagaaacaacgtgcccagagacagaggcgacaccgccatggaggtgggcatctacgccaacatcctggagaagcaggccaaggaggagagcgtgcccgaggtgggcagcagaccctgcgtgagcaccgcccaggacgaggccaagcacagccaggagctgcagtacgccacccccgtgttccaggaggtggcccccagagagcaggaggcctgcgacagctacaagagcggctacgtgtacagcgagctgaacttctag

SEQ ID NO: 22391 - DNA, 1413 bp, Artificial Sequence
  Description of Artificial Sequence: Synthetic coding sequence
atgaagttcctgctgatcctgctgctgcaggccaccgccagcggcgccctgcccctgaacagcagcaccagcctggagaagaacaacgtgctgttcggcgagagatacctggagaagttctacggcctggagatcaacaagctgcccgtgaccaagatgaagtacagcggcaacctgatgaaggagaagatccaggagatgcagcacttcctgggcctgaaggtgaccggccagctggacaccagcaccctggagatgatgcacgcccccagatgcggcgtgcccgacgtgcaccacttcagagagatgcccggcggccccgtgtggagaaagcactacatcacctacagaatcaacaactacacccccgacatgaacagagaggacgtggactacgccatcagaaaggccttccaggtgtggagcaacgtgacccccctgaagttcagcaagatcaacaccggcatggccgacatcctggtggtgttcgccagaggcgcccacggcgacttccacgccttcgacggcaagggcggcatcctggcccacgccttcggccccggcagcggcatcggcggcgacgcccacttcgacgaggacgagttctggaccacccacagcggcggcaccaacctgttcctgaccgccgtgcacgagatcggccacagcctgggcctgggccacagcagcgaccccaaggccgtgatgttccccacctacaagtacgtggacatcaacaccttcagactgagcgccgacgacatcagaggcatccagagcctgtacggcgaccccaaggagaaccagagactgcccaaccccgacaacagcgagcccgccctgtgcgaccccaacctgagcttcgacgccgtgaccaccgtgggcaacaagatcttcttcttcaaggacagattcttctggctgaaggtgagcgagagacccaagaccagcgtgaacctgatcagcagcctgtggcccaccctgcccagcggcatcgaggccgcctacgagatcgaggccagaaaccaggtgttcctgttcaaggacgacaagtactggctgatcagcaacctgagacccgagcccaactaccccaagagcatccacagcttcggcttccccaacttcgtgaagaagatcgacgccgccgtgttcaaccccagattctacagaacctacttcttcgtggacaaccagtactggagatacgacgagagaagacagatgatggaccccggctaccccaagctgatcaccaagaacttccagggcatcggccccaagatcgacgccgtgttctacagcaagaacaagtactactacttcttccagggcagcaaccagttcgagtacgacttcctgctgcagagaatcaccaagaccctgaagagcaacagctggttcggctgctag

SEQ ID NO: 22392 - DNA, 324 bp, Artificial Sequence
  Description of Artificial Sequence: Synthetic coding sequence
atggccggcgaggacgtgggcgccccccccgaccacctgtgggtgcaccaggagggcatctacagagacgagtaccagagaacctgggtggccgtggtggaggaggagaccagcttcctgagagccagagtgcagcagatccaggtgcccctgggcgacgccgccagacccagccacctgctgaccagccagctgcccctgatgtggcagctgtaccccgaggagagatacatggacaacaacagcagactgtggcagatccagcaccacctgatggtgagaggcgtgcaggagctgctgctgaagctgctgcccgacgactag

SEQ ID NO: 22393 - DNA, 3345 bp, Artificial Sequence
  Description of Artificial Sequence: Synthetic coding sequence
atgctgagctgcctgaaggaggagatgcccccccaggagctgaccagaagactggccaccgtgatcacccacgtggacgagatcatgcagcaggaggtgagacccctgatggccgtggagatcatcgagcagctgcacagacagttcgccatcctgagcggcggcagaggcgaggacggcgcccccatcatcaccttccccgagttcagcggcttcaagcacatccccgacgaggacttcctgaacgtgatgacctacctgaccagcatccccagcgtggaggccgccagcatcggcttcatcgtggtgatcgacagaagaagagacaagtggagcagcgtgaaggccagcctgaccagaatcgccgtggccttccccggcaacctgcagctgatcttcatcctgagacccagcagattcatccagagaaccttcaccgacatcggcatcaagtactacagaaacgagttcaagaccaaggtgcccatcatcatggtgaacagcgtgagcgacctgcacggctacatcgacaagagccagctgaccagagagctgggcggcaccctggagtacagacacggccagtgggtgaaccacagaaccgccatcgagaacttcgccctgaccctgaagaccaccgcccagatgctgcagaccttcggcagctgcctggccaccgccgagctgcccagaagcatgctgagcaccgaggacctgctgatgagccacaccagacagagagacaagctgcaggacgagctgaagctgctgggcaagcagggcaccaccctgctgagctgcatccaggagcccgccaccaagtgccccaacagcaagctgaacctgaaccagctggagaacgtgaccaccatggagagactgctggtgcagctggacgagaccgagaaggccttcagccacttctggagcgagcaccacctgaagctgaaccagtgcctgcagctgcagcacttcgagcacgacttctgcaaggccaagctggccctggacaacctgctggaggagcaggccgagttcaccggcatcggcgacagcgtgatgcacgtggagcagatcctgaaggagcacaagaagctggaggagaagagccaggagcccctggagaaggcccagctgctggccctggtgggcgaccagctgatccagagccaccactacgccgccgacgccatcagacccagatgcgtggagctgagacacctgtgcgacgacttcatcaacggcaacaagaagaagtgggacatcctgggcaagagcctggagttccacagacagctggacaaggtgagccagtggtgcgaggccggcatctacctgctggccagccaggccgtggacaagtgccagagcagagagggcgtggacatcgccctgaacgacatcgccaccttcctgggcaccgtgaaggagtaccccctgctgagccccaaggagttctacaacgagttcgagctgctgctgaccctggacgccaaggccaaggcccagaaggtgctgcagagactggacgacgtgcaggagatcttccacaagagacaggtgagcctgatgaagctggccgccaagcagaccagacccgtgcagcccgtggccccccaccccgagagcagccccaagtgggtgagcagcaagaccagccagcccagcaccagcgtgcccctggccagacccctgagaaccagcgaggagccctacaccgagaccgagctgaacagcagaggcaaggaggacgacgagaccaagttcgaggtgaagagcgaggagatcttcgagagccaccacgagagaggcaaccccgagctggagcagcaggccagactgggcgacctgagccccagaagaagaatcatcagagacctgctggagaccgaggagatctacatcaaggagatcaagagcatcatcgacggctacatcacccccatggacttcatctggctgaagcacctgatccccgacgtgctgcagaacaacaaggacttcctgttcggcaacatcagagagctgtacgagttccacaacagaaccttcctgaaggagctggagaagtgcgccgagaaccccgagctgctggcccactgcttcctgaagagaaaggaggacctgcagatctacttcaagtaccacaagaacctgcccagagccagagccatctggcaggagtgccaggactgcgcctacttcggcgtgtgccagagacagctggaccacaacctgcccctgttcaagtacctgaagggccccagccagagactgatcaagtaccagatgctgctgaagggcctgctggacttcgagagccccgaggacatggagatcgaccccggcgagctgggcggcagcgccaaggacggccccaagagaaccaaggacagcgccttcagcaccgagctgcagcaggccctggccgtgatcgaggacctgatcaagagctgcgagctggccgtggacctggccgccgtgaccgagtgccccgacgacatcggcaagctgggcaagctgctgctgcacggccccttcagcgtgtggaccatccacaaggacagatacaagatgaaggacctgatcagattcaagcccagccagagacagatctacctgttcgagagaggcatcgtgttctgcaagatcagaatggagcccggcgaccagggcctgagcccccactacagcttcaagaagaccatgaagctgatgaccctgagcatcagacagctgggcagaggcagccacagaaagttcgagatcgccagcagaaacggcctggagaagtacatcctgcaggccgccagcaaggagatcagagactgctggttcagcgagatcagcaagctgctgatggagcagcagaacaacatcaaggaccagggcaacccccagttcgagatgagcaccagcaagggcagcggcgccggcagcggcccctggatcaagaacatggagagagccaccaccagcaaggaggaccccgccagcagcaccggcggcatcaagggctgcagcagcagagagttcagcagcatggacaccttcgaggactgcgagggcgccgaggacatggagaaggagagcagcgccctgagcctggccggcctgttccagagcgacgacagccacgagacctgcagcagcaagagcgccttcctggagagaggcgagagcagccagggcgagaaggaggagagagacgaggaggagaccgccaccagaagcaccgaggaggagagagccggcgccagcaccggcagactggcccccgccggcgccaccgccggcttccaggccagagccctgagacccagaaccagcgcccaggagagctag

SEQ ID NO: 22394 - DNA, 1887 bp, Artificial Sequence
  Description of Artificial Sequence: Synthetic coding sequence
atgctgagctgcctgaaggaggagatgcccccccaggagctgaccagaagactggccaccgtgatcacccacgtggacgagatcatgcagcaggaggtgagacccctgatggccgtggagatcatcgagcagctgcacagacagttcgccatcctgagcggcggcagaggcgaggacggcgcccccatcatcaccttccccgagttcagcggcttcaagcacatccccgacgaggacttcctgaacgtgatgacctacctgaccagcatccccagcgtggaggccgccagcatcggcttcatcgtggtgatcgacagaagaagagacaagtggagcagcgtgaaggccagcctgaccagaatcgccgtggccttccccggcaacctgcagctgatcttcatcctgagacccagcagattcatccagagaaccttcaccgacatcggcatcaagtactacagaaacgagttcaagaccaaggtgcccatcatcatggtgaacagcgtgagcgacctgcacggctacatcgacaagagccagctgaccagagagctgggcggcaccctggagtacagacacggccagtgggtgaaccacagaaccgccatcgagaacttcgccctgaccctgaagaccaccgcccagatgctgcagaccttcggcagctgcctggccaccgccgagctgcccagaagcatgctgagcaccgaggacctgctgatgagccacaccagacagagagacaagctgcaggacgagctgaagctgctgggcaagcagggcaccaccctgctgagctgcatccaggagcccgccaccaagtgccccaacagcaagctgaacctgaaccagctggagaacgtgaccaccatggagagactgctggtgcagctggacgagaccgagaaggccttcagccacttctggagcgagcaccacctgaagctgaaccagtgcctgcagctgcagcacttcgagcacgacttctgcaaggccaagctggccctggacaacctgctggaggagcaggccgagttcaccggcatcggcgacagcgtgatgcacgtggagcagatcctgaaggagcacaagaagctggaggagaagagccaggagcccctggagaaggcccagctgctggccctggtgggcgaccagctgatccagagccaccactacgccgccgacgccatcagacccagatgcgtggagctgagacacctgtgcgacgacttcatcaacggcaacaagaagaagtgggacatcctgggcaagagcctggagttccacagacagctggacaaggtgagccagtggtgcgaggccggcatctacctgctggccagccaggccgtggacaagtgccagagcagagagggcgtggacatcgccctgaacgacatcgccaccttcctgggcaccgtgaaggagtaccccctgctgagccccaaggagttctacaacgagttcgagctgctgctgaccctggacgccaaggccaaggcccagaaggtgctgcagagactggacgacgtgcaggagatcttccacaagagacaggtgagcctgatgaagctggccgccaagcagaccagacccgtgcagcccgtggccccccaccccgagagcagccccaagtgggtgagcagcaagaccagccagcccagcaccagcgtgcccctggccagacccctgagaaccagcgaggagccctacaccgagaccgagctgaacagcagaggcaaggaggacgacgagaccaagttcgaggtgaagagcgaggagatcttcgagagccaccacgagagaggcaaccccgagctggagcagcaggccagactgggcgacctgagccccagaagatacagcagccagtacttcaagtag

SEQ ID NO: 22395 - DNA, 519 bp, Artificial Sequence
  Description of Artificial Sequence: Synthetic coding sequence
atgcacgtggagctgagacacctgtgcgacgacttcatcaacggcaacaagaagaagtgggacatcctgggcaagagcctggagttccacagacagctggacaaggccaaggcccagaaggtgctgcagagactggacgacgtgcaggagatcttccacaagagacaggtgagcctgatgaagctggccgccaagcagaccagacccgtgcagcccgtggccccccaccccgagagcagccccaagtgggtgagcagcaagaccagccagcccagcaccagcgtgcccctggccagacccctgagaaccagcgaggagccctacaccgagaccgagctgaacagcagaggcaaggaggacgacgagaccaagttcgaggtgaagagcgaggagatcttcgagagccaccacgagagaggcaaccccgagctggagcagcaggccagactgggcgacctgagccccagaagcgtgatcaccgtgtgcgtgtgcgagatgctgaccctgggcgtgcagtag

SEQ ID NO: 22396 - DNA, 2136 bp, Artificial Sequence
  Description of Artificial Sequence: Synthetic coding sequence
atgctgagctgcctgaaggaggagatgcccccccaggagctgaccagaagactggccaccgtgatcacccacgtggacgagatcatgcagcaggaggtgagacccctgatggccgtggagatcatcgagcagctgcacagacagttcgccatcctgagcggcggcagaggcgaggacggcgcccccatcatcaccttccccgagttcagcggcttcaagcacatccccgacgaggacttcctgaacgtgatgacctacctgaccagcatccccagcgtggaggccgccagcatcggcttcatcgtggtgatcgacagaagaagagacaagtggagcagcgtgaaggccagcctgaccagaatcgccgtggccttccccggcaacctgcagctgatcttcatcctgagacccagcagattcatccagagaaccttcaccgacatcggcatcaagtactacagaaacgagttcaagaccaaggtgcccatcatcatggtgaacagcgtgagcgacctgcacggctacatcgacaagagccagctgaccagagagctgggcggcaccctggagtacagacacggccagtgggtgaaccacagaaccgccatcgagaacttcgccctgaccctgaagaccaccgcccagatgctgcagaccttcggcagctgcctggccaccgccgagctgcccagaagcatgctgagcaccgaggacctgctgatgagccacaccagacagagagacaagctgcaggacgagctgaagctgctgggcaagcagggcaccaccctgctgagctgcatccaggagcccgccaccaagtgccccaacagcaagctgaacctgaaccagctggagaacgtgaccaccatggagagactgctggtgcagctggacgagaccgagaaggccttcagccacttctggagcgagcaccacctgaagctgaaccagtgcctgcagctgcagcacttcgagcacgacttctgcaaggccaagctggccctggacaacctgctggaggagcaggccgagttcaccggcatcggcgacagcgtgatgcacgtggagcagatcctgaaggagcacaagaagctggaggagaagagccaggagcccctggagaaggcccagctgctggccctggtgggcgaccagctgatccagagccaccactacgccgccgacgccatcagacccagatgcgtggagctgagacacctgtgcgacgacttcatcaacggcaacaagaagaagtgggacatcctgggcaagagcctggagttccacagacagctggacaaggtgagccagtggtgcgaggccggcatctacctgctggccagccaggccgtggacaagtgccagagcagagagggcgtggacatcgccctgaacgacatcgccaccttcctgggcaccgtgaaggagtaccccctgctgagccccaaggagttctacaacgagttcgagctgctgctgaccctggacgccaaggccaaggcccagaaggtgctgcagagactggacgacgtgcaggagatcttccacaagagacaggtgagcctgatgaagctggccgccaagcagaccagacccgtgcagcccgtggccccccaccccgagagcagccccaagtgggtgagcagcaagaccagccagcccagcaccagcgtgcccctggccagacccctgagaaccagcgaggagccctacaccgagaccgagctgaacagcagaggcaaggaggacgacgagaccaagttcgaggtgaagagcgaggagatcttcgagagccaccacgagagaggcaaccccgagctggagcagcaggccagactgggcgacctgagccccagaagaagaatcatcagagacctgctggagaccgaggagatctacatcaaggagatcaagagcatcatcgacggctacatcacccccatggacttcatctggctgaagcacctgatccccgacgtgctgcagaacaacaaggacttcctgttcggcaacatcagagagctgtacgagttccacaacagaaccttcctgaaggagctggagaagtgcgccgagaaccccgagctgctggcccactgcttcctgaagagagtgagcctgtacagccagtag

SEQ ID NO: 22397 - DNA, 3225 bp, Artificial Sequence
  Description of Artificial Sequence: Synthetic coding sequence
atgctgagctgcctgaaggaggagatgcccccccaggagctgaccagaagactggccaccgtgatcacccacgtggacgagatcatgcagcaggaggtgagacccctgatggccgtggagatcatcgagcagctgcacagacagttcgccatcctgagcggcggcagaggcgaggacggcgcccccatcatcaccttccccgagttcagcggcttcaagcacatccccgacgaggacttcctgaacgtgatgacctacctgaccagcatccccagcgtggaggccgccagcatcggcttcatcgtggtgatcgacagaagaagagacaagtggagcagcgtgaaggccagcctgaccagaatcgccgtggccttccccggcaacctgcagctgatcttcatcctgagacccagcagattcatccagagaaccttcaccgacatcggcatcaagtactacagaaacgagttcaagaccaaggtgcccatcatcatggtgaacagcgtgagcgacctgcacggctacatcgacaagagccagctgaccagagagctgggcggcaccctggagtacagacacggccagtgggtgaaccacagaaccgccatcgagaacttcgccctgaccctgaagaccaccgcccagatgctgcagaccttcggcagctgcctggccaccgccgagctgcccagaagcatgctgagcaccgaggacctgctgatgagccacaccagacagagagacaagctgcaggacgagctgaagctgctgggcaagcagggcaccaccctgctgagctgcatccaggagcccgccaccaagtgccccaacagcaagctgaacctgaaccagctggagaacgtgaccaccatggagagactgctggtgcagctggacgagaccgagaaggccttcagccacttctggagcgagcaccacctgaagctgaaccagtgcctgcagctgcagcacttcgagcacgacttctgcaaggccaagctggccctggacaacctgctggaggagcaggccgagttcaccggcatcggcgacagcgtgatgcacgtggagcagatcctgaaggagcacaagaagctggaggagaagagccaggagcccctggagaaggcccagctgctggccctggtgggcgaccagctgatccagagccaccactacgccgccgacgccatcagacccagatgcgtggagctgagacacctgtgcgacgacttcatcaacggcaacaagaagaagtgggacatcctgggcaagagcctggagttccacagacagctggacaaggtgagccagtggtgcgaggccggcatctacctgctggccagccaggccgtggacaagtgccagagcagagagggcgtggacatcgccctgaacgacatcgccaccttcctgggcaccgtgaaggagtaccccctgctgagccccaaggagttctacaacgagttcgagctgctgctgaccctggacgccaaggccaaggcccagaaggtgctgcagagactggacgacgtgcaggagatcttccacaagagacaggtgagcctgatgaagctggccgccaagcagaccagacccgtgcagcccgtggccccccaccccgagagcagccccaagtgggtgagcagcaagaccagccagcccagcaccagcgtgcccctggccagacccctgagaaccagcgaggagccctacaccgagaccgagctgaacagcagaggcaaggaggacgacgagaccaagttcgaggtgaagagcgaggagatcttcgagagccaccacgagagaggcaaccccgagctggagcagcaggccagactgggcgacctgagccccagaagaagaatcatcagagacctgctggagaccgaggagatctacatcaaggagatcaagagcatcatcgacggctacatcacccccatggacttcatctggctgaagcacctgatccccgacgtgctgcagaacaacaaggacttcctgttcggcaacatcagagagctgtacgagttccacaacagaaccttcctgaaggagctggagaagtgcgccgagaaccccgagctgctggcccactgcttcctgaagagaaaggaggacctgcagatctacttcaagtaccacaagaacctgcccagagccagagccatctggcaggagtgccaggactgcgcctacttcggcgtgtgccagagacagctggaccacaacctgcccctgttcaagtacctgaagggccccagccagagactgatcaagtaccagatgctgctgaagggcctgctggacttcgagagccccgaggacatggagatcgaccccggcgagctgggcggcagcgccaaggacggccccaagagaaccaaggacagcgccttcagcaccgagctgcagcaggccctggccgtgatcgaggacctgatcaagagctgcgagctggccgtggacctggccgccgtgaccgagtgccccgacgacatcggcaagctgggcaagctgctgctgcacggccccttcagcgtgtggaccatccacaaggacagatacaagatgaaggacctgatcagattcaagcccagccagagacagatctacctgttcgagagaggcatcgtgttctgcaagatcagaatggagcccggcgaccagggcctgagcccccactacagcttcaagaagaccatgaagctgatgaccctgagcatcagacagctgggcagaggcagccacagaaagttcgagatcgccagcagaaacggcctggagaagtacatcctgcaggccgccagcaaggagatcagagactgctggttcagcgagatcagcaagctgctgatggagcagcagaacaacatcaaggaccagggcaacccccagttcgagatgagcaccagcaagggcagcggcgccggcagcggcccctggatcaagaacatggagagagccaccaccagcaaggaggaccccgccagcagcaccggcggcatcaagggctgcagcagcagagagttcagcagcatggacaccttcgaggactgcgagggcgccgaggacatggagaaggagagcagcgccctgagcctggccggcctgttccagagcgacgacagccacgagacctgcagcagcaagagcgccttcctggagagaggcgagagcagccagggcgagaaggaggagagagacgaggaggagacctag

SEQ ID NO: 22398 - DNA, 360 bp, Artificial Sequence
  Description of Artificial Sequence: Synthetic coding sequence
atggaggagcccgagatgcagctgaagggcaagaaggtgaccgacaagttcaccgagagcgtgtacgtgctggccaacgagcccagcgtggccctgtacagactgcaggagcacgtgagaagaagcctgcccgagctggcccagcacaaggccgacatgcagagatgggaggagcagagccagggcgccatctacaccgtggagtacgcctgcagcgccgtgaagaacctggtggacagcagcgtgtacttcagaagcgtggagggcctgctgaagcaggccatcagcatcagagaccacatgaacgccagcgcccagggccacagccccgaggagccccccccccccagcagcgcctag

SEQ ID NO: 22399 - DNA, 330 bp, Artificial Sequence
  Description of Artificial Sequence: Synthetic coding sequence
atggaggagcccgagatgcagctgaagggcaagaaggtgaccgacaagttcaccgagagcgtgtacgtgctggccaacgagcccagcgtggccctgtacagactgcaggagcacgtgagaagaagcctgcccgagctggcccagcacaaggccgacatgcagagatgggaggagcagagccagggcgccatctacaccgtggagtacgcctgcagcgccgtgaagaacctggtggacagcagcgtgtacttcagaagcgtggagggcctgctgaagcaggccatcagcatcagagaccacatgaacgccagcgcccagggccacagatag

SEQ ID NO: 22400 - DNA, 717 bp, Artificial Sequence
  Description of Artificial Sequence: Synthetic coding sequence
atgctggccctgaccctggccaaggccgacagccccagaaccgccctgctgtgcagcgcctggctgctgaccgccagcttcagcgcccagcagcacaagggcagcctgcaggtgcaccagaccctgagcgtggagatggaccaggtgctgaaggccctgagcttccccaagaagaaggccgccctgctgagcgccgccatcctgtgcttcctgagaaccgccctgagacagagcttcagcagcgccctggtggccctggtgcccagcggcgcccagcccctgcccgccaccaaggacaccgtgctggcccccctgagaatgagccaggtgagaagcctggtgatcggcctgcagaacctgctggtgcagaaggaccccctgctgagccaggcctgcgtgggctgcctggaggccctgctggactacctggacgccagaagccccgacatcgccctgcacgtggccagccagccctggaacagattcctgctgttcaccctgctggacgccggcgagaacagcttcctgagacccgagatcctgagactgatgaccctgctgcagagcatgggccacctggccgaccacagcatggcccagaccctgcaggccagcctggagggcctgccccccagcaccagcagcggccagccccccctgcaggacatgctgtgcctgggcggcgtggccgtgagcctgagccacatcagaaactag

SEQ ID NO: 22401 - DNA, 1824 bp, Artificial Sequence
  Description of Artificial Sequence: Synthetic coding sequence
atgtgcctgaacctgctgagcgcccccgagaagaccggcccccccagcaaggaggagctgagcgccgtgagcgagctgctgcagcacggcctgccccagatcagcagcagaagccccgagagcctggccttcctgagcgacagacagtacatggagggcgccgccagacagagacagtactgcatcctgctgctgttctacctggcctacatccacgaggacagattcgtgagcgaggccgagctgttcgaggccgtgcagagcttcctgctgagcctgcaggaccagggcgagagaccccccctggtggtgttcaaggccagcatctacctgctggccatctgccaggacaaggacaacaccctgagagagaccatggtgagcgccatcagaaagttcctggagggcatccccgacctgcagctggtgtacacccaccaccccctgctgctgagattcttcctgctgtaccccgagctgatgagcagatacggccacagagtgctggagctgtggttcttctgggaggagagcagctacgaggagctggacgacgtgaccagcgccggccagcccgccctgcccgccagcctggtggtgctgttccagctgctgagaagcatccccagcatcctgctgatcctgctggacctgatctacagcagccccgtggacaccgcccacaaggtgctgatcagcctgagaaccttcctgagaagaaacgaggacatccaggtgggcggcctgatcagaggccacttcctgctgatcctgcagagactgctggtggagcacggcgccagccccagcggcgtgagcaagctgtgcggcaagtgcagccccaccgacgtggacatcctgcagcccagcttcaacttcctgtactggagcctgcaccagaccacccccagcagccagaagagagccgccgccgtgctgctgagcagcaccggcctgatggagctgctggagaagatgctggccctgaccctggccaaggccgacagccccagaaccgccctgctgtgcagcgcctggctgctgaccgccagcttcagcgcccagcagcacaagggcagcctgcaggtgcaccagaccctgagcgtggagatggaccaggtgctgaaggccctgagcttccccaagaagaaggccgccctgctgagcgccgccatcctgtgcttcctgagaaccgccctgagacagagcttcagcagcgccctggtggccctggtgcccagcggcgcccagcccctgcccgccaccaaggacaccgtgctggcccccctgagaatgagccaggtgagaagcctggtgatcggcctgcagaacctgctggtgcagaaggaccccctgctgagccaggcctgcgtgggctgcctggaggccctgctggactacctggacgccagaagccccgacatcgccctgcacgtggccagccagccctggaacagattcctgctgttcaccctgctggacgccggcgagaacagcttcctgagacccgagatcctgagactgatgaccctgttcatgagatacagaagcagcagcgtgctgagccacgaggaggtgggcgacgtgctgcagggcgtggccctggccgacctgagcaccctgagcaacaccaccctgcaggccctgcacggcttcttccagcagctgcagagcatgggccacctggccgaccacagcatggcccagaccctgcaggccagcctggagggcctgccccccagcaccagcagcggccagccccccctgcaggacatgctgtgcctgggcggcgtggccgtgagcctgagccacatcagaaactag

SEQ ID NO: 22402 - DNA, 3825 bp, Artificial Sequence
  Description of Artificial Sequence: Synthetic coding sequence
atggccgtgagacaggccgccaccgccggcacccccggccccagaagagaggaggaggccgccctgctgttcgagagagcccactacagacacgaccccagatggctgctgcccgtgacccccagactgtgcctggcctgcgccctggagctgctgcccgaccccggcgtgagcctggtgagaaagaagcacatgctgagctgcttccaggacgccctggtgagacacaccagcctggtgacccagctggtgagccaggaccagagagtgtgcatccacttcatcagcgtgctgttcggcctgctgtgcagcatggaggacggcagcgtgaccgacctgtgcatcgaggtgctgatccagatcaccacccagctgaagctggagcagaccatcagatgcctgctggacgagtgccacaaggagctgtgcaacatgcccagcatgagaggcagcctggccaccctgaccctgctgggcaagctggtggacgccatccccgccctggccgacgagctggtgatggagcacggcaacctgatggagcacctgctgagaggcctggtgtaccccagcgagggcatccaggccagcgtgtgctacctgtacggcaagctgtacagcagccccgtggccgccgagatgctgagcggccacttcagagagaagctgttccccctgttcctgagcatcctggacggcgcccagaccaaggagctgcagatcaactgcctgggcctgctgagacagctgctgaagtacgacctgttcgtgagcatgatcatgaaccaggacggcctgggcgagagcgccaagaacatcgagggcagcagcggcaacaccagcctgcccctggtgctgaagaagctgctgctgagcagagacgagaccctgcaggtggccagcgcccactgcatcaccgccgtgctggtgcacagccccgccaagcacgccagcgccttcatccacgccgacatccccgagttcctgttcgagcacctgagcagcagcagcgaggtgctggtgtggagcagctgcaactgcctgaccctgctggtggaggagcccctgttcttcagcaagtgccacaccgtgtacggcatcgaggccgtggtgagaagcctgcagggcagcctgaagatgaacaacatcgagctgcacaagcagggcctgctgctgttcgccgagatcctgaccagacagcccgaggagatcaagctgttcaccagcagcgccatgtgcagagacgccggcagagccctgcaggaggccgtgagcagccccgtgctggaggtggccgccgaggccctgaaggccaccagcgccttcctgagaaaggaccaccagagcaccccccccgtgcagtacggcgagctgcaggccctgctggaggccatgctgaacagatgcgccgagttcagccagaccctgctgagcagaagacccctgggccacgccagcagcagagacagcgagaaggccatcctgcagagaggcaagttcctgctgagcaccctggagggcttcagaagcgcctgcagactggccatcgagttccagagcgagcccagcgcccaggagaaccccttcaccgcccccagcgccaagaaggaggacaccctggaggccttcagcgagttcctgctgagcgcctgcgacagcctgtgcatccccatggtgatgagacacctggagcagaccacccaccccgccctgatggaggtgttcctgagcatcctgcacaacctgttcgtgatcgtgccccacatgaaggagaagttcagcaagaagctggccagcagcagcttcatcagactgaccctggagctgaaggccagattctgcagcggcctgagccacagcgccctgaaccaggtgtgcagcaacttcctgtactacatgtgcctgaacctgctgagcgcccccgagaagaccggcccccccagcaaggaggagctgagcgccgtgagcgagctgctgcagcacggcctgccccagatcagcagcagaagccccgagagcctggccttcctgagcgacagacagtacatggagggcgccgccagacagagacagtactgcatcctgctgctgttctacctggcctacatccacgaggacagattcgtgagcgaggccgagctgttcgaggccgtgcagagcttcctgctgagcctgcaggaccagggcgagagaccccccctggtggtgttcaaggccagcatctacctgctggccatctgccaggacaaggacaacaccctgagagagaccatggtgagcgccatcagaaagttcctggagggcatccccgacctgcagctggtgtacacccaccaccccctgctgctgagattcttcctgctgtaccccgagctgatgagcagatacggccacagagtgctggagctgtggttcttctgggaggagagcagctacgaggagctggacgacgtgaccagcgccggccagcccgccctgcccgccagcctggtggtgctgttccagctgctgagaagcatccccagcatcctgctgatcctgctggacctgatctacagcagccccgtggacaccgcccacaaggtgctgatcagcctgagaaccttcctgagaagaaacgaggacatccaggtgggcggcctgatcagaggccacttcctgctgatcctgcagagactgctggtggagcacggcgccagccccagcggcgccagcggcaacctgcccctgctgctgagcctgctgagcctgatgcagctgagaaacgtgagcgagcaggagctggacagcgtggccatgaagctgctgcaccaggtgagcaagctgtgcggcaagtgcagccccaccgacgtggacatcctgcagcccagcttcaacttcctgtactggagcctgcaccagaccacccccagcagccagaagagagccgccgccgtgctgctgagcagcaccggcctgatggagctgctggagaagatgctggccctgaccctggccaaggccgacagccccagaaccgccctgctgtgcagcgcctggctgctgaccgccagcttcagcgcccagcagcacaagggcagcctgcaggtgcaccagaccctgagcgtggagatggaccaggtgctgaaggccctgagcttccccaagaagaaggccgccctgctgagcgccgccatcctgtgcttcctgagaaccgccctgagacagagcttcagcagcgccctggtggccctggtgcccagcggcgcccagcccctgcccgccaccaaggacaccgtgctggcccccctgagaatgagccaggtgagaagcctggtgatcggcctgcagaacctgctggtgcagaaggaccccctgctgagccaggcctgcgtgggctgcctggaggccctgctggactacctggacgccagaagccccgacatcgccctgcacgtggccagccagccctggaacagattcctgctgttcaccctgctggacgccggcgagaacagcttcctgagacccgagatcctgagactgatgaccctgttcatgagatacagaagcagcagcgtgctgagccacgaggaggtgggcgacgtgctgcagggcgtggccctggccgacctgagcaccctgagcaacaccaccctgcaggccctgcacggcttcttccagcagctgcagagcatgggccacctggccgaccacagcatggcccagaccctgcaggccagcctggagggcctgccccccagcaccagcagcggccagccccccctgcaggacatgctgtgcctgggcggcgtggccgtgagcctgagccacatcagaaactag

SEQ ID NO: 22403 - DNA, 1155 bp, Artificial Sequence
  Description of Artificial Sequence: Synthetic coding sequence
atgggccacccccaccaggagagcagcctgttcttcaccgccagcggcaacctgcccctgctgctgagcctgctgagcctgatgcagctgagaaacgtgagcgagcaggagctggacagcgtggccatgaagctgctgcaccaggtgagcaagctgtgcggcaagtgcagccccaccgacgtggacatcctgcagcccagcttcaacttcctgtactggagcctgcaccagaccacccccagcagccagaagagagccgccgccgtgctgctgagcagcaccggcctgatggagctgctggagaagatgctggccctgaccctggccaaggccgacagccccagaaccgccctgctgtgcagcgcctggctgctgaccgccagcttcagcgcccagcagcacaagggcagcctgcaggtgcaccagaccctgagcgtggagatggaccaggtgctgaaggccctgagcttccccaagaagaaggccgccctgctgagcgccgccatcctgtgcttcctgagaaccgccctgagacagagcttcagcagcgccctggtggccctggtgcccagcggcgcccagcccctgcccgccaccaaggacaccgtgctggcccccctgagaatgagccaggtgagaagcctggtgatcggcctgcagaacctgctggtgcagaaggaccccctgctgagccaggcctgcgtgggctgcctggaggccctgctggactacctggacgccagaagccccgacatcgccctgcacgtggccagccagccctggaacagattcctgctgttcaccctgctggacgccggcgagaacagcttcctgagacccgagatcctgagactgatgaccctgttcatgagatacagaagcagcagcgtgctgagccacgaggaggtgggcgacgtgctgcagggcgtggccctggccgacctgagcaccctgagcaacaccaccctgcaggccctgcacggcttcttccagcagctgcagagcatgggccacctggccgaccacagcatggcccagaccctgcaggccagcctggagggcctgccccccagcaccagcagcggccagccccccctgcaggacatgctgtgcctgggcggcgtggccgtgagcctgagccacatcagaaactag

SEQ ID NO: 22404 - DNA, 1521 bp, Artificial Sequence
  Description of Artificial Sequence: Synthetic coding sequence
atgaaccaggacggcctgggcgagagcgccaagaacatcgagggcagcagcggcaacaccagcctgcccctggtgctgaagaagctgctgctgagcagagacgagaccctgcaggtggccagcgcccactgcatcaccgccgtgctggtgcacagccccgccaagcacgccagcgccttcatccacgccgacatccccgagttcctgttcgagcacctgagcagcagcagcgaggtgctggtgtggagcagctgcaactgcctgaccctgctggtggaggagcccctgttcttcagcaagtgccacaccgtgtacggcatcgaggccgtggtgagaagcctgcagggcagcctgaagatgaacaacatcgagctgcacaagcagggcctgctgctgttcgccgagatcctgaccagacagcccgaggagatcaagctgttcaccagcagcgccatgtgcagagacgccggcagagccctgcaggaggccgtgagcagccccgtgctggaggtggccgccgaggccctgaaggccaccagcgccttcctgagaaaggaccaccagagcaccccccccgtgcagtacggcgagctgcaggccctgctggaggccatgctgaacagatgcgccgagttcagccagaccctgctgagcagaagacccctgggccacgccagcagcagagacagcgagaaggccatcctgcagagaggcaagttcctgctgagcaccctggagggcttcagaagcgcctgcagactggccatcgagttccagagcgagcccagcgcccaggagaaccccttcaccgcccccagcgccaagaaggaggacaccctggaggccttcagcgagttcctgctgagcgcctgcgacagcctgtgcatccccatggtgatgagacacctggagcagaccacccaccccgccctgatggaggtgttcctgagcatcctgcacaacctgttcgtgatcgtgccccacatgaaggagaagttcagcaagaagctggccagcagcagcttcatcagactgaccctggagctgaaggccagattctgcagcggcctgagccacagcgccctgaaccaggtgtgcagcaacttcctgtactacatgtgcctgaacctgctgagcgcccccgagaagaccggcccccccagcaaggaggagctgagcgccgtgagcgagctgctgcagcacggcctgccccagatcagcagcagaagccccgagagcctggccttcctgagcgacagacagtacatggagggcgccgccagacagagacagtactgcatcctgctgctgttctacctggcctacatccacgaggacagattcgtgagcgaggccgagctgttcgaggccgtgcagagcttcctgctgagcctgcaggaccagggcgagagaccccccctggtggtgttcaaggccagcatctacctgctggccatctgccaggacaaggacaacaccctgagagagcagctgcactgcagcctgatcagcatcagctag

SEQ ID NO: 22405 - DNA, 810 bp, Artificial Sequence
  Description of Artificial Sequence: Synthetic coding sequence
atggagggcgccgccagacagagacagtactgcatcctgctgctgttctacctggcctacatccacgaggacagattcgtgagcgaggccgagctgttcgaggccgtgcagagcttcctgctgagcctgcaggaccagggcgagagaccccccctggtggtgttcaaggccagcatctacctgctggccatctgccaggacaaggacaacaccctgagagagaccatggtgagcgccatcagaaagttcctggagggcatccccgacctgcagctggtgtacacccaccaccccctgctgctgagattcttcctgctgtaccccgagctgatgagcagatacggccacagagtgctggagctgtggttcttctgggaggagagcagctacgaggagctggacgacgtgaccagcgccggccagcccgccctgcccgccagcctggtggtgctgttccagctgctgagaagcatccccagcatcctgctgatcctgctggacctgatctacagcagccccgtggacaccgcccacaaggtgctgatcagcctgagaaccttcctgagaagaaacgaggacatccaggtgggcggcctgatcagaggccacttcctgctgatcctgcagagactgctggtggagcacggcgccagccccagcggcgtgctgctggtgctgcacagcctgggcgagcccaccatcgccgccgagccccccctgcccgacgccgcccaggagtgcgtgagagccagaaccggccagagaggccacgaggcccccagccccagatgccccggctgcctgggctag

SEQ ID NO: 22406 - DNA, 1203 bp, Artificial Sequence
  Description of Artificial Sequence: Synthetic coding sequence
atgagcaaggtgagcaccatgttcagcgaggacgacttccagagcaccgagagagccccctacggcccccagctgcagtggagccaggacctgcccagagtgcaggtgttcagagagcaggccaacctggaggacagaagccccagaagaacccagagaatcaccggcggcgagcaggtgctgtggggccccatcacccagatcttccccaccgtgagacccgccgacctgaccagagtgatcatgcccctggagcagagaagccagcactgcaagcccgaggagggcctgcaggcccaggaggaggacctgggcctggtgggcgcccaggccctgcaggccgaggagcaggaggccgccttcttcagcagcaccctgaacgtgggcaccctggaggagctgcccgccgccgagagccccagccccccccagagcccccaggaggagagcttcagccccaccgccatggacgccatcttcggcagcctgagcgacgagggcagcggcagccaggagaaggagggccccagcaccagccccgacctgatcgaccccgagagcttcagccaggacatcctgcacgacaagatcatcgacctggtgcacctgctgctgagaaagtacagagtgaagggcctgatcaccaaggccgagatgctgggcagcgtgatcaagaactacgaggactacttccccgagatcttcagagaggccagcgtgtgcatgcagctgctgttcggcatcgacgtgaaggaggtggaccccaccagccacagctacgtgctggtgaccagcctgaacctgagctacgacggcatccagtgcaacgagcagagcatgcccaagagcggcctgctgatcatcgtgctgggcgtgatcttcatggagggcaactgcatccccgaggaggtgatgtgggaggtgctgagcatcatgggcgtgtacgccggcagagagcacttcctgttcggcgagcccaagagactgctgacccagaactgggtgcaggagaagtacctggtgtacagacaggtgcccggcaccgaccccgcctgctacgagttcctgtggggccccagagcccacgccgagaccagcaagatgaaggtgctggagtacatcgccaacgccaacggcagagaccccaccagctaccccagcctgtacgaggacgccctgagagaggagggcgagggcgtgtag

SEQ ID NO: 22407 - DNA, 957 bp, Artificial Sequence
  Description of Artificial Sequence: Synthetic coding sequence
atgctgctgggccagaagagccagagatacaaggccgaggagggcctgcaggcccagggcgaggcccccggcctgatggacgtgcagatccccaccgccgaggagcagaaggccgccagcagcagcagcaccctgatcatgggcaccctggaggaggtgaccgacagcggcagccccagccccccccagagccccgagggcgccagcagcagcctgaccgtgaccgacagcaccctgtggagccagagcgacgagggcagcagcagcaacgaggaggagggccccagcaccagccccgaccccgcccacctggagagcctgttcagagaggccctggacgagaaggtggccgagctggtgagattcctgctgagaaagtaccagatcaaggagcccgtgaccaaggccgagatgctggagagcgtgatcaagaactacaagaaccacttccccgacatcttcagcaaggccagcgagtgcatgcaggtgatcttcggcatcgacgtgaaggaggtggaccccgccggccacagctacatcctggtgacctgcctgggcctgagctacgacggcctgctgggcgacgaccagagcacccccaagaccggcctgctgatcatcgtgctgggcatgatcctgatggagggcagcagagcccccgaggaggccatctgggaggccctgagcgtgatgggcctgtacgacggcagagagcacagcgtgtactggaagctgagaaagctgctgacccaggagtgggtgcaggagaactacctggagtacagacaggcccccggcagcgaccccgtgagatacgagttcctgtggggccccagagccctggccgagaccagctacgtgaaggtgctggagcacgtggtgagagtgaacgccagagtgagaatcagctaccccagcctgcacgaggaggccctgggcgaggagaagggcgtgtag

SEQ ID NO: 22408 - DNA, 957 bp, Artificial Sequence; identical to SEQ ID NO: 22407
  Description of Artificial Sequence: Synthetic coding sequence

SEQ ID NO: 22409 - DNA, 957 bp, Artificial Sequence; identical to SEQ ID NO: 22407
  Description of Artificial Sequence: Synthetic coding sequence

SEQ ID NO: 22410 - DNA, 945 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcagcagaccgccagcagcagcagcaccctggtggaggtgaccctgggcgaggtgcccgccgccgacagccccagccccccccacagcccccagggcgccagcagcttcagcaccaccatcaactacaccctgtggagacagagcgacgagggcagcagcaaccaggaggaggagggccccagaatgttccccgacctggagagcgagttccaggccgccatcagcagaaagatggtggagctggtgcacttcctgctgctgaagtacagagccagagagcccgtgaccaaggccgagatgctggagagcgtgctgagaaactgccaggacttcttccccgtgatcttcagcaaggccagcgagtacctgcagctggtgttcggcatcgaggtggtggaggtggtgcccatcagccacctgtacatcctggtgacctgcctgggcctgagctacgacggcctgctgggcgacaaccaggtgatgcccaagaccggcctgctgatcatcgtgctggccatcatcgccatcgagggcgactgcgcccccgaggagaagatctgggaggagctgagcatgctggaggtgttcgagggcagagaggacagcgtgttcgcccaccccagaaagctgctgatgcaggacctggtgcaggagaactacctggagtacagacaggtgcccggcagcgaccccgcctgctacgagttcctgtggggccccagagccctgatcgagaccagctacgtgaaggtgctgcaccacaccctgaagatcggcggcgagccccacatcagctacccccccctgcacgagagagccctgagagagggcgaggagtag

SEQ ID NO: 22411 - DNA, 945 bp, Artificial Sequence; identical to SEQ ID NO: 22410
  Description of Artificial Sequence: Synthetic coding sequence

SEQ ID NO: 22412 - DNA, 102 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccacctag

SEQ ID NO: 22413 - DNA, 363 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcagcagaccgccagcagcagcagcaccctggtggaggtgaccctgggcgaggtgcccgccgccgacagccccagccccccccacagcccccagggcgccagcagcttcagcaccaccatcaactacaccctgtggagacagagcgacgagggcagcagcaaccaggaggaggagggccccagaatgttccccgacctggagagcgagttccaggccgccatcagcagaaagatggtggagctggtgcacttcctgtag

SEQ ID NO: 22414 - DNA, 459 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcagcagaccgccagcagcagcagcaccctggtggaggtgaccctgggcgaggtgcccgccgccgacagccccagccccccccacagcccccagggcgccagcagcttcagcaccaccatcaactacaccctgtggagacagagcgacgagggcagcagcaaccaggaggaggagggccccagaatgttccccgacctggagagcgagttccaggccgccatcagcagaaagatggtggagctggtgcacttcctgctgctgaagtacagagccagagagcccgtgaccaaggccgagatgctggagagcgtgctgagaaactgccaggacttcttccccgtgatcttcagctag

SEQ ID NO: 22415 - DNA, 270 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcagcagaccgccagcagcagcagcaccctggtggaggtgaccctgggcgaggtgcccgccgccgacagccccagccccccccacagcccccagggcgccagcagcttcagcaccaccatcaactacaccctgtggagacagagcgacgagggcagcagcaactag

SEQ ID NO: 22416 - DNA, 447 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcagcagaccgccagcagcagcagcaccctggtggaggtgaccctgggcgaggtgcccgccgccgacagccccagccccccccacagcccccagggcgccagcagcttcagcaccaccatcaactacaccctgtggagacagagcgacgagggcagcagcaaccaggaggaggagggccccagaatgttccccgacctggagagcgagttccaggccgccatcagcagaaagatggtggagctggtgcacttcctgctgctgaagtacagagccagagagcccgtgaccaaggccgagatgctggagagcgtgctgagaaactgccaggacttcttcccctag

SEQ ID NO: 22417 - DNA, 114 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcagcagtag

SEQ ID NO: 22418 - DNA, 1032 bp, Artificial Sequence
  Description of Artificial Sequence: Synthetic coding sequence
atgcccagaggccagaagagcaagctgagagccagagagaagagacaccaggccagatgcgagaaccaggacctgggcgccacccaggccaccgtggccgagggcgagagccccagccccgcctacctgctgttcggcgacagaccccagaacctgcccgccgccgagacccccagcatccccgaggccctgcagggcgcccccagcaccaccaacgccatcgcccccgtgagctgcagcagcaacgagggcgccagcagccaggacgagaagagcctgggcagcagcagagaggccgagggctggaaggaggaccccctgaacaagaaggtggtgagcctggtgcacttcctgctgcagaagtacgagaccaaggagcccatcaccaagggcgacatgatcaagttcgtgatcagaaaggacaagtgccacttcaacgagatcctgaagagagccagcgagcacatggagctggccctgggcgtggacctgaaggaggtggaccccatcagacactactacgccttcttcagcaagctggacctgacctacgacgagaccaccagcgacgaggagaagatccccaagaccggcctgctgatgatcgccctgggcgtgatcttcctgaacggcaacagagcccccgaggaggccgtgtgggagatcatgaacatgatgggcgtgtacgccgacagaaagcacttcctgtacggcgaccccagaaaggtgatgaccaaggacctggtgcagctgaagtacctggagtaccagcaggtgcccaacagcgacccccccagatacgagttcctgtggggccccagagcccacgccgagaccagcaagatgaaggtgctggagttcgtggccaagatccacgacaccgtgcccagcgccttccccagctgctacgaggaggccctgagagacgaggagcagagaacccaggccagagccgccgccagagcccacaccgccgccatggccaacgccagaagcagaaccaccagcagcagcttcagccacgccaagtag

SEQ ID NO: 22419 - DNA, 2337 bp, Artificial Sequence
  Description of Artificial Sequence: Synthetic coding sequence
atggcccagaagatggactgcggcgccggcctgctgggcttccaggccgaggccagcgtggaggacagcgccctgctgatgcagaccctgatggaggccatccagatcagcgaggccccccccaccaaccaggccaccgccgccgccagcccccagagcagccagccccccaccgccaacgagatggccgacatccaggtgagcgccgccgccgccagacccaagagcgccttcaaggtgcagaacgccaccaccaagggccccaacggcgtgtacgacttcagccaggcccacaacgccaaggacgtgcccaacacccagcccaaggccgccttcaagagccagaacgccacccccaagggccccaacgccgcctacgacttcagccaggccgccaccaccggcgagctggccgccaacaagagcgagatggccttcaaggcccagaacgccaccaccaaggtgggccccaacgccacctacaacttcagccagagcctgaacgccaacgacctggccaacagcagacccaagacccccttcaaggcctggaacgacaccaccaaggcccccaccgccgacacccagacccagaacgtgaaccaggccaagatggccaccagccaggccgacatcgagaccgaccccggcatcagcgagcccgacggcgccaccgcccagaccagcgccgacggcagccaggcccagaacctggagagcagaaccatcatcagaggcaagagaaccagaaagatcaacaacctgaacgtggaggagaacagcagcggcgaccagagaagagcccccctggccgccggcacctggagaagcgcccccgtgcccgtgaccacccagaacccccccggcgccccccccaacgtgctgtggcagacccccctggcctggcagaaccccagcggctggcagaaccagaccgccagacagaccccccccgccagacagagcccccccgccagacagaccccccccgcctggcagaaccccgtggcctggcagaaccccgtgatctggcccaaccccgtgatctggcagaaccccgtgatctggcccaaccccatcgtgtggcccggccccgtggtgtggcccaaccccctggcctggcagaacccccccggctggcagaccccccccggctggcagaccccccccggctggcagggcccccccgactggcagggcccccccgactggcccctgccccccgactggcccctgccccccgactggcccctgcccaccgactggcccctgccccccgactggatccccgccgactggcccatcccccccgactggcagaacctgagacccagccccaacctgagacccagccccaacagcagagccagccagaaccccggcgccgcccagcccagagacgtggccctgctgcaggagagagccaacaagctggtgaagtacctgatgctgaaggactacaccaaggtgcccatcaagagaagcgagatgctgagagacatcatcagagagtacaccgacgtgtaccccgagatcatcgagagagcctgcttcgtgctggagaagaagttcggcatccagctgaaggagatcgacaaggaggagcacctgtacatcctgatcagcacccccgagagcctggccggcatcctgggcaccaccaaggacacccccaagctgggcctgctgctggtgatcctgggcgtgatcttcatgaacggcaacagagccagcgaggccgtgctgtgggaggccctgagaaagatgggcctgagacccggcgtgagacaccccctgctgggcgacctgagaaagctgctgacctacgagttcgtgaagcagaagtacctggactacagaagagtgcccaacagcaacccccccgagtacgagttcctgtggggcctgagaagctaccacgagaccagcaagatgaaggtgctgagattcatcgccgaggtgcagaagagagaccccagagactggaccgcccagttcatggaggccgccgacgaggccctggacgccctggacgccgccgccgccgaggccgaggccagagccgaggccagaaccagaatgggcatcggcgacgaggccgtgagcggcccctggagctgggacgacatcgagttcgagctgctgacctgggacgaggagggcgacttcggcgacccctggagcagaatccccttcaccttctgggccagataccaccagaacgccagaagcagattcccccagaccttcgccggccccatcatcggccccggcggcaccgccagcgccaacttcgccgccaacttcggcgccatcggcttcttctgggtggagtag

SEQ ID NO: 22420 - DNA, 2337 bp, Artificial Sequence; identical to SEQ ID NO: 22419
  Description of Artificial Sequence: Synthetic coding sequence

SEQ ID NO: 22421 - DNA, 2220 bp, Artificial Sequence
  Description of Artificial Sequence: Synthetic coding sequence
atggccgagggcagcttcagcgtgcagagcgagagctacagcgtggaggacatggacgagggcagcgacgaggtgggcgaggaggagatggtggagggcaacgactacgaggagttcggcgccttcggcggctacggcaccctgaccagcttcgacatccacatcctgagagccttcggcagcctgggccccggcctgagaatcctgagcaacgagccctgggagctggagaaccccgtgctggcccagaccctggtggaggccctgcagctggaccccgagaccctggccaacgagaccgccgccagagccgccaacgtggccagagccgccgccagcaacagagccgccagagccgccgccgccgccgccagaaccgccttcagccaggtggtggccagccacagagtggccaccccccaggtgagcggcgaggacacccagcccaccacctacgccgccgaggcccagggccccacccccgagccccccctggccagcccccagaccagccagatgctggtgaccagcaagatggccgcccccgaggcccccgccaccagcgcccagagccagaccggcagccccgcccaggaggccgccaccgagggccccagcagcgcctgcgccttcagccaggccccctgcgccagagaggtggacgccaacagacccagcaccgccttcctgggccagaacgacgtgttcgacttcacccagcccgccggcgtgagcggcatggccttccccagacccaagagacccgcccccgcccaggaggccgccaccgagggccccagcgccgccagcggcgtgccccagaccggccccggcagagaggtggccgccaccagacccaagaccaccaagagcggcaaggccctggccaagaccagatgggtggagccccagaacgtggtggccgccgccgccgccaaggccaagatggccaccagcatccccgagcccgagggcgccgccgccgccaccgcccagcacagcgccgagccctgggccagaatgggcggcaagagaaccaagaagagcaagcacctggacgacgagtacgagagcagcgaggaggagagagagacccccgccgtgccccccacctggagagccagccagcccagcctgaccgtgagagcccagctggcccccagaccccccatggcccccagaagccagatccccagcagacacgtgctgtgcctgccccccagaaacgtgaccctgctgcaggagagagccaacaagctggtgaagtacctgatgatcaaggactacaagaagatccccatcaagagagccgacatgctgaaggacgtgatcagagagtacgacgagcacttccccgagatcatcgagagagccacctacaccctggagaagaagttcggcatccacctgaaggagatcgacaaggaggagcacctgtacatcctggtgtgcaccagagacagcagcgccagactgctgggcaagaccaaggacacccccagactgagcctgctgctggtgatcctgggcgtgatcttcatgaacggcaacagagccagcgaggccgtgctgtgggaggccctgagaaagatgggcctgagacccggcgtgagacaccccttcctgggcgacctgagaaagctgatcaccgacgacttcgtgaagcagaagtacctggagtacaagaagatccccaacagcaacccccccgagtacgagttcctgtggggcctgagagccagacacgagaccagcaagatgagagtgctgagattcatcgcccagaaccagaacagagaccccagagagtggaaggcccacttcctggaggccgtggacgacgccttcaagaccatggacgtggacatggccgaggagcacgccagagcccagatgagagcccagatgaacatcggcgacgaggccctgatcggcagatggagctgggacgacatccaggtggagctgctgacctgggacgaggacggcgacttcggcgacgcctgggccagaatccccttcgccttctgggccagataccaccagtacatcctgaacagcaacagagccaacagaagagccacctggagagccggcgtgagcagcggcaccaacggcggcgccagcaccagcgtgctggacggccccagcaccagcagcaccatcagaaccagaaacgccgccagagccggcgccagcttcttcagctggatccagtag

SEQ ID NO: 22422 - DNA, 2274 bp, Artificial Sequence
  Description of Artificial Sequence: Synthetic coding sequence
atggccgagggcagcttcagcgtgcagagcgagagctacagcgtggaggacatggacgagggcagcgacgaggtgggcgaggaggagatggtggagggcaacgactacgaggagttcggcgccttcggcggctacggcaccctgaccagcttcgacatccacatcctgagagccttcggcagcctgggccccggcctgagaatcctgagcaacgagccctgggagctggagaaccccgtgctggcccagaccctggtggaggccctgcagctggaccccgagaccctggccaacgagaccgccgccagagccgccaacgtggccagagccgccgccagcaacagagccgccagagccgccgccgccgccgccagaaccgccttcagccaggtggtggccagccacagagtggccaccccccaggtgagcggcgaggacacccagcccaccacctacgccgccgaggcccagggccccacccccgagccccccctggccagcccccagaccagccagatgctggtgaccagcaagatggccgcccccgaggcccccgccaccagcgcccagagccagaccggcagccccgcccaggaggccgccaccgagggccccagcagcgcctgcgccttcagccaggccccctgcgccagagaggtggacgccaacagacccagcaccgccttcctgggccagaacgacgtgttcgacttcacccagcccgccggcgtgagcggcatggccttccccagacccaagagacccgcccccgcccaggaggccgccaccgagggccccagcgccgccagcggcgtgccccagaccggccccggcagagaggtggccgccaccagacccaagaccaccaagagcggcaaggccctggccaagaccagatgggtggagccccagaacgtggtggccgccgccgccgccaaggccaagatggccaccagcatccccgagcccgagggcgccgccgccgccaccgcccagcacagcgccgagccctgggccagaatgggcggcaagagaaccaagaagagcaagcacctggacgacgagtacgagagcagcgaggaggagagagagacccccgccgtgccccccacctggagagccagccagcccagcctgaccgtgagagcccagctggcccccagaccccccatggcccccagaagccagatccccagcagacacgtgctgtgcctgccccccagaaacgtgaccctgctgcaggagagagccaacaagctggtgaagtacctgatgatcaaggactacaagaagatccccatcaagagagccgacatgctgaaggacgtgatcagagagtacgacgagcacttccccgagatcatcgagagagccacctacaccctggagaagaagttcggcatccacctgaaggagatcgacaaggaggagcacctgtacatcctggtgtgcaccagagacagcagcgccagactgctgggcaagaccaaggacacccccagactgagcctgctgctggtgatcctgggcgtgatcttcatgaacggcaacagagccagcgaggccgtgctgtgggaggccctgagaaagatgggcctgagacccggcgtgagacaccccttcctgggcgacctgagaaagctgatcaccgacgacttcgtgaagcagaagaaccccgagctgagagaggagacccccctgagcatggcccccagctggtacctggagtacaagaagatccccaacagcaacccccccgagtacgagttcctgtggggcctgagagccagacacgagaccagcaagatgagagtgctgagattcatcgcccagaaccagaacagagaccccagagagtggaaggcccacttcctggaggccgtggacgacgccttcaagaccatggacgtggacatggccgaggagcacgccagagcccagatgagagcccagatgaacatcggcgacgaggccctgatcggcagatggagctgggacgacatccaggtggagctgctgacctgggacgaggacggcgacttcggcgacgcctgggccagaatccccttcgccttctgggccagataccaccagtacatcctgaacagcaacagagccaacagaagagccacctggagagccggcgtgagcagcggcaccaacggcggcgccagcaccagcgtgctggacggccccagcaccagcagcaccatcagaaccagaaacgccgccagagccggcgccagcttcttcagctggatccagcacagatag

SEQ ID NO: 22423 - DNA, 2091 bp, Artificial Sequence
  Description of Artificial Sequence: Synthetic coding sequence
atggagagcgagtacgtgctgtgcaactggaaggaccagctgtggcccgccaaggtgctgagcagaagcgagaccagcagcaacagcaagagaaagaaggccttcagcctggaggtgcagatcctgagcctggacgagaagatcaagctggacagcaccgagaccaagatcctgaacaagagccagatcgaggccatcgccgccagcctgggcctgcagagcgaggacagcgccccccccaccgaggagaccgcctacggcagaagcctgaaggtggccctgggcatcctgaacgagagaaccaacctgagccaggccagcaccagcgacgaggaggagatcaccatgctgagccagaacgtgccccagaagcagagcgacagccccccccacaagaagtacagaaaggacgagggcgacctgcccggctgcctggaggagagagagaacagcgcctgcctgctggccagcagcgagagcgacgacagcctgtacgacgacaagagccaggcccccaccatggtggacaccatccccagcgaggtggagaccaagagcctgcagaacagcagctggtgcgagaccttccccagcctgagcgaggacaacgacgagaaggagaacaagaacaagatcgacatcagcgccgtgatgagcgtgcacagcgccgtgaaggaggagagcgcctgcgtgaaggacgagaagttcgccccccccctgagccccctgagcagcgacatgctgatcatgcccaaggccctgaaggaggagagcgaggacacctgcctggagaccctggccgtgcccagcgagtgcagcgccttcagcgagaacatcgaggaccccggcgagggccccagcaacccctgcctggacaccagccagaaccagcccagcatggagagcgagatgggcgccgccgcctgccccggcagctgcagcagagagtgcgaggtgagcttcagcgccagcaaccccgtgtgggactacagccacctgatgagcagcgagagaaacttccagagactggacttcgaggagctggaggaggagggccaggccagcgacaagagcctgctgcccagcagaatcaacctgagcctgctggacgacgacgaggaggacgaggagctgcccagattcatcctgcactacgagacccaccccttcgagaccggcatgatcgtgtggttcaagtaccagaagtaccccttctggcccgccgtgatcaagagcatcagaagaaaggagagaaaggccagcgtgctgttcgtggaggccaacatgaacagcgagaagaagggcatcagagtgaacttcagaagactgaagaagttcgactgcaaggagaagcagatgctggtggacaaggccagagaggactacagcgagagcatcgactggtgcatcagcctgatctgcgactacagagtgagaatcggctgcggcagcttcaccggcagcctgctggagtactacgccgccgacatcagctaccccgtgagaaaggagaccaagcaggacaccttcagaaacaagttccccaagctgcacaacgaggacgccagagagcccatggccgtgaccagccagaccaagaagatgagcttccagaagatcctgcccgacagaatgaaggccgccagagacagagccaacaagaacctggtggacttcatcgtgaacgccaagggcaccgagaaccacctgctggccatcgtgaacggcaccaagggcagcagatggctgaagagcttcctgaacgccaacagattcaccccctgcatcgagacctacttcgaggacgaggaccagctggacgaggtggtgaagtacctgcaggaggtgtgcaaccagatcgaccagatcatgcccacctggatcaaggacgacaagatcaagttcatcctggaggtgctgctgcccgaggccatcatctgcagcatcagcgccgtggacggcctggactacgaggccgccgaggccaagtacctgaagggcccctgcctgggctacagagagagagagctgttcgacgccaagatcatctacgagaagagaagaaaggcccccaccaacgaggcccactag

SEQ ID NO: 22424 - DNA, 2091 bp, Artificial Sequence; identical to SEQ ID NO: 22423
  Description of Artificial Sequence: Synthetic coding sequence

SEQ ID NO: 22425 - DNA, 2091 bp, Artificial Sequence; identical to SEQ ID NO: 22423
  Description of Artificial Sequence: Synthetic coding sequence

SEQ ID NO: 22426 - DNA, 396 bp, Artificial Sequence
  Description of Artificial Sequence: Synthetic coding sequence
atggccagaagcctggtgtgcctgggcgtgatcatcctgctgagcgccttcagcggccccggcgtgagaggcggccccatgcccaagctggccgacagaaagctgtgcgccgaccaggagtgcagccaccccatcagcatggccgtggccctgcaggactacatggcccccgactgcagattcctgaccatccacagaggccaggtggtgtacgtgttcagcaagctgaagggcagaggcagactgttctggggcggcagcgtgcagggcgactactacggcgacctggccgccagactgggctacttccccagcagcatcgtgagagaggaccagaccctgaagcccggcaaggtggacgtgaagaccgacaagtgggacttctactgccagtag

SEQ ID NO: 22427 - DNA, 2226 bp, Artificial Sequence
  Description of Artificial Sequence: Synthetic coding sequence
atggccgagggcagcttcagcgtgcagagcgagagctacagcgtggaggacatggacgagggcagcgacgaggtgggcgaggaggagatggtggagggcaacgactacgaggagttcggcgccttcggcggctacggcaccctgaccagcttcgacatccacatcctgagagccttcggcagcctgggccccggcctgagaatcctgagcaacgagccctgggagctggagaaccccgtgctggcccagaccctggtggaggccctgcagctggaccccgagaccctggccaacgagaccgccgccagagccgccaacgtggccagagccgccgccagcaacagagccgccagagccgccgccgccgccgccagaaccgccttcagccaggtggtggccagccacagagtggccaccccccaggtgagcggcgaggacacccagcccaccacctacgccgccgaggcccagggccccacccccgagccccccctggccagcccccagaccagccagatgctggtgaccagcaagatggccgcccccgaggcccccgccaccagcgcccagagccagaccggcagccccgcccaggaggccgccaccgagggccccagcagcgcctgcgccttcagccaggccccctgcgccagagaggtggacgccaacagacccagcaccgccttcctgggccagaacgacgtgttcgacttcacccagcccgccggcgtgagcggcatggccttccccagacccaagagacccgcccccgcccaggaggccgccaccgagggccccagcgccgccagcggcgtgccccagaccggccccggcagagaggtggccgccaccagacccaagaccaccaagagcggcaaggccctggccaagaccagatgggtggagccccagaacgtggtggccgccgccgccgccaaggccaagatggccaccagcatccccgagcccgagggcgccgccgccgccaccgcccagcacagcgccgagccctgggccagaatgggcggcaagagaaccaagaagagcaagcacctggacgacgagtacgagagcagcgaggaggagagagagacccccgccgtgccccccacctggagagccagccagcccagcctgaccgtgagagcccagctggcccccagaccccccatggcccccagaagccagatccccagcagacacgtgctgtgcctgccccccagaaacgtgaccctgctgcaggagagagccaacaagctggtgaagtacctgatgatcaaggactacaagaagatccccatcaagagagccgacatgctgaaggacgtgatcagagagtacgacgagcacttccccgagatcatcgagagagccacctacaccctggagaagaagttcggcatccacctgaaggagatcgacaaggaggagcacctgtacatcctggtgtgcaccagagacagcagcgccagactgctgggcaagaccaaggacacccccagactgagcctgctgctggtgatcctgggcgtgatcttcatgaacggcaacagagccagcgaggccgtgctgtgggaggccctgagaaagatgggcctgagacccggcgtgagacaccccttcctgggcgacctgagaaagctgatcaccgacgacttcgtgaagcagaagtacctggagtacaagaagatccccaacagcaacccccccgagtacgagttcctgtggggcctgagagccagacacgagaccagcaagatgagagtgctgagattcatcgcccagaaccagaacagagaccccagagagtggaaggcccacttcctggaggccgtggacgacgccttcaagaccatggacgtggacatggccgaggagcacgccagagcccagatgagagcccagatgaacatcggcgacgaggccctgatcggcagatggagctgggacgacatccaggtggagctgctgacctgggacgaggacggcgacttcggcgacgcctgggccagaatccccttcgccttctgggccagataccaccagtacatcctgaacagcaacagagccaacagaagagccacctggagagccggcgtgagcagcggcaccaacggcggcgccagcaccagcgtgctggacggccccagcaccagcagcaccatcagaaccagaaacgccgccagagccggcgccagcttcttcagctggatccagcacagatag

SEQ ID NO: 22428 - DNA, 4446 bp, Artificial Sequence
  Description of Artificial Sequence: Synthetic coding sequence
atgagcaagaccctgaagaagaagaagcactggctgagcaaggtgcaggagtgcgccgtgagctgggccggcccccccggcgacttcggcgccgagatcagaggcggcgccgagagaggcgagttcccctacctgggcagactgagagaggagcccggcggcggcacctgctgcgtggtgagcggcaaggcccccagccccggcgacgtgctgctggaggtgaacggcacccccgtgagcggcctgaccaacagagacaccctggccgtgatcagacacttcagagagcccatcagactgaagaccgtgaagcccggcaaggtgatcaacaaggacctgagacactacctgagcctgcagttccagaagggcagcatcgaccacaagctgcagcaggtgatcagagacaacctgtacctgagaaccatcccctgcaccaccagagcccccagagacggcgaggtgcccggcgtggactacaacttcatcagcgtggagcagttcaaggccctggaggagagcggcgccctgctggagagcggcacctacgacggcaacttctacggcacccccaagccccccgccgagcccagccccttccagcccgaccccgtggaccaggtgctgttcgacaacgagttcgacgccgagagccagagaaagagaaccaccagcgtgagcaagatggagagaatggacagcagcctgcccgaggaggaggaggacgaggacaaggaggccatcaacggcagcggcaacgccgagaacagagagagacacagcgagagcagcgactggatgaagaccgtgcccagctacaaccagaccaacagcagcatggacttcagaaactacatgatgagagacgagaccctggagcccctgcccaagaactgggagatggcctacaccgacaccggcatgatctacttcatcgaccacaacaccaagaccaccacctggctggaccccagactgtgcaagaaggccaaggcccccgaggactgcgaggacggcgagctgccctacggctgggagaagatcgaggacccccagtacggcacctactacgtggaccacctgaaccagaagacccagttcgagaaccccgtggaggaggccaagagaaagaagcagctgggccaggtggagatcggcagcagcaagcccgacatggagaagagccacttcaccagagaccccagccagctgaagggcgtgctggtgagagccagcctgaagaagagcaccatgggcttcggcttcaccatcatcggcggcgacagacccgacgagttcctgcaggtgaagaacgtgctgaaggacggccccgccgcccaggacggcaagatcgcccccggcgacgtgatcgtggacatcaacggcaactgcgtgctgggccacacccacgccgacgtggtgcagatgttccagctggtgcccgtgaaccagtacgtgaacctgaccctgtgcagaggctaccccctgcccgacgacagcgaggaccccgtggtggacatcgtggccgccacccccgtgatcaacggccagagcctgaccaagggcgagacctgcatgaacccccaggacttcaagcccggcgccatggtgctggagcagaacggcaagagcggccacaccctgaccggcgacggcctgaacggccccagcgacgccagcgagcagagagtgagcatggccagcagcggcagcagccagcccgagctggtgaccatccccctgatcaagggccccaagggcttcggcttcgccatcgccgacagccccaccggccagaaggtgaagatgatcctggacagccagtggtgccagggcctgcagaagggcgacatcatcaaggagatctaccaccagaacgtgcagaacctgacccacctgcaggtggtggaggtgctgaagcagttccccgtgggcgccgacgtgcccctgctgatcctgagaggcggcccccccagccccaccaagaccgccaagatgaagaccgacaagaaggagaacgccggcagcctggaggccatcaacgagcccatcccccagcccatgcccttcccccccagcatcatcagaagcggcagccccaagctggaccccagcgaggtgtacctgaagagcaagaccctgtacgaggacaagccccccaacaccaaggacctggacgtgttcctgagaaagcaggagagcggcttcggcttcagagtgctgggcggcgacggccccgaccagagcatctacatcggcgccatcatccccctgggcgccgccgagaaggacggcagactgagagccgccgacgagctgatgtgcatcgacggcatccccgtgaagggcaagagccacaagcaggtgctggacctgatgaccaccgccgccagaaacggccacgtgctgctgaccgtgagaagaaagatcttctacggcgagaagcagcccgaggacgacagcagccaggccttcatcagcacccagaacggcagccccagactgaacagagccgaggtgcccgccagacccgccccccaggagccctacgacgtggtgctgcagagaaaggagaacgagggcttcggcttcgtgatcctgaccagcaagaacaagcccccccccggcgtgatcccccacaagatcggcagagtgatcgagggcagccccgccgacagatgcggcaagctgaaggtgggcgaccacatcagcgccgtgaacggccagagcatcgtggagctgagccacgacaacatcgtgcagctgatcaaggacgccggcgtgaccgtgaccctgaccgtgatcgccgaggaggagcaccacggcccccccagcggcaccaacagcgccagacagagccccgccctgcagcacagacccatgggccagagccaggccaaccacatccccggcgacagaagcgccctggagggcgagatcggcaaggacgtgagcaccagctacagacacagctggagcgaccacaagcacctggcccagcccgacaccgccgtgatcagcgtggtgggcagcagacacaaccagaacctgggctgctaccccgtggagctggagagaggccccagaggcttcggcttcagcctgagaggcggcaaggagtacaacatgggcctgttcatcctgagactggccgaggacggccccgccatcaaggacggcagaatccacgtgggcgaccagatcgtggagatcaacggcgagcccacccagggcatcacccacaccagagccatcgagctgatccaggccggcggcaacaaggtgctgctgctgctgagacccggcaccggcctgatccccgaccacggcgactgggacatcaacaaccccagcagcagcaacgtgatctacgacgagcagagccccctgccccccagcagccacttcgccagcatcttcgaggagagccacgtgcccgtgatcgaggagagcctgagagtgcagatctgcgagaaggccgaggagctgaaggacatcgtgcccgagaagaagagcaccctgaacgagaaccagcccgagatcaagcaccagagcctgctgcagaagaacgtgagcaagagagacccccccagcagccacggccacagcaacaagaagaacctgctgaaggtggagaacggcgtgaccagaagaggcagaagcgtgagccccaagaagcccgccagccagcacagcgaggagcacctggacaagatccccagccccctgaagaacaaccccaagagaagacccagagaccagagcctgagccccagcaagggcgagaacaagagctgccaggtgagcaccagagccggcagcggccaggaccagtgcagaaagagcagaggcagaagcgccagccccaagaagcagcagaagatcgagggcagcaaggcccccagcaacgccgaggccaagctgctggagggcaagagcagaagaatcgccggctacaccggcagcaacgccgagcagatccccgacggcaaggagaagagcgacgtgatcagaaaggacgccaagcagaaccagctggagaagagcagaaccagaagccccgagaagaagatcaagagaatggtggagaagagcctgcccagcaagatgaccaacaagaccaccagcaaggaggtgagcgagaacgagaagggcaagaaggtgaccaccggcgagaccagcagcagcaacgacaagatcggcgagaacgtgcagctgagcgagaagagactgaagcaggagcccgaggagaaggtggtgagcaacaagaccgaggaccacaagggcaaggagctggaggccgccgacaagaacaaggagaccggcagattcaagcccgagagcagcagccccgtgaagaagaccctgatcacccccggcccctggaaggtgcccagcggcaacaaggtgaccggcaccatcggcatggccgagaagagacagtag

SEQ ID NO: 22429 - DNA, 3378 bp, Artificial Sequence
  Description of Artificial Sequence: Synthetic coding sequence
atgagcaagaccctgaagaagaagaagcactggctgagcaaggtgcaggagtgcgccgtgagctgggccggcccccccggcgacttcggcgccgagatcagaggcggcgccgagagaggcgagttcccctacctgggcagactgagagaggagcccggcggcggcacctgctgcgtggtgagcggcaaggcccccagccccggcgacgtgctgctggaggtgaacggcacccccgtgagcggcctgaccaacagagacaccctggccgtgatcagacacttcagagagcccatcagactgaagaccgtgaagcccggcaaggtgatcaacaaggacctgagacactacctgagcctgcagttccagaagggcagcatcgaccacaagctgcagcaggtgatcagagacaacctgtacctgagaaccatcccctgcaccaccagagcccccagagacggcgaggtgcccggcgtggactacaacttcatcagcgtggagcagttcaaggccctggaggagagcggcgccctgctggagagcggcacctacgacggcaacttctacggcacccccaagccccccgccgagcccagccccttccagcccgaccccgtggaccaggtgctgttcgacaacgagttcgacgccgagagccagagaaagagaaccaccagcgtgagcaagatggagagaatggacagcagcctgcccgaggaggaggaggacgaggacaaggaggccatcaacggcagcggcaacgccgagaacagagagagacacagcgagagcagcgactggatgaagaccgtgcccagctacaaccagaccaacagcagcatggacttcagaaactacatgatgagagacgagaccctggagcccctgcccaagaactgggagatggcctacaccgacaccggcatgatctacttcatcgaccacaacaccaagaccaccacctggctggaccccagactgtgcaagaaggccaaggcccccgaggactgcgaggacggcgagctgccctacggctgggagaagatcgaggacccccagtacggcacctactacgtggaccacctgaaccagaagacccagttcgagaaccccgtggaggaggccaagagaaagaagcagctgggccaggtggagatcggcagcagcaagcccgacatggagaagagccacttcaccagagaccccagccagctgaagggcgtgctggtgagagccagcctgaagaagagcaccatgggcttcggcttcaccatcatcggcggcgacagacccgacgagttcctgcaggtgaagaacgtgctgaaggacggccccgccgcccaggacggcaagatcgcccccggcgacgtgatcgtggacatcaacggcaactgcgtgctgggccacacccacgccgacgtggtgcagatgttccagctggtgcccgtgaaccagtacgtgaacctgaccctgtgcagaggctaccccctgcccgacgacagcgaggaccccgtggtggacatcgtggccgccacccccgtgatcaacggccagagcctgaccaagggcgagacctgcatgaacccccaggacttcaagcccggcgccatggtgctggagcagaacggcaagagcggccacaccctgaccggcgacggcctgaacggccccagcgacgccagcgagcagagagtgagcatggccagcagcggcagcagccagcccgagctggtgaccatccccctgatcaagggccccaagggcttcggcttcgccatcgccgacagccccaccggccagaaggtgaagatgatcctggacagccagtggtgccagggcctgcagaagggcgacatcatcaaggagatctaccaccagaacgtgcagaacctgacccacctgcaggtggtggaggtgctgaagcagttccccgtgggcgccgacgtgcccctgctgatcctgagaggcggcccccccagccccaccaagaccgccaagatgaagaccgacaagaaggagaacgccggcagcctggaggccatcaacgagcccatcccccagcccatgcccttcccccccagcatcatcagaagcggcagccccaagctggaccccagcgaggtgtacctgaagagcaagaccctgtacgaggacaagccccccaacaccaaggacctggacgtgttcctgagaaagcaggagagcggcttcggcttcagagtgctgggcggcgacggccccgaccagagcatctacatcggcgccatcatccccctgggcgccgccgagaaggacggcagactgagagccgccgacgagctgatgtgcatcgacggcatccccgtgaagggcaagagccacaagcaggtgctggacctgatgaccaccgccgccagaaacggccacgtgctgctgaccgtgagaagaaagatcttctacggcgagaagcagcccgaggacgacagcagccaggccttcatcagcacccagaacggcagccccagactgaacagagccgaggtgcccgccagacccgccccccaggagccctacgacgtggtgctgcagagaaaggagaacgagggcttcggcttcgtgatcctgaccagcaagaacaagcccccccccggcgtgatcccccacaagatcggcagagtgatcgagggcagccccgccgacagatgcggcaagctgaaggtgggcgaccacatcagcgccgtgaacggccagagcatcgtggagctgagccacgacaacatcgtgcagctgatcaaggacgccggcgtgaccgtgaccctgaccgtgatcgccgaggaggagcaccacggcccccccagcggcaccaacagcgccagacagagccccgccctgcagcacagacccatgggccagagccaggccaaccacatccccggcgacagaagcgccctggagggcgagatcggcaaggacgtgagcaccagctacagacacagctggagcgaccacaagcacctggcccagcccgacaccgccgtgatcagcgtggtgggcagcagacacaaccagaacctgggctgctaccccgtggagctggagagaggccccagaggcttcggcttcagcctgagaggcggcaaggagtacaacatgggcctgttcatcctgagactggccgaggacggccccgccatcaaggacggcagaatccacgtgggcgaccagatcgtggagatcaacggcgagcccacccagggcatcacccacaccagagccatcgagctgatccaggccggcggcaacaaggtgctgctgctgctgagacccggcaccggcctgatccccgaccacggcctggcccccagcggcctgtgcagctacgtgaagcccgagcagcactag

SEQ ID NO: 22430 - DNA, 3378 bp, Artificial Sequence; identical to SEQ ID NO: 22429
  Description of Artificial Sequence: Synthetic coding sequence

SEQ ID NO: 22431 - DNA, 1230 bp, Artificial Sequence
  Description of Artificial Sequence: Synthetic coding sequence
atgggccagagccaggccaaccacatccccggcgacagaagcgccctggagggcgagatcggcaaggacgtgagcaccagctacagacacagctggagcgaccacaagcacctggcccagcccgacaccgccgtgatcagcgtggtgggcagcagacacaaccagaacctgggctgctaccccgtggagctggagagaggccccagaggcttcggcttcagcctgagaggcggcaaggagtacaacatgggcctgttcatcctgagactggccgaggacggccccgccatcaaggacggcagaatccacgtgggcgaccagatcgtggagatcaacggcgagcccacccagggcatcacccacaccagagccatcgagctgatccaggccggcggcaacaaggtgctgctgctgctgagacccggcaccggcctgatccccgaccacggcgactgggacatcaacaaccccagcagcagcaacgtgatctacgacgagcagagccccctgccccccagcagccacttcgccagcatcttcgaggagagccacgtgcccgtgatcgaggagagcctgagagtgcagatctgcgagaaggccgaggagctgaaggacatcgtgcccgagaagaagagcaccctgaacgagaaccagcccgagatcaagcaccagagcctgctgcagaagaacgtgagcaagagagacccccccagcagccacggccacagcaacaagaagaacctgctgaaggtggagaacggcgtgaccagaagaggcagaagcgtgagccccaagaagcccgccagccagcacagcgaggagcacctggacaagatccccagccccctgaagaacaaccccaagagaagacccagagaccagagcctgagccccagcaagggcgagaacaagagctgccaggtgagcaccagagccggcagcggccaggaccagtgcagaaagagcagaggcagaagcgccagccccaagaagcagcagaagatcgagggcagcaaggcccccagcaacgccgaggccaagctgctggagggcaagagcagaagaatcgccggctacaccggcagcaacgccgagcagatccccgacggcaaggagaagagcgacgtgatcagaaaggacgccaagcagaaccagctggagaaggccgagcagggcctgcagagaaagaagagcaaggagtggctgagaaacctgttccaccccaagtag

SEQ ID NO: 22432 - DNA, 1200 bp, Artificial Sequence
  Description of Artificial Sequence: Synthetic coding sequence
atgggcagcagcagatgcggccccggcgcccaccccgtgcacctgtggcccccccacttcgccttcagcggccaccaccccagagacctgggcccccacagcggccccgccctgctggtgagcctggccagcgaggtgcaggacctgcacctggcccagagaaaggagatggccagcggcttcagcaagggccccaccctgggcctgctgcccgacgtgcccagcctgatggagaccctgagctacagctactgctacgtgggcatcatgaccggccccttcttcagatacagaacctacctggactggctggagcagcccttccccggcgccgtgcccagcctgagacccctgctgagaagagcctggcccgcccccctgttcggcctgctgttcctgctgagcagccacctgttccccctggaggccgtgagagaggacgccttctacgccagacccctgcccgccagactgttctacatgatccccgtgttcttcgccttcagaatgagattctacgtggcctggatcgccgccgagtgcggctgcatcgccgccggcttcggcgcctaccccgtggccgccaaggccagagccggcggcggccccaccctgcagtgccccccccccagcagccccgagaaggccgccagcctggagtacgactacgagaccatcagaaacatcgactgctacagcaccgacttctgcgtgagagtgagagacggcatgagatactggaacatgaccgtgcagtggtggctggcccagtacatctacaagagcgcccccgccagaagctacgtgctgagaagcgcctggaccatgctgctgagcgcctactggcacggcctgcaccccggctactacctgagcttcctgaccatccccctgtgcctggccgccgagggcagactggagagcgccctgagaggcagactgagccccggcggccagaaggcctgggactgggtgcactggttcctgaagatgagagcctacgactacatgtgcatgggcttcgtgctgctgagcctggccgacaccctgagatactgggccagcatctacttctgcatccacttcctggccctggccgccctgggcctgggcctggccctgggcggcggcagccccagcagaagaaaggccgccagccagcccaccagcctggcccccgagaagctgagagaggagtag

SEQ ID NO: 22433 - DNA, 1200 bp, Artificial Sequence; identical to SEQ ID NO: 22432
  Description of Artificial Sequence: Synthetic coding sequence

SEQ ID NO: 22434 - DNA, 1200 bp, Artificial Sequence; identical to SEQ ID NO: 22432
  Description of Artificial Sequence: Synthetic coding sequence

SEQ ID NO: 22435 - DNA, 1200 bp, Artificial Sequence; identical to SEQ ID NO: 22432
  Description of Artificial Sequence: Synthetic coding sequence

SEQ ID NO: 22436 - DNA, 1200 bp, Artificial Sequence; identical to SEQ ID NO: 22432
  Description of Artificial Sequence: Synthetic coding sequence

SEQ ID NO: 22437 - DNA, 1200 bp, Artificial Sequence; identical to SEQ ID NO: 22432
  Description of Artificial Sequence: Synthetic coding sequence

SEQ ID NO: 22438 - DNA, 1200 bp, Artificial Sequence; identical to SEQ ID NO: 22432
  Description of Artificial Sequence: Synthetic coding sequence

SEQ ID NO: 22439 - DNA, 1200 bp, Artificial Sequence; identical to SEQ ID NO: 22432
  Description of Artificial Sequence: Synthetic coding sequence

SEQ ID NO: 22440 - DNA, 1200 bp, Artificial Sequence; identical to SEQ ID NO: 22432
  Description of Artificial Sequence: Synthetic coding sequence

SEQ ID NO: 22441 - DNA, 1200 bp, Artificial Sequence; identical to SEQ ID NO: 22432
  Description of Artificial Sequence: Synthetic coding sequence

SEQ ID NO: 22442 - DNA, 1200 bp, Artificial Sequence; identical to SEQ ID NO: 22432
  Description of Artificial Sequence: Synthetic coding sequence

SEQ ID NO: 22443 - DNA, 1200 bp, Artificial Sequence; identical to SEQ ID NO: 22432
  Description of Artificial Sequence: Synthetic coding sequence

SEQ ID NO: 22444 - DNA, 876 bp, Artificial Sequence
  Description of Artificial Sequence: Synthetic coding sequence
atgagcatgcccctgcaccagatcagcgccatccccagccaggacgccatcagcgccagagtgtacagaagcaagaccaaggagaaggagagagaggagcagaacgagaagaccctgggccacttcatgagccacagcagcaacatcagcaaggccggcagcccccccagcgccagcgcccccgcccccgtgagcagcttcagcagaaccagcatcacccccagcagccaggacatctgcagaatctgccactgcgagggcgacgacgagagccccctgatcaccccctgccactgcaccggcagcctgcacttcgtgcaccaggcctgcctgcagcagtggatcaagagcagcgacaccagatgctgcgagctgtgcaagtacgagttcatcatggagaccaagctgaagcccctgagaaagtgggagaagctgcagatgaccagcagcgagagaagaaagatcatgtgcagcgtgaccttccacgtgatcgccatcacctgcgtggtgtggagcctgtacgtgctgatcgacagaaccgccgaggagatcaagcagggccaggccaccggcatcctggagtggcccttctggaccaagctggtggtggtggccatcggcttcaccggcggcctgctgttcatgtacgtgcagtgcaaggtgtacgtgcagctgtggaagagactgaaggcctacaacagagtgatctacgtgcagaactgccccgagaccagcaagaagaacatcttcgagaagagccccctgaccgagcccaacttcgagaacaagcacggctacggcatctgccacagcgacaccaacagcagctgctgcaccgagcccgaggacaccggcgccgagatcatccacgtgtag

SEQ ID NO: 22445 - DNA, 1089 bp, Artificial Sequence
  Description of Artificial Sequence: Synthetic coding sequence
atggccagcggcagcgccggcaagcccaccggcgaggccgccagccccgcccccgccagcgccatcggcggcgccagcagccagcccagaaagagactggtgagcgtgtgcgaccactgcaagggcaagatgcagctggtggccgacctgctgctgctgagcagcgaggccagacccgtgctgttcgagggccccgccagcagcggcgccggcgccgagagcttcgagcagtgcagagacaccatcatcgccagaaccaagggcctgagcatcctgacccacgacgtgcagagccagctgaacatgggcagattcggcgaggccggcgacagcctggtggagctgggcgacctggtggtgagcctgaccgagtgcagcgcccacgccgcctacctggccgccgtggccacccccggcgcccagcccgcccagcccggcctggtggacagatacagagtgaccagatgcagacacgaggtggagcagggctgcgccgtgctgagagccacccccctggccgacatgaccccccagctgctgctggaggtgagccagggcctgagcagaaacctgaagttcctgaccgacgcctgcgccctggccagcgacaagagcagagacagattcagcagagagcagttcaagctgggcgtgaagtgcatgagcaccagcgccagcgccctgctggcctgcgtgagagaggtgaaggtggcccccagcgagctggccagaagcagatgcgccctgttcagcggccccctggtgcaggccgtgagcgccctggtgggcttcgccaccgagccccagttcctgggcagagccgccgccgtgagcgccgagggcaaggccgtgcagaccgccatcctgggcggcgccatgagcgtggtgagcgcctgcgtgctgctgacccagtgcctgagagacctggcccagcaccccgacggcggcgccaagatgagcgaccacagagagagactgagaaacagcgcctgcgccgtgagcgagggctgcaccctgctgagccaggccctgagagagagaagcagccccagaaccctgccccccgtgaacagcaacagcgtgaactag

SEQ ID NO: 22446 - DNA, 879 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgaccatcaagagcctgtgcctgagcaacggcggcatcttccccgagacccacagacccctgctgctgcagaagctgctgaaggacggcggcgtgctgagccccatcctgaccagactgatgaacttcttcgtgttcagcagaggcctgctgcagtacatcaaccagagaaagaagttcagaagaagatgggtgggcgccctggccagcgtgaccatccccatccacttcatctacggccccctggaccccgtgaacccctaccccgagttcctggagctgtacagaaagaccctgcccagaagcaccgtgagcatcctggacgaccacatcagccactacccccagctggaggaccccatgggcttcctgaacgcctacatgggcttcatcaacagcttctag

SEQ ID NO: 22447 - DNA, 981 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgaccatcaagagcctgtgcctgagcaacggcggcatcttccccgagacccacagacccctgctgctgcagaagctgctgaaggacggcggcgtgctgagccccatcctgaccagactgatgaacttcttcgtgttcagcagaggcctgacccccgtgttcggcccctacaccagacccagcgagagcgagctgtgggacatgtgggccggcatcagaaacaacgacggcaacctggtgatcgacagcctgctgcagtacatcaaccagagaaagaagttcagaagaagatgggtgggcgccctggccagcgtgaccatccccatccacttcatctacggccccctggaccccgtgaacccctaccccgagttcctggagctgtacagaaagaccctgcccagaagcaccgtgagcatcctggacgaccacatcagccactacccccagctggaggaccccatgggcttcctgaacgcctacatgggcttcatcaacagcttctag

SEQ ID NO: 22448 - DNA, 879 bp, Artificial Sequence; identical to SEQ ID NO: 22446
  Description of Artificial Sequence: Synthetic coding sequence

SEQ ID NO: 22449 - DNA, 981 bp, Artificial Sequence; identical to SEQ ID NO: 22447
  Description of Artificial Sequence: Synthetic coding sequence

SEQ ID NO: 22450 - DNA, 801 bp, Artificial Sequence
  Description of Artificial Sequence: Synthetic coding sequence
atgagaaccgagcccctgtgcggcgccagccccctgctggtgcccggcgacccctacagcgtggtggtgctgctgcagggctacgccgagcccgagggcgtgggcgacgccgtgagagccgacggcagcgtgaccctggtgctgccccagaccagaggccccgccagcagccacagagagagccccagaggcagcggcggcgccgaggccgccctggaggaggccgccagaggccccatcctggtggacaccggcggcccctgggccagagaggccctgctgggcgccctggccggccagggcgtggcccccggcgacgtgaccctggtggtgggcacccacggccacagcgaccacatcggcaacctgggcctgttccccggcgccgccctgctggtgagccacgacttctgcctgcccggcggcagatacctgccccacggcctgggcgagggccagcccctgagactgggccccggcctggaggtgtgggccacccccggccacggcggccagagagacgtgagcgtggtggtggccggcaccgccctgggcaccgtggtggtggccggcgacgtgttcgagagagacggcgacgaggacagctggcaggccctgagcgaggaccccgccgcccaggagagaagcagaaagagagtgctggtggtggccgacgtggtggtgcccggccacggcccccccttcagagtgctgagagaggccagccagcccgagaccgagggcggcggcaacagccagcaggagcccgtggtgggcgacgaggagcccgccctgcactag

SEQ ID NO: 22451 - DNA, 342 bp, Artificial Sequence
  Description of Artificial Sequence: Synthetic coding sequence
atgagaaccgagcccctgtgcggcgccagccccctgctggtgcccggcgacccctacagcgtggtggtgctgctgcagggctacgccgagcccgagggcgtgggcgacgccgtgagagccgacggcagcgtgaccctggtgctgccccagaccagaggccccgccagcagccacagagagagccccagaggcagcggcggcgccgaggccgccctggaggaggccgccagaggccccatcctggtggacaccggcggcccctgggccagagaggccctgctgggcgccctggccggccagggcgtggcccccggcgacgtgaccctggtggtgggcacctag

SEQ ID NO: 22452 - DNA, 840 bp, Artificial Sequence
  Description of Artificial Sequence: Synthetic coding sequence
atgagcgccctggagtggtacgcccacaagagcctgggcgacggcatcttctggatccaggagagattctacgagagcggcaacagagccaacatctggctggtgagaggcagcgagcaggacgtggtgatcgacaccggcctgggcctgagaagcctgcccgagtacctgtacagcagcggcctgctgcaggacagagaggccaaggaggacgccgccagaagacccctgctggccgtggccacccacgtgcacttcgaccacagcggcggcctgtaccagttcgacagagtggccgtgcaccacgccgaggccgaggccctggccagaggcgacaacttcgagaccgtgacctggctgagcgacagcgaggtggtgagaacccccagccccggctggagagccagacagttcagagtgcaggccgtgcagcccaccctgatcctgcaggacggcgacgtgatcaacctgggcgacagacagctgaccgtgatgcacatgcccggccacagcagaggcagcatctgcctgcacgacaaggacagaaagatcctgttcagcggcgacgtggtgtacgacggcagcctgatcgactggctgccctacagcagaatcagcgactacgtgggcacctgcgagagactgatcgagctggtggacagaggcctggtggagaaggtgctgcccggccacttcaacaccttcggcgccgagagactgttcagactggccagcaactacatcagcaaggccggcatctgccacaaggtgagcaccttcgccatgagaagcctggccagcctggccctgagagtgaccaacagcagaaccagcccctag

SEQ ID NO: 22453 - DNA, 600 bp, Artificial Sequence
  Description of Artificial Sequence: Synthetic coding sequence
atgagcgccctggagtggtacgcccacaagagcctgggcgacggcatcttctggatccaggagagattctacgagagcggcaacagagccaacatctggctggtgagaggcagcgagcaggacgtggtgatcgacaccggcctgggcctgagaagcctgcccgagtacctgtacagcagcggcctgctgcaggacagagaggccaaggaggacgccgccagaagacccctgctggccgtggccacccacgtgcacttcgaccacagcggcggcctgtaccagttcgacagagtggccgtgcaccacgccgaggccgaggccctggccagaggcgacaacttcgagaccgtgacctggctgagcgacagcgaggtggtgagaacccccagccccggctggagagccagacagttcagagtgcaggccgtgcagcccaccctgatcctgcaggacggcaacggcccccccagagccagagccctggtgaagggcggctactgggaggagaccgtgagagtgccccacgtggccgacctgagaggccacaagggcgactacttcggcaccagccagagccacttctgcttcaccctgccctag

SEQ ID NO: 22454 - DNA, 630 bp, Artificial Sequence
  Description of Artificial Sequence: Synthetic coding sequence
atggccgccagaagacccctgctggccgtggccacccacgtgcacttcgaccacagcggcggcctgtaccagttcgacagagtggccgtgcaccacgccgaggccgaggccctggccagaggcgacaacttcgagaccgtgacctggctgagcgacagcgaggtggtgagaacccccagccccggctggagagccagacagttcagagtgcaggccgtgcagcccaccctgatcctgcaggacggcgacgtgatcaacctgggcgacagacagctgaccgtgatgcacatgcccggccacagcagaggcagcatctgcctgcacgacaaggacagaaagatcctgttcagcggcgacgtggtgtacgacggcagcctgatcgactggctgccctacagcagaatcagcgactacgtgggcacctgcgagagactgatcgagctggtggacagaggcctggtggagaaggtgctgcccggccacttcaacaccttcggcgccgagagactgttcagactggccagcaactacatcagcaaggccggcatctgccacaaggtgagcaccttcgccatgagaagcctggccagcctggccctgagagtgaccaacagcagaaccagcccctag

SEQ ID NO: 22455 - DNA, 840 bp, Artificial Sequence; identical to SEQ ID NO: 22452
  Description of Artificial Sequence: Synthetic coding sequence

SEQ ID NO: 22456 - DNA, 153 bp, Artificial Sequence
  Description of Artificial Sequence: Synthetic coding sequence
agctgcacctacgccagcttctgcaagtgcaaggagtacaagtgcaccagctgcaagaagaactgctgcagctgctaccccgtgggctgcgccaagtgcgcccagggctgcatctgcaagggcgccagcgacaagtgcagctgctgcgcctag

SEQ ID NO: 22457 - DNA, 123 bp, Artificial Sequence
  Description of Artificial Sequence: Synthetic coding sequence
atggaccccaactacagctgcaccaccggcggcagctgcacctgcgccggcagctgcaagtgcaaggagtgcaagtgcaccagctgcaagaagagctgctgcttctgctgccccatgggctag

SEQ ID NO: 22458 - DNA, 186 bp, Artificial Sequence
  Description of Artificial Sequence: Synthetic coding sequence
atggaccccaactgcagctgcaccaccggcgtgagctgcgcctgcaccggcagctgcacctgcaaggagtgcaagtgcaccagctgcaagaagagctgctgcagctgctgccccgtgggctgcgccaagtgcgcccacggctgcgtgtgcaagggcaccctggagaactgcagctgctgcgcctag

SEQ ID NO: 22459 - DNA, 879 bp, Artificial Sequence
  Description of Artificial Sequence: Synthetic coding sequence
atggagaccgccgagaaggagtgcggcgccctgggcggcctgttccaggccatcgtgaacgacatgaagagcagctaccccatctgggaggacttcaacagcaaggccaccaagctgcacagccagctgagaaccaccgtgctggccgccgtggccttcctggacgccttccagaaggtggccgacatggccaccaacaccagaggcgccaccagagacatcggcagcgccctgaccagaatgtgcatgagacacagaagcatcgagaccaagctgagacagttcaccaacgccctgctggagagcctgatcaaccccctgcaggagagaatcgaggactggaagaaggccgccaaccagctggacaaggaccacgccaaggagtacaagagagccagacacgagatcaagaagaagagcagcgacaccctgaagctgcagaagaaggccagaaagggcaagggcgacctgcagccccagctggacagcgccctgcaggacgtgaacgacatgtacctgctgctggaggagaccgagaagcaggccgtgagaagagccctgatcgaggagagaggcagattctgcaccttcatcaccttcctgcagcccgtggtgaacggcgagctgaccatgctgggcgagatcacccacctgcagggcatcatcgacgacctggtggtgctgaccgccgagccccacaagctgccccccgccagcgagcaggtgatcaaggacctgaagggcagcgactacagctggagctaccagacccccccccccagcgtgcccagcgagcccttcgtgagcttcctgagcgtgagattctggaagaacagccccctgctgcccgcccccagcacccccagcagccccatctag

SEQ ID NO: 22460 - DNA, 2244 bp, Artificial Sequence
  Description of Artificial Sequence: Synthetic coding sequence
atggagaccgccgagaaggagtgcggcgccctgggcggcctgttccaggccatcgtgaacgacatgaagagcagctaccccatctgggaggacttcaacagcaaggccaccaagctgcacagccagctgagaaccaccgtgctggccgccgtggccttcctggacgccttccagaaggtggccgacatggccaccaacaccagaggcgccaccagagacatcggcagcgccctgaccagaatgtgcatgagacacagaagcatcgagaccaagctgagacagttcaccaacgccctgctggagagcctgatcaaccccctgcaggagagaatcgaggactggaagaaggccgccaaccagctggacaaggaccacgccaaggagtacaagagagccagacacgagatcaagaagaagagcagcgacaccctgaagctgcagaagaaggccagaaaggagctgctgggcaagggcgacctgcagccccagctggacagcgccctgcaggacgtgaacgacatgtacctgctgctggaggagaccgagaagcaggccgtgagaagagccctgatcgaggagagaggcagattctgcaccttcatcaccttcctgcagcccgtggtgaacggcgagctgaccatgctgggcgagatcacccacctgcagggcatcatcgacgacctggtggtgctgaccgccgagccccacaagctgccccccgccagcgagcaggtgatcaaggacctgaagggcagcgactacagctggagctaccagaccccccccagcagccccagcagcagcagcagcagaaagagcagcatgtgcagcgcccccagcagcagcagcagcgccaagggcggcggcgccccctggcccggcggcgcccagacctacagccccagcagcacctgcagatacagaagcctggcccagcccgccaccaccaccgccagactgagcagcgtgagcagccacgacagcggcttcgtgagccaggacgccacctacagcaagccccccagccccatgcccagcgacatcaccagccagaagagcagcagcagcgccagcagcgaggccagcgagacctgccagagcgtgagcgagtgcagcagccccaccagcgactggagcaaggtgggcagccacgagcagcccagcggcgccaccctgcagagaagaaaggacagagtggagctgctgagagacaccgagcccggccccgccagcggcggcaccctgggccccagcggcgaggaggcccccagacccagaatgagccccgccaccatcgccgccaagcacggcgaggaggtgagccccgccgccagcgacctggccatggtgctgaccagaggcctgagcctggagcaccagaagagcagcagagacagcctgcagtacagcagcggctacagcacccagaccaccacccccagctgcagcgaggacaccatccccagccagggcagcgactacgactgctacagcgtgaacggcgacgccgacagcgagggcccccccgagttcgacaagagcagcaccatccccagaaacagcaacatcgcccagaactacagaagactgatccagaccaagagacccgccagcaccgccggcctgcccaccgccggcctgcccaccgccaccggcctgcccagcggcgccccccccggcgtggccaccatcagaagaacccccagcaccaagcccaccgtgagaagagccctgagcagcgccggccccatccccatcagaccccccatcgtgcccgtgaagacccccaccgtgcccgacagccccggctacatgggccccaccagagccggcagcgaggagtgcgtgttctacaccgacgagaccgccagccccctggcccccgacctggccaaggccagccccaagagactgagcctgcccaacaccgcctggggcagccccagccccgaggccgccggctaccccggcgccggcgccgaggacgagcagcagcagctggccgccaacagacacagcctggtggagaagctgggcgagctggtggccggcgcccacgccctgggcgagggccagttccccttccccaccgccctgagcgccacccccaccgaggagacccccacccccccccccgccgccaccagcgacccccccgccgaggacatgctggtggccatcagaagaggcgtgagactgagaagaaccgtgaccaacgacagaagcgcccccagaatcctgtag

SEQ ID NO: 22461 - DNA, 1149 bp, Artificial Sequence
  Description of Artificial Sequence: Synthetic coding sequence
atggagcccagagccggcgtgagcaagcaggacatcagagagcagatctggggctacatggagagccagaacctggccgacttccccagacccgtgcaccacagaatccccaacttcaagggcagctacctggcctgccagaacatcaaggacctggacgtgttcgccagaacccaggaggtgaaggtggaccccgacaagcccctggagggcgtgagactgctggtgctgcagagcaagaagaccctgctggtgcccacccccagactgagaaccggcctgttcaacaagatcacccccccccccggcgccaccaaggacatcctgagaaagtgcgccaccagccagggcgtgagaaactacagcgtgcccatcggcctggacagcagagtgctggtggacctggtggtggtgggcagcgtggccgtgagcgagaagggctggagaatcggcaagggcgagggctacgccgacctggagtacgccatgatggtgagcatgggcgccgtgagcaaggagacccccgtggtgaccatcgtgcacgactgccaggtggtggacatccccgaggagctggtggaggagcacgacatcaccgtggactacatcctgacccccaccagagtgatcgccaccggctgcaagagacccaagcccatgggcatcacctggttcaagatcagcctggagatgatggagaagatccccatcctgagaagcctgagagccagagagcagcaggccggcaaggacgtgaccctgcagggcgagcaccagcacctgcccgagcccggctgccagcagaccgtgcccctgagcgtgggcagaagaccccccgacacccccggccccgagaccaacagcatggaggccgcccccggcagcccccccggcgagggcgcccccctggccgccgacgtgtacgtgggcaacctgcccggcgacgccagagtgagcgacctgaagagagccctgagagagctgggcagcgtgcccctgagactgacctggcagggccccagaagaagagccttcctgcactaccccgacagcgccgccgcccagcaggccgtgagctgcctgcagggcctgagactgggcaccgacaccctgagagtggccctggccagacagcagagagacaagtag

SEQ ID NO: 22462 - DNA, 1152 bp, Artificial Sequence
  Description of Artificial Sequence: Synthetic coding sequence
atggagcccagagccgtgggcgtgagcaagcaggacatcagagagcagatctggggctacatggagagccagaacctggccgacttccccagacccgtgcaccacagaatccccaacttcaagggcagctacctggcctgccagaacatcaaggacctggacgtgttcgccagaacccaggaggtgaaggtggaccccgacaagcccctggagggcgtgagactgctggtgctgcagagcaagaagaccctgctggtgcccacccccagactgagaaccggcctgttcaacaagatcacccccccccccggcgccaccaaggacatcctgagaaagtgcgccaccagccagggcgtgagaaactacagcgtgcccatcggcctggacagcagagtgctggtggacctggtggtggtgggcagcgtggccgtgagcgagaagggctggagaatcggcaagggcgagggctacgccgacctggagtacgccatgatggtgagcatgggcgccgtgagcaaggagacccccgtggtgaccatcgtgcacgactgccaggtggtggacatccccgaggagctggtggaggagcacgacatcaccgtggactacatcctgacccccaccagagtgatcgccaccggctgcaagagacccaagcccatgggcatcacctggttcaagatcagcctggagatgatggagaagatccccatcctgagaagcctgagagccagagagcagcaggccggcaaggacgtgaccctgcagggcgagcaccagcacctgcccgagcccggctgccagcagaccgtgcccctgagcgtgggcagaagaccccccgacacccccggccccgagaccaacagcatggaggccgcccccggcagcccccccggcgagggcgcccccctggccgccgacgtgtacgtgggcaacctgcccggcgacgccagagtgagcgacctgaagagagccctgagagagctgggcagcgtgcccctgagactgacctggcagggccccagaagaagagccttcctgcactaccccgacagcgccgccgcccagcaggccgtgagctgcctgcagggcctgagactgggcaccgacaccctgagagtggccctggccagacagcagagagacaagtag

SEQ ID NO: 22463 - DNA, 1152 bp, Artificial Sequence
  Description of Artificial Sequence: Synthetic coding sequence
atggagcccagagccgtgggcgtgagcaagcaggacatcagagagcagatctggggctacatggagagccagaacctggccgacttccccagacccgtgcaccacagaatccccaacttcaagggcgccagccacgccgccgagcagctgcccagactgcaggccttcaagaccgccagaaccatcaaggtgaaccccgacgccccccagaagagcgccagattcttcgtgctggagagcaagaagaccctgctggtgcccacccccagactgagaaccggcctgttcaacaagatcacccccccccccggcgccaccaaggacatcctgagaaagtgcgccaccagccagggcgtgagaaactacagcgtgcccatcggcctggacagcagagtgctggtggacctggtggtggtgggcagcgtggccgtgagcgagaagggctggagaatcggcaagggcgagggctacgccgacctggagtacgccatgatggtgagcatgggcgccgtgagcaaggagacccccgtggtgaccatcgtgcacgactgccaggtggtggacatccccgaggagctggtggaggagcacgacatcaccgtggactacatcctgacccccaccagagtgatcgccaccggctgcaagagacccaagcccatgggcatcacctggttcaagatcagcctggagatgatggagaagatccccatcctgagaagcctgagagccagagagcagcaggccggcaaggacgtgaccctgcagggcgagcaccagcacctgcccgagcccggctgccagcagaccgtgcccctgagcgtgggcagaagaccccccgacacccccggccccgagaccaacagcatggaggccgcccccggcagcccccccggcgagggcgcccccctggccgccgacgtgtacgtgggcaacctgcccggcgacgccagagtgagcgacctgaagagagccctgagagagctgggcagcgtgcccctgagactgacctggcagggccccagaagaagagccttcctgcactaccccgacagcgccgccgcccagcaggccgtgagctgcctgcagggcctgagactgggcaccgacaccctgagagtggccctggccagacagcagagagacaagtag

SEQ ID NO: 22464 - DNA, 1146 bp, Artificial Sequence
  Description of Artificial Sequence: Synthetic coding sequence
ggccccagactgggcgtgagcaagcaggacatcagagagcagatctggggctacatggagagccagaacctggccgacttccccagacccgtgcaccacagaatccccaacttcaagggcagctacctggcctgccagaacatcaaggacctggacgtgttcgccagaacccaggaggtgaaggtggaccccgacaagcccctggagggcgtgagactgctggtgctgcagagcaagaagaccctgctggtgcccacccccagactgagaaccggcctgttcaacaagatcacccccccccccggcgccaccaaggacatcctgagaaagtgcgccaccagccagggcgtgagaaactacagcgtgcccatcggcctggacagcagagtgctggtggacctggtggtggtgggcagcgtggccgtgagcgagaagggctggagaatcggcaagggcgagggctacgccgacctggagtacgccatgatggtgagcatgggcgccgtgagcaaggagacccccgtggtgaccatcgtgcacgactgccaggtggtggacatccccgaggagctggtggaggagcacgacatcaccgtggactacatcctgacccccaccagagtgatcgccaccggctgcaagagacccaagcccatgggcatcacctggttcaagatcagcctggagatgatggagaagatccccatcctgagaagcctgagagccagagagcagcaggccggcaaggacgtgaccctgcagggcgagcaccagcacctgcccgagcccggctgccagcagaccgtgcccctgagcgtgggcagaagaccccccgacacccccggccccgagaccaacagcatggaggccgcccccggcagcccccccggcgagggcgcccccctggccgccgacgtgtacgtgggcaacctgcccggcgacgccagagtgagcgacctgaagagagccctgagagagctgggcagcgtgcccctgagactgacctggcagggccccagaagaagagccttcctgcactaccccgacagcgccgccgcccagcaggccgtgagctgcctgcagggcctgagactgggcaccgacaccctgagagtggccctggccagacagcagagagacaagtag

SEQ ID NO: 22465 - DNA, 663 bp, Artificial Sequence
  Description of Artificial Sequence: Synthetic coding sequence
atgatggtgagcatgggcgccgtgagcaaggagacccccgtggtgaccatcgtgcacgactgccaggtggtggacatccccgaggagctggtggaggagcacgacatcaccgtggactacatcctgacccccaccagagtgatcgccaccggctgcaagagacccaagcccatgggcatcacctggttcaagatcagcctggagatgatggagaagatccccatcctgagaagcctgagagccagagagcagcaggccggcaaggacgtgaccctgcagggcgagcaccagcacctgcccgagcccggctgccagcagaccgtgcccctgagcgtgggcagaagaccccccgacacccccggccccgagaccaacagcatggaggccgcccccggcagcccccccggcgagggcgcccccctggccgccgacgtgtacgtgggcaacctgcccggcgacgccagagtgagcgacctgaagagagccctgagagagctgggcagcgtgcccctgagactgacctggcagggccccagaagaagagccttcctgcactaccccgacagcgccgccgcccagcaggccgtgagctgcctgcagggcctgagactgggcaccgacaccctgagagtggccctggccagacagcagagagacaagtag

SEQ ID NO: 22466 - DNA, 579 bp, Artificial Sequence
  Description of Artificial Sequence: Synthetic coding sequence
atgtgcagcgagcccaagcaccacgtgaacggcaacagaaccgtggagcccttccccgagggcacccagatggccgtgttcggcatgggctgcttctggggcgccgagagaaagttctgggtgctgaagggcgtgtacagcacccaggtgggcttcgccggcggctacaccagcaaccccacctacaaggaggtgtgcagcgagaagaccggccacgccgaggtggtgagagtggtgtaccagcccgagcacatgagcttcgaggagctgctgaaggtgttctgggagaaccacgaccccacccagggcatgagacagggcaacgaccacggcacccagtacagaagcgccatctaccccaccagcgccaagcagatggaggccgccctgagcagcaaggagaactaccagaaggtgctgagcgagcacggcttcggccccatcaccaccgacatcagagagggccagaccttctactacgccgaggactaccaccagcagtacctgagcaagaaccccaacggctactgcggcctgggcggcaccggcgtgagctgccccgtgggcatcaagaagtag

SEQ ID NO: 22467 - DNA, 588 bp, Artificial Sequence
  Description of Artificial Sequence: Synthetic coding sequence
atgctgagcgccaccagaagagcctgccagctgctgctgctgcacagcctgttccccgtgcccagaatgggcaacagcgccagcaacatcgtgagcccccaggaggccctgcccggcagaaaggagcagacccccgtggccgccaagcaccacgtgaacggcaacagaaccgtggagcccttccccgagggcacccagatggccgtgttcgagaagaccggccacgccgaggtggtgagagtggtgtaccagcccgagcacatgagcttcgaggagctgctgaaggtgttctgggagaaccacgaccccacccagggcatgagacagggcaacgaccacggcacccagtacagaagcgccatctaccccaccagcgccaagcagatggaggccgccctgagcagcaaggagaactaccagaaggtgctgagcgagcacggcttcggccccatcaccaccgacatcagagagggccagaccttctactacgccgaggactaccaccagcagtacctgagcaagaaccccaacggctactgcggcctgggcggcaccggcgtgagctgccccgtgggcatcaagaagtag

SEQ ID NO: 22468 - DNA, 510 bp, Artificial Sequence
  Description of Artificial Sequence: Synthetic coding sequence
atggccgtgttcggcatgggctgcttctggggcgccgagagaaagttctgggtgctgaagggcgtgtacagcacccaggtgggcttcgccggcggctacaccagcaaccccacctacaaggaggtgtgcagcgagaagaccggccacgccgaggtggtgagagtggtgtaccagcccgagcacatgagcttcgaggagctgctgaaggtgttctgggagaaccacgaccccacccagggcatgagacagggcaacgaccacggcacccagtacagaagcgccatctaccccaccagcgccaagcagatggaggccgccctgagcagcaaggagaactaccagaaggtgctgagcgagcacggcttcggccccatcaccaccgacatcagagagggccagaccttctactacgccgaggactaccaccagcagtacctgagcaagaaccccaacggctactgcggcctgggcggcaccggcgtgagctgccccgtgggcatcaagaagtag

SEQ ID NO: 22469 - DNA, 627 bp, Artificial Sequence
  Description of Artificial Sequence: Synthetic coding sequence
atgggcgagcccgccttcaccagcttccccagcctgcccgtgctgggcaagctgaagagaaacatgatgccctgggccctgcagaagaagagagagatccacatggccaaggcccacagaagaagagccgccagaagcgccctgcccatgagactgaccagctgcatcttcagaagacccgtgaccagaatcagaagccaccccgacaaccaggtgagaagaagaaagggcgacgagcacctggagaagccccagcagctgtgcgcctacagaagactgcaggccctgcagccctgcagcagccagggcgagggcagcagccccctgcacctggagagcgtgctgagcatcctggcccccggcaccgccggcgagagcctggacagagccggcgccgagagagtgagaagccccctggagcccacccccggcagattccccgccgtggccggcggccccacccccggcatgggctgccagctgcccccccccctgagcggccagctggtgacccccgccgacatcagaagacaggccagaagagtgaagaaggccagagagagactggccaaggccctgcaggccgacagactggccagaagagccgagatgctgaccggcggctag

SEQ ID NO: 22470 - DNA, 627 bp, Artificial Sequence
  Description of Artificial Sequence: Synthetic coding sequence
atgggcgagcccgccttcaccagcttccccagcctgcccgtgctgggcaagctgaagagaaacatgatgccctgggccctgcagaagaagagagagatccacatggccaaggcccacagaagaagagccgccagaagcgccctgcccatgagactgaccagctgcatcttcagaagacccgtgaccagaatcagaagccaccccgacaaccaggtgagaagaagaaagggcgacgagcacctggagaagccccagcagctgtgcgcctacagaagactgcaggccctgcagccctgcagcagccagggcgagggcagcagccccctgcacctggagagcgtgctgagcatcctggcccccggcaccgccggcgagagcctggacagagccggcgccgagagagtgagaagccccctggagcccacccccggcagattccccgccgtggccggcggccccacccccggcatgggctgccagctgcccccccccctgagcggccagctggtgacccccgccgacatcagaagacaggccagaagagtgaagaaggccagagagagactggccaaggccctgcaggccgacagactggccagaagagccgagatgctgaccgtgagatag

SEQ ID NO: 22471 - DNA, 627 bp, Artificial Sequence
  Description of Artificial Sequence: Synthetic coding sequence
atgggcgagcccgccttcaccagcttccccagcccccccgtgctgggcaagctgaagagaaacatgatgccctgggccctgcagaagaagagagagatccacatggccaaggcccacagaagaagagccgccagaagcgccctgcccatgagactgaccagctgcatcttcagaagacccgtgaccagaatcagaagccaccccgacaaccaggtgagaagaagaaagggcgacgagcacctggagaagccccagcagctgtgcgcctacagaagactgcaggccctgcagccctgcagcagccagggcgagggcagcagccccctgcacctggagagcgtgctgagcatcctggcccccggcaccgccggcgagagcctggacagagccggcgccgagagagtgagaagccccctggagcccacccccggcagattccccgccgtggccggcggccccacccccggcatgggctgccagctgcccccccccctgagcggccagctggtgacccccgccgacatcagaagacaggccagaagagtgaagaaggccagagagagactggccaaggccctgcaggccgacagactggccagacaggccgagatgctgacctgcagatag

SEQ ID NO: 22472 - DNA, 627 bp, Artificial Sequence
  Description of Artificial Sequence: Synthetic coding sequence
atgggcgagcccgccttcaccagcttccccagcccccccgtgctgggcaagctgaagagaaacatgatgccctgggccctgcagaagaagagagagatccacatggccaaggcccacagaagaagagccgccagaagcgccctgcccatgagactgaccagctgcatcttcagaagacccgtgaccagaatcagaagccaccccgacaaccaggtgagaagaagaaagggcgacgagcacctggagaagccccagcagctgtgcgcctacagaagactgcaggccctgcagccctgcagcagccagggcgagggcagcagccccctgcacctggagagcgtgctgagcatcctggcccccggcaccgccggcgagagcctggacagagccggcgccgagagagtgagaatccccctggagcccacccccggcagattccccgccgtggccggcggccccacccccggcatgggctgccagctgcccccccccctgagcggccagctggtgacccccgccgacatcagaagacaggccagaagagtgaagaaggccagagagagactggccaaggccctgcaggccgacagactggccagacaggccgagatgctgacctgcagatag

SEQ ID NO: 22473 - DNA, 627 bp, Artificial Sequence
  Description of Artificial Sequence: Synthetic coding sequence
atgggcgagcccgccttcaccagcttccccagcccccccgtgctgggcaagctgaagagaaacatgatgccctgggccctgcagaagaagagagagatccacatggccaaggcccacagaagaagagccgccagaagcgccctgcccatgagactgaccagctgcatcttcagaagacccgtgaccagaatcagaagccaccccgacaaccaggtgagaagaagaaagggcgacgagcacctggagaagccccagcagctgtgcgcctacagaagactgcaggccctgcagccctgcagcagccagggcgagggcagcagccccctgcacctggagagcgtgctgagcatcctggcccccggcaccgccggcgagagcctggacagagccggcgccgagagagtgagaatccccctggagcccacccccggcagattccccgccgtggccggcggccccacccccggcatgggctgccagctgcccccccccctgagcggccagctggtgacccccgccgacatcagaagacaggccagaagagtgaagaaggccagagagagactggccaaggccctgcaggccgacagactggccagacaggccgagatgctgaccggcggctag

SEQ ID NO: 22474 - DNA, 627 bp, Artificial Sequence
  Description of Artificial Sequence: Synthetic coding sequence
atgggcgagcccgccttcaccagcttccccagcccccccgtgctgggcaagctgaagagaaacatgatgccctgggccctgcagaagaagagagagatccacatggccaaggcccacagaagaagagccgccagaagcgccctgcccatgagactgaccagctgcatcttcagaagacccgtgaccagaatcagaagccaccccgacaaccaggtgagaagaagaaagggcgacgagcacctggagaagccccagcagctgtgcgcctacagaagactgcaggccctgcagccctgcagcagccagggcgagggcagcagccccctgcacctggagagcgtgctgagcatcctggcccccggcaccgccggcgagagcctggacagagccggcgccgagagagtgagaatccccctggagcccacccccggcagattccccgccgtggccggcggccccacccccggcatgggctgccagctgcccccccccctgagcggccagctggtgacccccgccgacatcagaagacaggccagaagagtgaagaaggccagagagagactggccaaggccctgcaggccgacagactggccagacaggccgagatgctgaccgtgagatag

SEQ ID NO: 22475 - DNA, 615 bp, Artificial Sequence
  Description of Artificial Sequence: Synthetic coding sequence
atgggcgagcccgccttcaccagcttccccagcctgcccgtgctgggcaagctgaagagaaacatgatgccctgggccctgcagaagaagagagagatccacatggccaaggcccacagaagaagagccgccagaagcgccctgcccatgagactgaccagctgcatcttcagaagacccgtgaccagaatcagaagccaccccgacaaccaggtgagaagaagaaagggcgacgagcacctggagaagccccagcagctgtgcgcctacagaagactgcaggccctgcagccctgcagcagccagggcgagggcagcagccccctgcacctggagagcgtgctgagcatcctggcccccggcaccgccggcgagagcctggacagagccggcgccgagagagtgagaagccccctggagcccacccccggcagattccccgccgtggccggcggccccacccccggcatgggctgccagctgcccccccccctgagcggccagctggtgacccccgccgacatcagaagacaggccagaagagtgaagaaggccagagagagactggccaaggccctgcaggccgacagactggccagaagagccgagatgtag

SEQ ID NO: 22476 - DNA, 759 bp, Artificial Sequence
  Description of Artificial Sequence: Synthetic coding sequence
atgagcagcgaggtgagcgccagaagagacgccaagaagctggtgagaagccccagcggcctgagaatggtgcccgagcacagagccttcggcagccccttcggcctggaggagccccagtgggtgcccgacaaggagtgcagaagatgcatgcagtgcgacgccaagttcgacttcctgaccagaaagcaccactgcagaagatgcggcaagtgcttctgcgacagatgctgcagccagaaggtgcccctgagaagaatgtgcttcgtggaccccgtgagacagtgcgccgagtgcgccctggtgagcctgaaggaggccgagttctacgacaagcagctgaaggtgctgctgagcggcgccaccttcctggtgaccttcggcaacagcgagaagcccgagaccatgacctgcagactgagcaacaaccagagatacctgttcctggacggcgacagccactacgagatcgagatcgtgcacatcagcaccgtgcagatcctgaccgagggcttcccccccggcgagaaggacatccacgcctacaccagcctgagaggcagccagcccgccagcgagggcggcaacgccagagccaccggcatgttcctgcagtacaccgtgcccggcaccgagggcgtgacccagctgaagctgaccgtggtggaggacgtgaccgtgggcagaagacaggccgtggcctggctggtggccatgcacaaggccgccaagctgctgtacgagagcagagaccagtag

SEQ ID NO: 22477 - DNA, 2808 bp, Artificial Sequence
  Description of Artificial Sequence: Synthetic coding sequence
atggcccccgccgagatcctgaacggcaaggagatcagcgcccagatcagagccagactgaagaaccaggtgacccagctgaaggagcaggtgcccggcttcacccccagactggccatcctgcaggtgggcaacagagacgacagcaacctgtacatcaacgtgaagctgaaggccgccgaggagatcggcatcaaggccacccacatcaagctgcccagaaccaccaccgagagcgaggtgatgaagtacatcaccagcctgaacgaggacagcaccgtgcacggcttcctggtgcagctgcccctggacagcgagaacagcatcaacaccgaggaggtgatcaacgccatcgcccccgagaaggacgtggacggcctgaccagcatcaacgccggcaagctggccagaggcgacctgaacgactgcttcatcccctgcacccccaagggctgcctggagctgatcaaggagaccggcgtgcccatcgccggcagacacgccgtggtggtgggcagaagcaagatcgtgggcgcccccatgcacgacctgctgctgtggaacaacgccaccgtgaccacctgccacagcaagaccgcccacctggacgaggaggtgaacaagggcgacatcctggtggtggccaccggccagcccgagatggtgaagggcgagtggatcaagcccggcgccatcgtgatcgactgcggcatcaactacgtgcccgacgacaagaagcccaacggcagaaaggtggtgggcgacgtggcctacgacgaggccaaggagagagccagcttcatcacccccgtgcccggcggcgtgggccccatgaccgtggccatgctgatgcagagcaccgtggagagcgccaagagattcctggagaagttcaagcccggcaagtggatgatccagtacaacaacctgaacctgaagacccccgtgcccagcgacatcgacatcagcagaagctgcaagcccaagcccatcggcaagctggccagagagatcggcctgctgagcgaggaggtggagctgtacggcgagaccaaggccaaggtgctgctgagcgccctggagagactgaagcacagacccgacggcaagtacgtggtggtgaccggcatcacccccacccccctgggcgagggcaagagcaccaccaccatcggcctggtgcaggccctgggcgcccacctgtaccagaacgtgttcgcctgcgtgagacagcccagccagggccccaccttcggcatcaagggcggcgccgccggcggcggctacagccaggtgatccccatggaggagttcaacctgcacctgaccggcgacatccacgccatcaccgccgccaacaacctggtggccgccgccatcgacgccagaatcttccacgagctgacccagaccgacaaggccctgttcaacagactggtgcccagcgtgaacggcgtgagaagattcagcgacatccagatcagaagactgaagagactgggcatcgagaagaccgaccccaccaccctgaccgacgaggagatcaacagattcgccagactggacatcgaccccgagaccatcacctggcagagagtgctggacaccaacgacagattcctgagaaagatcaccatcggccaggcccccaccgagaagggccacaccagaaccgcccagttcgacatcagcgtggccagcgagatcatggccgtgctggccctgaccaccagcctggaggacatgagagagagactgggcaagatggtggtggccagcagcaagaagggcgagcccgtgagcgccgaggacctgggcgtgagcggcgccctgaccgtgctgatgaaggacgccatcaagcccaacctgatgcagaccctggagggcacccccgtgttcgtgcacgccggccccttcgccaacatcgcccacggcaacagcagcatcatcgccgacagaatcgccctgaagctggtgggccccgagggcttcgtggtgaccgaggccggcttcggcgccgacatcggcatggagaagttcttcaacatcaagtgcagatacagcggcctgtgcccccacgtggtggtgctggtggccaccgtgagagccctgaagatgcacggcggcggccccaccgtgaccgccggcctgcccctgcccaaggcctacatccaggagaacctggagctggtggagaagggcttcagcaacctgaagaagcagatcgagaacgccagaatgttcggcatccccgtggtggtggccgtgaacgccttcaagaccgacaccgagagcgagctggacctgatcagcagactgagcagagagcacggcgccttcgacgccgtgaagtgcacccactgggccgagggcggcaagggcgccctggccctggcccaggccgtgcagagagccgcccaggcccccagcagcttccagctgctgtacgacctgaagctgcccgtggaggacaagatcagaatcatcgcccagaagatctacggcgccgacgacatcgagctgctgcccgaggcccagcacaaggccgaggtgtacaccaagcagggcttcggcaacctgcccatctgcatggccaagacccacctgagcctgagccacaaccccgagcagaagggcgtgcccaccggcttcatcctgcccatcagagacatcagagccagcgtgggcgccggcttcctgtaccccctggtgggcaccatgagcaccatgcccggcctgcccaccagaccctgcttctacgacatcgacctggaccccgagaccgagcaggtgaacggcctgttctag

SEQ ID NO: 22478 - DNA, 852 bp, Artificial Sequence
  Description of Artificial Sequence: Synthetic coding sequence
atggcccacagaggcgcccacttcgccttcagaagcagatggcagaagaccgacgacgagctgtgcagacacagcatgagcttcatcctgcacaaggccatcagaaacgacttcttccagagctacctgtacctgctggagaagatccccctggtgaagctgtacgccctgaccagccaggtgatcaacggcgagatgcagttctacgccagagccaagctgttctaccaggaggtgcccgccaccgaggagggcatgatgggcaacttcatcgagctgagcagccccgacatccaggccagccagaagttcctgagaaagttcgtgggcggccccggcagagccggcaccgactgcgccctggactgcggcagcggcatcggcagagtgagcaagcacgtgctgctgcccgtgttcaacagcgtggagctggtggacatgatggagagcttcctgctggaggcccagaactacctgcaggtgaagggcgacaaggtggagagctaccactgctacagcctgcaggagttcaccccccccttcagaagatacgacgtgatctggatccagtgggtgagcggccacctgaccgacaaggacctgctggccttcctgagcagatgcagagacggcctgaaggagaacggcatcatcatcctgaaggacaacgtggccagagagggctgcatcctggacctgagcgacagcagcgtgaccagagacatggacatcctgagaagcctgatcagaaagagcggcctggtggtgctgggccaggagaagcaggacggcttccccgagcagtgcatccccgtgtggatgttcgccctgcacagcgacagacacagctag

SEQ ID NO: 22479 - DNA, 1191 bp, Artificial Sequence
  Description of Artificial Sequence: Synthetic coding sequence
atgaaggagtgcaacgccaccagaagaccccagatgagcttcctgaagatggacatgacccagatggagttccccgacgccagcttccaggtggtgctggacaagggcaccctggacgccgtgctgaccgacgaggaggagaagaccctgcagcaggtggacagaatgctggccgaggtgggcagagtgctgcaggtgggcggcagatacctgtgcatcagcctggcccaggcccacatcctgaagaaggccgtgggccacttcagcagagagggctggatggtgagagtgcaccaggtggccaacagccaggaccaggtgctggaggccgagccccagttcagcctgcccgtgttcgccttcatcatgaccaagttcagacccgtgcccggcagcgccctgcagatcttcgagctgtgcgcccaggagcagagaaagcccgtgagactggagagcgccgagagactggccgaggccgtgcaggagagacagcagtacgcctggctgtgcagccagctgagaagaaaggccagactgggcagcgtgagcctggacctgtgcgacggcgacaccggcgagcccagatacaccctgcacgtggtggacagcctgcccctgttcgtgcacgaccacttccccaagagctgcatcgacgccgtggagatcgaccccagcatgctggaggtggccacccagtggttcggcttcagccagagcgacagaatgaaggtgcacatcgccgacggcctggactacatcgccagcctggccggcggcggcgaggccagaccctgctacgacgtgatcatgttcgacgtggacagcaaggaccccaccctgggcatgagctgccccccccccgccttcgtggagcagagcttcctgcagaaggtgaagagcatcctgacccccgagggcgtgttcatcctgaacctggtgtgcagagacctgggcctgaaggacagcgtgctggccggcctgaaggccgtgttccccctgctgtacgtgagaagaatcgagggcgaggtgaacgagatcctgttctgccagctgcaccccgagcagaagctggccacccccgagctgctggagaccgcccaggccctggagagaaccctgagaaagcccggcagaggctgggacgacacctacgtgctgagcgacatgctgaagaccgtgaagatcgtgtag

SEQ ID NO: 22480 - DNA, 2100 bp, Artificial Sequence
  Description of Artificial Sequence: Synthetic coding sequence
atgaacctgctgcccaagagcagcagagagttcggcagcgtggactactgggagaagttcttccagcagagaggcaagaaggccttcgagtggtacggcacctacctggagctgtgcggcgtgctgcacaagtacatcaagcccagagagaaggtgctggtgatcggctgcggcaacagcgagctgagcgagcagctgtacgacgtgggctacagagacatcgtgaacatcgacatcagcgaggtggtgatcaagcagatgaaggagtgcaacgccaccagaagaccccagatgagcttcctgaagatggacatgacccagatggagttccccgacgccagcttccaggtggtgctggacaagggcaccctggacgccgtgctgaccgacgaggaggagaagaccctgcagcaggtggacagaatgctggccgaggtgggcagagtgctgcaggtgggcggcagatacctgtgcatcagcctggcccaggcccacatcctgaagaaggccgtgggccacttcagcagagagggctggatggtgagagtgcaccaggtggccaacagccaggaccaggtgctggaggccgagccccagttcagcctgcccgtgttcgccttcatcatgaccaagttcagacccgtgcccggcagcgccctgcagatcttcgagctgtgcgcccaggagcagagaaagcccgtgagactggagagcgccgagagactggccgaggccgtgcaggagagacagcagtacgcctggctgtgcagccagctgagaagaaaggccagactgggcagcgtgagcctggacctgtgcgacggcgacaccggcgagcccagatacaccctgcacgtggtggacagccccaccgtgaagcccagcagagacaaccacttcgccatcttcatcatcccccagggcagagagaccgagtggctgttcggcatggacgagggcagaaagcagctggccgccagcgccggcttcagaagactgatcaccgtggccctgcacagaggccagcagtacgagagcatggaccacatccaggccgagctgagcgccagagtgatggagctggcccccgccggcatgcccacccagcagcaggtgcccttcctgagcgtgggcggcgacatcggcgtgagaaccgtgcagcaccaggactgcagccccctgagcggcgactacgtgatcgaggacgtgcagggcgacgacaagagatacttcagaagactgatcttcctgagcaacagaaacgtggtgcagagcgaggccagactgctgaaggacgtgagccacaaggcccagaagaagagaaagaaggacagaaagaagcagagacccgccgacgccgaggacctgcccgccgcccccggccagagcatcgacaagagctacctgtgctgcgagcaccacaaggccatgatcgccggcctggccctgctgagaaaccccgagctgctgctggagatccccctggccctgctggtggtgggcctgggcggcggcagcctgcccctgttcgtgcacgaccacttccccaagagctgcatcgacgccgtggagatcgaccccagcatgctggaggtggccacccagtggttcggcttcagccagagcgacagaatgaaggtgcacatcgccgacggcctggactacatcgccagcctggccggcggcggcgaggccagaccctgctacgacgtgatcatgttcgacgtggacagcaaggaccccaccctgggcatgagctgccccccccccgccttcgtggagcagagcttcctgcagaaggtgaagagcatcctgacccccgagggcgtgttcatcctgaacctggtgtgcagagacctgggcctgaaggacagcgtgctggccggcctgaaggccgtgttccccctgctgtacgtgagaagaatcgagggcgaggtgaacgagatcctgttctgccagctgcaccccgagcagaagctggccacccccgagctgctggagaccgcccaggccctggagagaaccctgagaaagcccggcagaggctgggacgacacctacgtgctgagcgacatgctgaagaccgtgaagatcgtgtag

SEQ ID NO: 22481 - DNA, 1842 bp, Artificial Sequence
  Description of Artificial Sequence: Synthetic coding sequence
atgaaggagtgcaacgccaccagaagaccccagatgagcttcctgaagatggacatgacccagatggagttccccgacgccagcttccaggtggtgctggacaagggcaccctggacgccgtgctgaccgacgaggaggagaagaccctgcagcaggtggacagaatgctggccgaggtgggcagagtgctgcaggtgggcggcagatacctgtgcatcagcctggcccaggcccacatcctgaagaaggccgtgggccacttcagcagagagggctggatggtgagagtgcaccaggtggccaacagccaggaccaggtgctggaggccgagccccagttcagcctgcccgtgttcgccttcatcatgaccaagttcagacccgtgcccggcagcgccctgcagatcttcgagctgtgcgcccaggagcagagaaagcccgtgagactggagagcgccgagagactggccgaggccgtgcaggagagacagcagtacgcctggctgtgcagccagctgagaagaaaggccagactgggcagcgtgagcctggacctgtgcgacggcgacaccggcgagcccagatacaccctgcacgtggtggacagccccaccgtgaagcccagcagagacaaccacttcgccatcttcatcatcccccagggcagagagaccgagtggctgttcggcatggacgagggcagaaagcagctggccgccagcgccggcttcagaagactgatcaccgtggccctgcacagaggccagcagtacgagagcatggaccacatccaggccgagctgagcgccagagtgatggagctggcccccgccggcatgcccacccagcagcaggtgcccttcctgagcgtgggcggcgacatcggcgtgagaaccgtgcagcaccaggactgcagccccctgagcggcgactacgtgatcgaggacgtgcagggcgacgacaagagatacttcagaagactgatcttcctgagcaacagaaacgtggtgcagagcgaggccagactgctgaaggacgtgagccacaaggcccagaagaagagaaagaaggacagaaagaagcagagacccgccgacgccgaggacctgcccgccgcccccggccagagcatcgacaagagctacctgtgctgcgagcaccacaaggccatgatcgccggcctggccctgctgagaaaccccgagctgctgctggagatccccctggccctgctggtggtgggcctgggcggcggcagcctgcccctgttcgtgcacgaccacttccccaagagctgcatcgacgccgtggagatcgaccccagcatgctggaggtggccacccagtggttcggcttcagccagagcgacagaatgaaggtgcacatcgccgacggcctggactacatcgccagcctggccggcggcggcgaggccagaccctgctacgacgtgatcatgttcgacgtggacagcaaggaccccaccctgggcatgagctgccccccccccgccttcgtggagcagagcttcctgcagaaggtgaagagcatcctgacccccgagggcgtgttcatcctgaacctggtgtgcagagacctgggcctgaaggacagcgtgctggccggcctgaaggccgtgttccccctgctgtacgtgagaagaatcgagggcgaggtgaacgagatcctgttctgccagctgcaccccgagcagaagctggccacccccgagctgctggagaccgcccaggccctggagagaaccctgagaaagcccggcagaggctgggacgacacctacgtgctgagcgacatgctgaagaccgtgaagatcgtgtag

SEQ ID NO: 22482 - DNA, 1632 bp, Artificial Sequence
  Description of Artificial Sequence: Synthetic coding sequence
atgaacctgctgcccaagagcagcagagagttcggcagcgtggactactgggagaagttcttccagcagagaggcaagaaggccttcgagtggtacggcacctacctggagctgtgcggcgtgctgcacaagtacatcaagcccagagagaaggtgctggtgatcggctgcggcaacagcgagctgagcgagcagctgtacgacgtgggctacagagacatcgtgaacatcgacatcagcgaggtggtgatcaagcagatgaaggagtgcaacgccaccagaagaccccagatgagcttcctgaagatggacatgacccagatggagttccccgacgccagcttccaggtggtgctggacaagggcaccctggacgccgtgctgaccgacgaggaggagaagaccctgcagcaggtggacagaatgctggccgaggtgggcagagtgctgcagggcagagagaccgagtggctgttcggcatggacgagggcagaaagcagctggccgccagcgccggcttcagaagactgatcaccgtggccctgcacagaggccagcagtacgagagcatggaccacatccaggccgagctgagcgccagagtgatggagctggcccccgccggcatgcccacccagcagcaggtgcccttcctgagcgtgggcggcgacatcggcgtgagaaccgtgcagcaccaggactgcagccccctgagcggcgactacgtgatcgaggacgtgcagggcgacgacaagagatacttcagaagactgatcttcctgagcaacagaaacgtggtgcagagcgaggccagactgctgaaggacgtgagccacaaggcccagaagaagagaaagaaggacagaaagaagcagagacccgccgacgccgaggacctgcccgccgcccccggccagagcatcgacaagagctacctgtgctgcgagcaccacaaggccatgatcgccggcctggccctgctgagaaaccccgagctgctgctggagatccccctggccctgctggtggtgggcctgggcggcggcagcctgcccctgttcgtgcacgaccacttccccaagagctgcatcgacgccgtggagatcgaccccagcatgctggaggtggccacccagtggttcggcttcagccagagcgacagaatgaaggtgcacatcgccgacggcctggactacatcgccagcctggccggcggcggcgaggccagaccctgctacgacgtgatcatgttcgacgtggacagcaaggaccccaccctgggcatgagctgccccccccccgccttcgtggagcagagcttcctgcagaaggtgaagagcatcctgacccccgagggcgtgttcatcctgaacctggtgtgcagagacctgggcctgaaggacagcgtgctggccggcctgaaggccgtgttccccctgctgtacgtgagaagaatcgagggcgaggtgaacgagatcctgttctgccagctgcaccccgagcagaagctggccacccccgagctgctggagaccgcccaggccctggagagaaccctgagaaagcccggcagaggctgggacgacacctacgtgctgagcgacatgctgaagaccgtgaagatcgtgtag

SEQ ID NO: 22483 - DNA, 2097 bp, Artificial Sequence
  Description of Artificial Sequence: Synthetic coding sequence
atgagagccttcgtggtgagcagagagttcggcagcgtggactactgggagaagttcttccagcagagaggcaagaaggccttcgagtggtacggcacctacctggagctgtgcggcgtgctgcacaagtacatcaagcccagagagaaggtgctggtgatcggctgcggcaacagcgagctgagcgagcagctgtacgacgtgggctacagagacatcgtgaacatcgacatcagcgaggtggtgatcaagcagatgaaggagtgcaacgccaccagaagaccccagatgagcttcctgaagatggacatgacccagatggagttccccgacgccagcttccaggtggtgctggacaagggcaccctggacgccgtgctgaccgacgaggaggagaagaccctgcagcaggtggacagaatgctggccgaggtgggcagagtgctgcaggtgggcggcagatacctgtgcatcagcctggcccaggcccacatcctgaagaaggccgtgggccacttcagcagagagggctggatggtgagagtgcaccaggtggccaacagccaggaccaggtgctggaggccgagccccagttcagcctgcccgtgttcgccttcatcatgaccaagttcagacccgtgcccggcagcgccctgcagatcttcgagctgtgcgcccaggagcagagaaagcccgtgagactggagagcgccgagagactggccgaggccgtgcaggagagacagcagtacgcctggctgtgcagccagctgagaagaaaggccagactgggcagcgtgagcctggacctgtgcgacggcgacaccggcgagcccagatacaccctgcacgtggtggacagccccaccgtgaagcccagcagagacaaccacttcgccatcttcatcatcccccagggcagagagaccgagtggctgttcggcatggacgagggcagaaagcagctggccgccagcgccggcttcagaagactgatcaccgtggccctgcacagaggccagcagtacgagagcatggaccacatccaggccgagctgagcgccagagtgatggagctggcccccgccggcatgcccacccagcagcaggtgcccttcctgagcgtgggcggcgacatcggcgtgagaaccgtgcagcaccaggactgcagccccctgagcggcgactacgtgatcgaggacgtgcagggcgacgacaagagatacttcagaagactgatcttcctgagcaacagaaacgtggtgcagagcgaggccagactgctgaaggacgtgagccacaaggcccagaagaagagaaagaaggacagaaagaagcagagacccgccgacgccgaggacctgcccgccgcccccggccagagcatcgacaagagctacctgtgctgcgagcaccacaaggccatgatcgccggcctggccctgctgagaaaccccgagctgctgctggagatccccctggccctgctggtggtgggcctgggcggcggcagcctgcccctgttcgtgcacgaccacttccccaagagctgcatcgacgccgtggagatcgaccccagcatgctggaggtggccacccagtggttcggcttcagccagagcgacagaatgaaggtgcacatcgccgacggcctggactacatcgccagcctggccggcggcggcgaggccagaccctgctacgacgtgatcatgttcgacgtggacagcaaggaccccaccctgggcatgagctgccccccccccgccttcgtggagcagagcttcctgcagaaggtgaagagcatcctgacccccgagggcgtgttcatcctgaacctggtgtgcagagacctgggcctgaaggacagcgtgctggccggcctgaaggccgtgttccccctgctgtacgtgagaagaatcgagggcgaggtgaacgagatcctgttctgccagctgcaccccgagcagaagctggccacccccgagctgctggagaccgcccaggccctggagagaaccctgagaaagcccggcagaggctgggacgacacctacgtgctgagcgacatgctgaagaccgtgaagatcgtgtag

SEQ ID NO: 22484 - DNA, 822 bp, Artificial Sequence
  Description of Artificial Sequence: Synthetic coding sequence
atgctgagatacccctacttctgcagaatgtacaaggagtgcctgagctgctggctggagagcggcatccccaacctgggcgtgtggcccaacagaatccacaccaccgccgagaagtacagagagtacgaggccagagagcagaccgaccagacccaggcccaggagctgcacagaagccaggacagagacttcgagaccatggccaagctgcacatccccgtgatggtggacgaggtggtgcactgcctgagcccccagaagggccagatcttcctggacatgaccttcggcagcggcggccacaccaaggccatcctgcagaaggagagcgacatcgtgctgtacgccctggacagagaccccaccgcctacgccctggccgagcacctgagcgagctgtaccccaagcagatcagagccatgctgggccagttcagccaggccgaggccctgctgatgaaggccggcgtgcagcccggcaccttcgacggcgtgctgatggacctgggctgcagcagcatgcagctggacacccccgagagaggcttcagcctgagaaaggacggccccctggacatgagaatggacggcggcagataccccgacatgcccaccgccgccgacgtggtgaacgccctggaccagcaggccctggccagcatcctgagaacctacggcgaggagaagcacgccaagaagatcgccagcgccatcgtgcaggccagaagcatctaccccatcaccagaacccagcagctggccagcatcgtggccgagtacagcgagacctacttccccgtggcccagaccctgtactag

SEQ ID NO: 22485 - DNA, 822 bp, Artificial Sequence; identical to SEQ ID NO: 22484
  Description of Artificial Sequence: Synthetic coding sequence

SEQ ID NO: 22486 - DNA, 300 bp, Artificial Sequence
  Description of Artificial Sequence: Synthetic coding sequence
atgctgagatacccctacttctgcagaatgtacaaggagtgcctgagctgctggctggagagcggcatccccaacctgggcgtgtggcccaacagaatccacaccaccgccgagaagtacagagagtacgaggccagagagcagaccgaccagacccaggcccaggagctgcacagaagccaggacagagacttcgagaccatggccaagctgcacatccccgtgatggtggacgaggtggtgcactgcctgagcccccagaagggccagagcctgggcgtgagaagcgtgggcatctag

SEQ ID NO: 22487 - DNA, 1224 bp, Artificial Sequence
  Description of Artificial Sequence: Synthetic coding sequence
atgctgagatacccctacttctgcagaatgtacaaggagtgcctgagctgctggctggagagcggcatccccaacctgggcgtgtggcccaacagaatccacaccaccgccgagaagtacagagagtacgaggccagagagcagaccgaccagacccaggcccaggagctgcacagaagccaggacagagacttcgagaccatggccaagctgcacatccccgtgatggtggacgaggtggtgcactgcctgagcccccagaagggccagatcttcctggacatgaccttcggcagcggcggccacaccaaggccatcctgcagaaggagagcgacatcgtgctgtacgccctggacagagaccccaccgcctacgccctggccgagcacctgagcgagctgtaccccaagcagatcagagccatgctgggccagttcagccaggccgaggccctgctgatgaaggccggcgtgcagcccggcaccttcgacggcgtgctgatggacctgggctgcagcagcatgcagctggacacccccgagagaggcttcagcctgagaaaggacggccccctggacatgagaatggacggcggcagataccccgacatgcccaccgccgccgacgtggtgaacgccctggaccagcaggccctggccagcatcctgagaacctacggcgaggagaagcacgccaagaagatcgccagcgccatcgtgcaggccagaagcatctaccccatcaccagaacccagcagctggccagcatcgtggccggcgccttcccccccagcgccatctacaccagaaaggacctgctgcagagaagcacccacatcgccaccaagaccttccaggccctgagaatcttcgtgaacaacgagctgaacgagctgtacaccggcctgaagaccgcccagaagttcctgagacccggcggcagactggtggccctgagcttccacagcctggaggacagaatcgtgaagagattcctgctgggcatcagcatgaccgagagattcaacctgagcgtgagacagcaggtgatgaagaccagccagctgggcagcgaccacgagaacaccgaggaggtgagcatgagaagagcccccctgatgtgggagctgatccacaagaaggtgctgagcccccaggaccaggacgtgcaggacaaccccagaggcagaagcgccaagctgagagccgccatcaagctgtag

SEQ ID NO: 22488 - DNA, 1689 bp, Artificial Sequence
  Description of Artificial Sequence: Synthetic coding sequence
atggccctgagcaagagcatgcacgccagaaacagatacaaggacaagccccccgacttcgcctacctggccagcaagtaccccgacttcaagcagcacgtgcagatcaacctgaacggcagagtgagcctgaacttcaaggaccccgaggccgtgagagccctgacctgcaccctgctgagagaggacttcggcctgagcatcgacatccccctggagagactgatccccaccgtgcccctgagactgaactacatccactgggtggaggacctgatcggccaccaggacagcgacaagagcaccctgagaagaggcatcgacatcggcaccggcgccagctgcatctaccccctgctgggcgccaccctgaacggctggtacttcctggccaccgaggtggacgacatgtgcttcaactacgccaagaagaacgtggagcagaacaacctgagcgacctgatcaaggtggtgaaggtgccccagaagaccctgctgatggacgccctgaaggaggagagcgagatcatctacgacttctgcatgtgcaacccccccttcttcgccaaccagctggaggccaagggcgtgaacagcagaaaccccagaagacccccccccagcagcgtgaacaccggcggcatcaccgagatcatggccgagggcggcgagctggagttcgtgaagagaatcatccacgacagcctgcagctgaagaagagactgagatggtacagctgcatgctgggcaagaagtgcagcctggcccccctgaaggaggagctgagaatccagggcgtgcccaaggtgacctacaccgagttctgccagggcagaaccatgagatgggccctggcctggagcttctacgacgacgtgaccgtgcccagcccccccagcaagagaagaaagctggagaagcccagaaagcccatcaccttcgtggtgctggccagcgtgatgaaggagctgagcctgaaggccagccccctgagaagcgagaccgccgagggcatcgtggtggtgaccacctggatcgagaagatcctgaccgacctgaaggtgcagcacaagagagtgccctgcggcaaggaggaggtgagcctgttcctgaccgccatcgagaacagctggatccacctgagaagaaagaagagagagagagtgagacagctgagagaggtgcccagagcccccgaggacgtgatccaggccctggaggagaagaagcccacccccaaggagagcggcaacagccaggagctggccagaggcccccaggagagaaccccctgcggccccgccctgagagagggcgaggccgccgccgtggagggcccctgccccagccaggagagcctgagccaggaggagaaccccgagcccaccgaggacgagagaagcgaggagaagggcggcgtggaggtgctggagagctgccagggcagcagcaacggcgcccaggaccaggaggccagcgagcagttcggcagccccgtggccgagagaggcaagagactgcccggcgtggccggccagtacctgttcaagtgcctgatcaacgtgaagaaggaggtggacgacgccctggtggagatgcactgggtggagggccagaacagagacctgatgaaccagctgtgcacctacatcagaaaccagatcttcagactggtggccgtgaactag

SEQ ID NO: 22489 - DNA, 675 bp, Artificial Sequence
  Description of Artificial Sequence: Synthetic coding sequence
atggccctgagcaagagcatgcacgccagaaacagatacaaggacaagccccccgacttcgcctacctggccagcaagtaccccgacttcaagcagcacgtgcagatcaacctgaacggcagagtgagcctgaacttcaaggaccccgaggccgtgagagccctgacctgcaccctgctgagagaggacttcggcctgagcatcgacatccccctggagagactgatccccaccgtgcccctgagactgaactacatccactgggtggaggacctgatcggccaccaggacagcgacaagagcaccctgagaagaggcatcgacatcggcaccggcgccagctgcatctaccccctgctgggcgccaccctgaacggctggtacttcctggccaccgaggtggacgacatgtgcttcaactacgccaagaagaacgtggagcagaacaacctgagcgacctgatcaaggtggtgaaggtgccccagaagaccctgctgatggacgccctgaaggaggagagcgagatcatctacgacttctgcatgtgcaacccccccttcttcgccaaccagctggaggccaagggcgtgaacagcagaaaccccagaagacccccccccagcagcgtgaacaccggcgagagcctggagcccggcagaagaagactgcagtag

SEQ ID NO: 22490 - DNA, 606 bp, Artificial Sequence
  Description of Artificial Sequence: Synthetic coding sequence
atgaaggagctgagcctgaaggccagccccctgagaagcgagaccgccgagggcatcgtggtggtgaccacctggatcgagaagatcctgaccgacctgaaggtgcagcacaagagagtgccctgcggcaaggaggaggtgagcctgttcctgaccgccatcgagaacagctggatccacctgagaagaaagaagagagagagagtgagacagctgagagaggtgcccagagcccccgaggacgtgatccaggccctggaggagaagaagcccacccccaaggagagcggcaacagccaggagctggccagaggcccccaggagagaaccccctgcggccccgccctgagagagggcgaggccgccgccgtggagggcccctgccccagccaggagagcctgagccaggaggagaaccccgagcccaccgaggacgagagaagcgaggagaagggcggcgtggaggtgctggagagctgccagggcagcagcaacggcgcccaggaccaggaggcctgctggctgaagctggccccccagctgtggaccgccagcgccagaagcgagggcctgttcgtggagagcggcctgggcagcaccgcctag

SEQ ID NO: 22491 - DNA, 1035 bp, Artificial Sequence
  Description of Artificial Sequence: Synthetic coding sequence
atggccgagggcggcgagctggagttcgtgaagagaatcatccacgacagcctgcagctgaagaagagactgagatggtacagctgcatgctgggcaagaagtgcagcctggcccccctgaaggaggagctgagaatccagggcgtgcccaaggtgacctacaccgagttctgccagggcagaaccatgagatgggccctggcctggagcttctacgacgacgtgaccgtgcccagcccccccagcaagagaagaaagctggagaagcccagaaagcccatcaccttcgtggtgctggccagcgtgatgaaggagctgagcctgaaggccagccccctgagaagcgagaccgccgagggcatcgtggtggtgaccacctggatcgagaagatcctgaccgacctgaaggtgcagcacaagagagtgccctgcggcaaggaggaggtgagcctgttcctgaccgccatcgagaacagctggatccacctgagaagaaagaagagagagagagtgagacagctgagagaggtgcccagagcccccgaggacgtgatccaggccctggaggagaagaagcccacccccaaggagagcggcaacagccaggagctggccagaggcccccaggagagaaccccctgcggccccgccctgagagagggcgaggccgccgccgtggagggcccctgccccagccaggagagcctgagccaggaggagaaccccgagcccaccgaggacgagagaagcgaggagaagggcggcgtggaggtgctggagagctgccagggcagcagcaacggcgcccaggaccaggaggccagcgagcagttcggcagccccgtggccgagagaggcaagagactgcccggcgtggccggccagtacctgttcaagtgcctgatcaacgtgaagaaggaggtggacgacgccctggtggagatgcactgggtggagggccagaacagagacctgatgaaccagctgtgcacctacatcagaaaccagatcttcagactggtggccgtgaactag

SEQ ID NO: 22492 - DNA, 795 bp, Artificial Sequence
  Description of Artificial Sequence: Synthetic coding sequence
atggacgtgtgcctgagcagcgcccagcagcccggcagaagaggcgagggcctgagcagccccggcggctggctggaggccgagaagaagggcgccccccagaaggacagcaccggcggcgtgctggaggagagcaacaagatcgagcccagcctgcacagcctgcagaagttcgtgcccaccgactacgccagctacacccaggagcactacagattcgccggcaaggagatcgtgatccaggagagcatcgagagctacggcgccgtggtgtggcccggcgccatggccctgtgccagtacctggaggagcacgccgaggagctgaacttccaggacgccaagatcctggagatcggcgccggccccggcctggtgagcatcgtggccagcatcctgggcgcccaggtgaccgccaccgacctgcccgacgtgctgggcaacctgcagtacaacctgctgaagaacaccctgcagtgcaccgcccacctgcccgaggtgaaggagctggtgtggggcgaggacctggacaagaacttccccaagagcgccttctactacgactacgtgctggccagcgacgtggtgtaccaccactacttcctggacaagctgctgaccaccatggtgtacctgagccagcccggcaccgtgctgctgtgggccaacaagttcagattcagcaccgactacgagttcctggacaagttcaagcaggtgttcgacaccaccctgctggccgagtaccccgagagcagcgtgaagctgttcaagggcatcctgaagtgggactag

SEQ ID NO: 22493 - DNA, 489 bp, Artificial Sequence
  Description of Artificial Sequence: Synthetic coding sequence
atgtggggcagactgctggccgccttcccccccgtgcccaccccccagagcaccctgttctacagagccgacgtggtggtgaccgacctggaggagctgcaggacctgctgaagatgaacatcaacatgaacaagcacctggtgaccggcagcgtgcaggccaaggtgctgaagtggggcgaggagatcgagggcttccccagcccccccgacttcatcctgatggccgactgcatctactacgaggagagcctggagcccctgctgaagaccctgaaggacatcagcggcttcgagacctgcatcatctgctgctacgagcagagaaccatgggcaagaaccccgagatcgagaagaagtacttcgagctgctgcagctggacttcgacttcgagaagatccccctggagaagcacgacgaggagtacagaagcgaggacatccacatcatctacatcagaaagaagaagagcaagttccccagctag

SEQ ID NO: 22494 - DNA, 585 bp, Artificial Sequence
  Description of Artificial Sequence: Synthetic coding sequence
atggccgacaccctggagagcagcctggaggaccccctgagaagcttcgtgagagtgctggagaagagagacggcaccgtgctgagactgcagcagtacagcagcggcggcgtgggctgcgtggtgtgggacgccgccatcgtgctgagcaagtacctggagacccccgagttcagcggcgacggcgcccacgccctgagcagaagaagcgtgctggagctgggcagcggcaccggcgccgtgggcctgatggccgccaccctgggcgccgacgtggtggtgaccgacctggaggagctgcaggacctgctgaagatgaacatcaacatgaacaagcacctggtgaccggcagcgtgcaggccaaggtgctgaagtggggcgaggagatcgagggcttccccagcccccccgacttcatcctgatggccgactgcatctactacgaggagagcctggagcccctgctgaagaccctgaaggacatcagcggcttcgagacctgcatcatctgctgctacgagcagagaaccatgggcaagaaccccgagatcgagaagaagtacttcgagaagttccccagctag

SEQ ID NO: 22495 - DNA, 690 bp, Artificial Sequence
  Description of Artificial Sequence: Synthetic coding sequence
atggccgacaccctggagagcagcctggaggaccccctgagaagcttcgtgagagtgctggagaagagagacggcaccgtgctgagactgcagcagtacagcagcggcggcgtgggctgcgtggtgtgggacgccgccatcgtgctgagcaagtacctggagacccccgagttcagcggcgacggcgcccacgccctgagcagaagaagcgtgctggagctgggcagcggcaccggcgccgtgggcctgatggccgccaccctgggcgccgacgtggtggtgaccgacctggaggagctgcaggacctgctgaagatgaacatcaacatgaacaagcacctggtgaccggcagcgtgcaggccaaggtgctgaagtggggcgaggagatcgagggcttccccagcccccccgacttcatcctgatggccgactgcatctactacgaggagagcctggagcccctgctgaagaccctgaaggacatcagcggcttcgagacctgcatcatctgctgctacgagcagagaaccatgggcaagaaccccgagatcgagaagaagtacttcgagctgctgcagctggacttcgacttcgagaagatccccctggagaagcacgacgaggagtacagaagcgaggacatccacatcatctacatcagaaagaagaagagcaagttccccagctag

SEQ ID NO: 22496 - DNA, 618 bp, Artificial Sequence
  Description of Artificial Sequence: Synthetic coding sequence
atggtgcagctggcccccgccgccgccatggacgaggtgaccttcagaagcgacaccgtgctgagcgacgtgcacctgtacacccccaaccacagacacctgatggtgagactgaacagcgtgggccagcccgtgttcctgagccagttcaagctgctgtggagccaggacagctggaccgacagcggcgccaagggcggcagccacagagacgtgcacaccaaggagccccccagcgccgagaccggcagcaccggcagcccccccggcagcggccacggcaacgagggcttcagcctgcaggccggcaccgacaccaccggccaggaggtggccgaggcccagctggacgaggacggcgacctggacgtggtgagaagacccagagccgccagcgacagcaaccccgccggccccctgagagacaaggtgcaccccatgatcctggcccaggaggaggacgacgtgctgggcgaggaggcccagggcagcccccacgacatcatcagaatcggcgtggccggcagacccgcccccggcagactgcaccccgtgcccaccggccccctgcccagaatgtacagcgccggcgccagaggcagacacggcgccagatag

SEQ ID NO: 22497 - DNA, 1215 bp, Artificial Sequence
  Description of Artificial Sequence: Synthetic coding sequence
atggtgcagctggcccccgccgccgccatggacgaggtgaccttcagaagcgacaccgtgctgagcgacgtgcacctgtacacccccaaccacagacacctgatggtgagactgaacagcgtgggccagcccgtgttcctgagccagttcaagctgctgtggagccaggacagctggaccgacagcggcgccaagggcggcagccacagagacgtgcacaccaaggagccccccagcgccgagaccggcagcaccggcagcccccccggcagcggccacggcaacgagggcttcagcctgcaggccggcaccgacaccaccggccaggaggtggccgaggcccagctggacgaggacggcgacctggacgtggtgagaagacccagagccgccagcgacagcaaccccgccggccccctgagagacaaggtgcaccccatgatcctggcccaggaggaggacgacgtgctgggcgaggaggcccagggcagcccccacgacatcatcagaatcgagcacaccatggccacccccctggaggacgtgggcaagcaggtgtggagaggcgccctgctgctggccgactacatcctgttcagacaggacctgttcagaggctgcaccgccctggagctgggcgccggcaccggcctggccagcatcatcgccgccaccatggccagaaccgtgtactgcaccgacgtgggcgccgacctgctgagcatgtgccagagaaacatcgccctgaacagccacctggccgccaccggcggcggcatcgtgagagtgaaggagctggactggctgaaggacgacctgtgcaccgaccccaaggtgcccttcagctggagccaggaggagatcagcgacctgtacgaccacaccaccatcctgttcgccgccgaggtgttctacgacgacgacctgaccgacgccgtgttcaagaccctgagcagactggcccacagactgaagaacgcctgcaccgccatcctgagcgtggagaagagactgaacttcaccctgagacacctggacgtgacctgcgaggcctacgaccacttcagaagctgcctgcacgccctggagcagctggccgacggcaagctgagattcgtggtggagcccgtggaggccagcttcccccagctgctggtgtacgagagactgcagcagctggagctgtggaagatcatcgccgagcccgtgacctag

SEQ ID NO: 22498 - DNA, 1137 bp, Artificial Sequence
  Description of Artificial Sequence: Synthetic coding sequence
atggccggcagctaccccgagggcgcccccgccgtgctggccgacaagagacagcagttcggcagcagattcctgagagaccccgccagagtgttccaccacaacgcctgggacaacgtggagtggagcgaggagcaggccgccgccgccgagagaaaggtgcaggagaacagcatccagagagtgtgccaggagaagcaggtggactacgagatcaacgcccacaagtactggaacgacttctacaagatccacgagaacggcttcttcaaggacagacactggctgttcaccgagttccccgagctggcccccagccagaaccagaaccacctgaaggactggttcctggagaacaagagcgaggtgcccgagtgcagaaacaacgaggacggccccggcctgatcatggaggagcagcacaagtgcagcagcaagagcctggagcacaagacccagaccctgcccgtggaggagaacgtgacccagaagatcagcgacctggagatctgcgccgacgagttccccggcagcagcgccacctacagaatcctggaggtgggctgcggcgtgggcaacaccgtgttccccatcctgcagaccaacaacgaccccggcctgttcgtgtactgctgcgacttcagcagcaccgccatcgagctggtgcagaccaacagcgagtacgaccccagcagatgcttcgccttcgtgcacgacctgtgcgacgaggagaagagctaccccgtgcccaagggcagcctggacatcatcatcctgatcttcgtgctgagcgccatcgtgcccgacaagatgcagaaggccatcaacagactgagcagactgctgaagcccggcggcatgatgctgctgagagactacggcagatacgacatggcccagctgagattcaagaagggccagtgcctgagcggcaacttctacgtgagaggcgacggcaccagagtgtacttcttcacccaggaggagctggacaccctgttcaccaccgccggcctggagaaggtgcagaacctggtggacagaagactgcaggtgaacagaggcaagcagctgaccatgtacagagtgtggatccagtgcaagtactgcaagcccctgctgagcagcaccagctag

SEQ ID NO: 22499 - DNA, 654 bp, Artificial Sequence
  Description of Artificial Sequence: Synthetic coding sequence
atggccggcagctaccccgagggcgcccccgccgtgctggccgacaagagacagcagttcggcagcagattcctgagagaccccgccagagtgttccaccacaacgcctgggacaacgtggagtggagcgaggagcaggccgccgccgccgagagaaaggtgcaggagaacagcatccagagagtgtgccaggagaagcaggtggactacgagatcaacgcccacaagtactggaacgacttctacaagatccacgagaacggcttcttcaaggacagacactggctgttcaccgagttccccgagctggcccccagccagaaccagaaccacctgaaggactggttcctggagaacaagagcgaggtgcccgagtgcagaaacaacgaggacggccccggcctgatcatggaggagcagcacaagtgcagcagcaagagcctggagcacaagacccagaccctgcccgtggaggagaacgtgacccagaagatcagcgacctggagatctgcgccgacgagttccccggccagccccccaccgagtactggagactggccgtggtgtgggagacccagagcttccagttctacaagagaaccatgacccaggacagcctgttcatcgccgtgatcttcctgccccagctgtag

SEQ ID NO: 22500 - DNA, 1137 bp, Artificial Sequence
  Description of Artificial Sequence: Synthetic coding sequence
atggccggcagctaccccgagggcgcccccgccatcctggccgacaagagacagcagttcggcagcagattcctgagcgaccccgccagagtgttccaccacaacgcctgggacaacgtggagtggagcgaggagcaggccgccgccgccgagagaaaggtgcaggagaacagcatccagagagtgtgccaggagaagcaggtggactacgagatcaacgcccacaagtactggaacgacttctacaagatccacgagaacggcttcttcaaggacagacactggctgttcaccgagttccccgagctggcccccagccagaaccagaaccacctgaaggactggttcctggagaacaagagcgaggtgtgcgagtgcagaaacaacgaggacggccccggcctgatcatggaggagcagcacaagtgcagcagcaagagcctggagcacaagacccagaccccccccgtggaggagaacgtgacccagaagatcagcgacctggagatctgcgccgacgagttccccggcagcagcgccacctacagaatcctggaggtgggctgcggcgtgggcaacaccgtgttccccatcctgcagaccaacaacgaccccggcctgttcgtgtactgctgcgacttcagcagcaccgccatcgagctggtgcagaccaacagcgagtacgaccccagcagatgcttcgccttcgtgcacgacctgtgcgacgaggagaagagctaccccgtgcccaagggcagcctggacatcatcatcctgatcttcgtgctgagcgccgtggtgcccgacaagatgcagaaggccatcaacagactgagcagactgctgaagcccggcggcatggtgctgctgagagactacggcagatacgacatggcccagctgagattcaagaagggccagtgcctgagcggcaacttctacgtgagaggcgacggcaccagagtgtacttcttcacccaggaggagctggacaccctgttcaccaccgccggcctggagaaggtgcagaacctggtggacagaagactgcaggtgaacagaggcaagcagctgaccatgtacagagtgtggatccagtgcaagtactgcaagcccctgctgagcagcaccagctag

SEQ ID NO: 22501 - DNA, 1419 bp, Artificial Sequence
  Description of Artificial Sequence: Synthetic coding sequence
atgagcgtggtgcaccagctgagcgccggctggctgctggaccacctgagcttcatcaacaagatcaactaccagctgcaccagcaccacgagccctgctgcagaaagaaggagttcaccaccagcgtgcacttcgagagcctgcagatggacagcgtgagcagcagcggcgtgtgcgccgccttcatcgccagcgacagcagcaccaagcccgagaacgacgacggcggcaactacgagatgttcaccagaaagttcgtgttcagacccgagctgttcgacgtgaccaagccctacatcacccccgccgtgcacaaggagtgccagcagagcaacgagaaggaggacctgatgaacggcgtgaagaaggagatcagcatcagcatcatcggcaagaagagaaagagatgcgtggtgttcaaccagggcgagctggacgccatggagtaccacaccaagatcagagagctgatcctggacggcagcctgcagctgatccaggagggcctgaagagcggcttcctgtaccccctgttcgagaagcaggacaagggcagcaagcccatcaccctgcccctggacgcctgcagcctgagcgagctgtgcgagatggccaagcacctgcccagcctgaacgagatggagcaccagaccctgcagctggtggaggaggacaccagcgtgaccgagcaggacctgttcctgagagtggtggagaacaacagcagcttcaccaaggtgatcaccctgatgggccagaagtacctgctgccccccaagagcagcttcctgctgagcgacatcagctgcatgcagcccctgctgaactacagaaagaccttcgacgtgatcgtgatcgaccccccctggcagaacaagagcgtgaagagaagcaacagatacagctacctgagccccctgcagatccagcagatccccatccccaagctggccgcccccaactgcctgctggtgacctgggtgaccaacagacagaagcacctgagattcatcaaggaggagctgtaccccagctggagcgtggaggtggtggccgagtggcactgggtgaagatcaccaacagcggcgagttcgtgttccccctggacagcccccacaagaagccctacgagggcctgatcctgggcagagtgcaggagaagaccgccctgcccctgagaaacgccgacgtgaacgtgctgcccatccccgaccacaagctgatcgtgagcgtgccctgcaccctgcacagccacaagccccccctggccgaggtgctgaaggactacatcaagcccgacggcgagtacctggagctgttcgccagaaacctgcagcccggctggaccagctggggcaacgaggtgctgaagttccagcacgtggactacttcatcgccgtggagagcggcagctag

SEQ ID NO: 22502 - DNA, 1419 bp, Artificial Sequence; identical to SEQ ID NO: 22501
  Description of Artificial Sequence: Synthetic coding sequence

SEQ ID NO: 22503 - DNA, 855 bp, Artificial Sequence
  Description of Artificial Sequence: Synthetic coding sequence
atggccagcctgcagagaaagggcctgcaggccagaatcctgaccagcgaggaggaggagaagctgaagagagaccagaccctggtgagcgacttcaagcagcagaagctggagcaggaggcccagaagaactgggacctgttctacaagagaaacagcaccaacttcttcaaggacagacactggaccaccagagagttcgaggagctgagaagctgcagagagttcgaggaccagaagctgaccatgctggaggccggctgcggcgtgggcaactgcctgttccccctgctggaggaggaccccaacatcttcgcctacgcctgcgacttcagccccagagccatcgagtacgtgaagcagaaccccctgtacgacaccgagagatgcaaggtgttccagtgcgacctgaccaaggacgacctgctggaccacgtgccccccgagagcgtggacgtggtgatgctgatcttcgtgctgagcgccgtgcaccccgacaagatgcacctggtgctgcagaacatctacaaggtgctgaagcccggcaagagcgtgctgttcagagactacggcctgtacgaccacgccatgctgagattcaaggccagcagcaagctgggcgagaacttctacgtgagacaggacggcaccagaagctacttcttcaccgacgacttcctggcccagctgttcatggacaccggctacgaggaggtggtgaacgagtacgtgttcagagagaccgtgaacaagaaggagggcctgtgcgtgcccagagtgttcctgcagagcaagttcctgaagccccccaagaaccccagccccgtggtgctgggcctggaccccaagagctag

SEQ ID NO: 22504 - DNA, 855 bp, Artificial Sequence; identical to SEQ ID NO: 22503
  Description of Artificial Sequence: Synthetic coding sequence

SEQ ID NO: 22505 - DNA, 735 bp, Artificial Sequence
  Description of Artificial Sequence: Synthetic coding sequence
atggacatcctggtgcccctgctgcagctgctggtgctgctgctgaccctgcccctgcacctgatggccctgctgggctgctggcagcccctgtgcaagagctacttcccctacctgatggccgtgctgacccccaagagcaacagaaagatggagagcaagaagagagagctgttcagccagatcaagggcctgaccggcgccagcggcaaggtggccctgctggagctgggctgcggcaccggcgccaacttccagttctacccccccggctgcagagtgacctgcctggaccccaacccccacttcgagaagttcctgaccaagagcatggccgagaacagacacctgcagtacgagagattcgtggtggcccccggcgaggacatgagacagctggccgacggcagcatggacgtggtggtgtgcaccctggtgctgtgcagcgtgcagagccccagaaaggtgctgcaggaggtgagaagagtgctgagacccggcggcgtgctgttcttctgggagcacgtggccgagccctacggcagctgggccttcatgtggcagcaggtgttcgagcccacctggaagcacatcggcgacggctgctgcctgaccagagagacctggaaggacctggagaacgcccagttcagcgagatccagatggagagacagcccccccccctgaagtggctgcccgtgggcccccacatcatgggcaaggccgtgaagtag

SEQ ID NO: 22506 - DNA, 957 bp, Artificial Sequence
  Description of Artificial Sequence: Synthetic coding sequence
atgagactgctggccggctggctgtgcctgagcctggccagcgtgtggctggccagaagaatgtggaccctgagaagccccctgaccagaagcctgtacgtgaacatgaccagcggccccggcggccccgccgccgccgccggcggcagaaaggagaaccaccagtggtacgtgtgcaacagagagaagctgtgcgagagcctgcaggccgtgttcgtgcagagctacctggaccagggcacccagatcttcctgaacaacagcatcgagaagagcggctggctgttcatccagctgtaccacagcttcgtgagcagcgtgttcagcctgttcatgagcagaaccagcatcaacggcctgctgggcagaggcagcatgttcgtgttcagccccgaccagttccagagactgctgaagatcaaccccgactggaagacccacagactgctggacctgggcgccggcgacggcgaggtgaccaagatcatgagcccccacttcgaggagatctacgccaccgagctgagcgagaccatgatctggcagctgcagaagaagaagtacagagtgctgggcatcaacgagtggcagaacaccggcttccagtacgacgtgatcagctgcctgaacctgctggacagatgcgaccagcccctgaccctgctgaaggacatcagaagcgtgctggagcccaccagaggcagagtgatcctggccctggtgctgcccttccacccctacgtggagaacgtgggcggcaagtgggagaagcccagcgagatcctggagatcaagggccagaactgggaggagcaggtgaacagcctgcccgaggtgttcagaaaggccggcttcgtgatcgaggccttcaccagactgccctacctgtgcgagggcgacatgtacaacgactactacgtgctggacgacgccgtgttcgtgctgaagcccgtgtag

SEQ ID NO: 22507 - DNA, 954 bp, Artificial Sequence
  Description of Artificial Sequence: Synthetic coding sequence
atgagactgctggccggctggctgtgcctgagcctggccagcgtgtggctggccagaagaatgtggaccctgagaagccccctgaccagaagcctgtacgtgaacatgaccagcggccccggcggccccgccgccgccgccggcggcagaaaggagaaccaccagtggtacgtgtgcaacagagagaagctgtgcgagagcctgcaggccgtgttcgtgcagagctacctggaccagggcacccagatcttcctgaacaacagcatcgagaagagcggctggctgttcatccagctgtaccacagcttcgtgagcagcgtgttcagcctgttcatgagcagaaccagcatcaacggcctgctgggcagaggcagcatgttcgtgttcagccccgaccagttccagagactgctgaagatcaaccccgactggaagacccacagactgctggacctgggcgccggcgacggcgaggtgaccaagatcatgagcccccacttcgaggagatctacgccaccgagctgagcgagaccatgatctggcagctgcagaagaagaagtacagagtgctgggcatcaacgagtggcagaacaccggcttccagtacgacgtgatcagctgcctgaacctgctggacagatgcgaccagcccctgaccctgctgaaggacatcagaagcgtgctggagcccaccagaggcagagtgatcctggccctggtgctgcccttccacccctacgtggagaacggcggcaagtgggagaagcccagcgagatcctggagatcaagggccagaactgggaggagcaggtgaacagcctgcccgaggtgttcagaaaggccggcttcgtgatcgaggccttcaccagactgccctacctgtgcgagggcgacatgtacaacgactactacgtgctggacgacgccgtgttcgtgctgaagcccgtgtag

SEQ ID NO: 22508 - DNA, 849 bp, Artificial Sequence
  Description of Artificial Sequence: Synthetic coding sequence
atgtggaccctgagaagccccctgaccagaagcctgtacgtgaaggagaaccaccagtggtacgtgtgcaacagagagaagctgtgcgagagcctgcaggccgtgttcgtgcagagctacctggaccagggcacccagatcttcctgaacaacagcatcgagaagagcggctggctgttcatccagctgtaccacagcttcgtgagcagcgtgttcagcctgttcatgagcagaaccagcatcaacggcctgctgggcagaggcagcatgttcgtgttcagccccgaccagttccagagactgctgaagatcaaccccgactggaagacccacagactgctggacctgggcgccggcgacggcgaggtgaccaagatcatgagcccccacttcgaggagatctacgccaccgagctgagcgagaccatgatctggcagctgcagaagaagaagtacagagtgctgggcatcaacgagtggcagaacaccggcttccagtacgacgtgatcagctgcctgaacctgctggacagatgcgaccagcccctgaccctgctgaaggacatcagaagcgtgctggagcccaccagaggcagagtgatcctggccctggtgctgcccttccacccctacgtggagaacgtgggcggcaagtgggagaagcccagcgagatcctggagatcaagggccagaactgggaggagcaggtgaacagcctgcccgaggtgttcagaaaggccggcttcgtgatcgaggccttcaccagactgccctacctgtgcgagggcgacatgtacaacgactactacgtgctggacgacgccgtgttcgtgctgaagcccgtgtag

SEQ ID NO: 22509 - DNA, 165 bp, Artificial Sequence
  Description of Artificial Sequence: Synthetic coding sequence
atgatgaagccccaggccgagaccggcgaggccgccagagaccccagcctgagacccgccagaaccgtgctggtgggcagcctgagctggctgagaaagcagctgcagcccacccactgcaagtacgagggccccagaaaggccagaagactgtggttcgcctag

SEQ ID NO: 22510 - DNA, 231 bp, Artificial Sequence
  Description of Artificial Sequence: Synthetic coding sequence
atgatcgccggcgagcacagactggaccccgccaccatcagcctgggcgtggaccagaccgacgaccaccagcagcccacccacagcagaatcagaaagaagagagtgagccccaccagcgtgtggttccagccctacttctgcatcctgaagaccctgtgcaccaccctggacaccgtgcaggacgacgccaccagcagctggatgctgatctgccacgtggacttctag

SEQ ID NO: 22511 - DNA, 7290 bp, Artificial Sequence
  Description of Artificial Sequence: Synthetic coding sequence
atggacatgagcgaccccaacttctggaccgtgctgagcaacttcaccctgccccacctgagaagcggcaacagactgagaagaacccagagctgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagccccgcctgctgcgaccacgagatcatcatgatgaaccacgtgtacaaggagagattccccaaggccaccgcccagatggaggagagactgaaggagatcatcaccagctacagccccgacaacgtgctgcccctggccgacggcgtgctgagcttcacccaccaccagatcatcgagctggccagagactgcctggacaagagccaccagggcctgatcaccagcagatacttcctggagctgcagcacaagctggacaagctgctgcaggaggcccacgacagaagcgagagcggcgagctggccttcatcaagcagctggtgagaaagatcctgatcgtgatcgccagacccgccagactgctggagtgcctggagttcgaccccgaggagttctactacctgctggaggccgccgagggccacgccaaggagggccagggcatcaagaccgacatccccagatacatcatcagccagctgggcctgaacaaggaccccctggaggagatggcccacctgggcaactacgacagcggcaccgccgagacccccgagaccgacgagagcgtgagcagcagcaacgccagcctgaagctgagaagaaagcccagagagagcgacttcgagaccatcaagctgatcagcaacggcgcctacggcgccgtgtacttcgtgagacacaaggagagcagacagagattcgccatgaagaagatcaacaagcagaacctgatcctgagaaaccagatccagcaggccttcgtggagagagacatcctgaccttcgccgagaaccccttcgtggtgagcatgtactgcagcttcgagaccagaagacacctgtgcatggtgatggagtacgtggagggcggcgactgcgccaccctgatgaagaacatgggccccctgcccgtggacatggccagaatgtacttcgccgagaccgtgctggccctggagtacctgcacaactacggcatcgtgcacagagacctgaagcccgacaacctgctggtgaccagcatgggccacatcaagctgaccgacttcggcctgagcaaggtgggcctgatgagcatgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcaactggcccgagaaggacgaggcccccccccccgacgcccaggacctgatcaccctgctgctgagacagaaccccctggagagactgggcaccggcggcgcctacgaggtgaagcagcacagattcttcagaagcctggactggaacagcctgctgagacagaaggccgagttcatcccccagctggagagcgaggacgacaccagctacttcgacaccagaagcgagaagtaccaccacatggagaccgaggaggaggacgacaccaacgacgaggacttcaacgtggagatcagacagttcagcagctgcagccacagattcagcaaggtgttcagcagcatcgacagaatcacccagaacagcgccgaggagaaggaggacagcgtggacaagaccaagagcaccaccctgcccagcaccgagaccctgagctggagcagcgagtacagcgagatgcagcagctgagcaccagcaacagcagcgacaccgagagcaacagacacaagctgagcagcggcctgctgcccaagctggccatcagcaccgagggcgagcaggacgaggccgccagctgccccggcgacccccacgaggagcccggcaagcccgccctgccccccgaggagtgcgcccaggaggagcccgaggtgaccacccccgccagcaccatcagcagcagcaccctgagcgtgggcagcttcagcgagcacctggaccagatcaacggcagaagcgagtgcgtggacagcaccgacaacagcagcaagcccagcagcgagcccgccagccacatggccagacagagactggagagcaccgagaagaagaagatcagcggcaaggtgaccaagagcctgagcgccagcgccctgagcctgatgatccccggcgacatgttcgccgtgagccccctgggcagccccatgagcccccacagcctgagcagcgaccccagcagcagcagagacagcagccccagcagagacagcagcgccgccagcgccagcccccaccagcccatcgtgatccacagcagcggcaagaactacggcttcaccatcagagccatcagagtgtacgtgggcgacagcgacatctacaccgtgcaccacatcgtgtggaacgtggaggagggcagccccgcctgccaggccggcctgaaggccggcgacctgatcacccacatcaacggcgagcccgtgcacggcctggtgcacaccgaggtgatcgagctgctgctgaagagcggcaacaaggtgagcatcaccaccacccccttcgagaacaccagcatcaagaccggccccgccagaagaaacagctacaagagcagaatggtgagaagaagcaagaagagcaagaagaaggagagcctggagagaagaagaagcctgttcaagaagctggccaagcagcccagccccctgctgcacaccagcagaagcttcagctgcctgaacagaagcctgagcagcggcgagagcctgcccggcagccccacccacagcctgagccccagaagccccacccccagctacagaagcacccccgacttccccagcggcaccaacagcagccagagcagcagccccagcagcagcgcccccaacagccccgccggcagcggccacatcagacccagcaccctgcacggcctggcccccaagctgggcggccagagatacagaagcggcagaagaaagagcgccggcaacatccccctgagccccctggccagaacccccagccccaccccccagcccaccagcccccagagaagccccagccccctgctgggccacagcctgggcaacagcaagatcgcccaggccttccccagcaagatgcacagcccccccaccatcgtgagacacatcgtgagacccaagagcgccgagccccccagaagccccctgctgaagagagtgcagagcgaggagaagctgagccccagctacggcagcgacaagaagcacctgtgcagcagaaagcacagcctggaggtgacccaggaggaggtgcagagagagcagagccagagagaggcccccctgcagagcctggacgagaacgtgtgcgacgtgccccccctgagcagagccagacccgtggagcagggctgcctgaagagacccgtgagcagaaaggtgggcagacaggagagcgtggacgacctggacagagacaagctgaaggccaaggtggtggtgaagaaggccgacggcttccccgagaagcaggagagccaccagaagagccacggccccggcagcgacctggagaacttcgccctgttcaagctggaggagagagagaagaaggtgtaccccaaggccgtggagagaagcagcaccttcgagaacaaggccagcatgcaggaggccccccccctgggcagcctgctgaaggacgccctgcacaagcaggccagcgtgagagccagcgagggcgccatgagcgacggcagagtgcccgccgagcacagacagggcggcggcgacttcagaagagcccccgcccccggcaccctgcaggacggcctgtgccacagcctggacagaggcatcagcggcaagggcgagggcaccgagaagagcagccaggccaaggagctgctgagatgcgagaagctggacagcaagctggccaacatcgactacctgagaaagaagatgagcctggaggacaaggaggacaacctgtgccccgtgctgaagcccaagatgaccgccggcagccacgagtgcctgcccggcaaccccgtgagacccaccggcggccagcaggagcccccccccgccagcgagagcagagccttcgtgagcagcacccacgccgcccagatgagcgccgtgagcttcgtgcccctgaaggccctgaccggcagagtggacagcggcaccgagaagcccggcctggtggcccccgagagccccgtgagaaagagccccagcgagtacaagctggagggcagaagcgtgagctgcctgaagcccatcgagggcaccctggacatcgccctgctgagcggcccccaggccagcaagaccgagctgcccagccccgagagcgcccagagccccagccccagcggcgacgtgagagccagcgtgccccccgtgctgcccagcagcagcggcaagaagaacgacaccaccagcgccagagagctgagccccagcagcctgaagatgaacaagagctacctgctggagccctggttcctgccccccagcagaggcctgcagaacagccccgccgtgagcctgcccgaccccgagttcaagagagacagaaagggcccccaccccaccgccagaagccccggcaccgtgatggagagcaacccccagcagagagagggcagcagccccaagcaccaggaccacaccaccgaccccaagctgctgacctgcctgggccagaacctgcacagccccgacctggccagacccagatgccccctgccccccgaggccagccccagcagagagaagcccggcctgagagagagcagcgagagaggcccccccaccgccagaagcgagagaagcgccgccagagccgacacctgcagagagcccagcatggagctgtgcttccccgagaccgccaagaccagcgacaacagcaagaacctgctgagcgtgggcagaacccaccccgacttctacacccagacccaggccatggagaaggcctgggcccccggcggcaagaccaaccacaaggacggccccggcgaggccagacccccccccagagacaacagcagcctgcacagcgccggcatcccctgcgagaaggagctgggcaaggtgagaagaggcgtggagcccaagcccgaggccctgctggccagaagaagcctgcagccccccggcatcgagagcgagaagagcgagaagctgagcagcttccccagcctgcagaaggacggcgccaaggagcccgagagaaaggagcagcccctgcagagacaccccagcagcatcccccccccccccctgaccgccaaggacctgagcagccccgccgccagacagcactgcagcagccccagccacgccagcggcagagagcccggcgccaagcccagcaccgccgagcccagcagcagcccccaggacccccccaagcccgtggccgcccacagcgagagcagcagccacaagcccagacccggccccgaccccggcccccccaagaccaagcaccccgacagaagcctgagcagccagaagcccagcgtgggcgccaccaagggcaaggagcccgccacccagagcctgggcggcagcagcagagagggcaagggccacagcaagagcggccccgacgtgttccccgccacccccggcagccagaacaaggccagcgacggcatcggccagggcgagggcggccccagcgtgcccctgcacaccgacagagcccccctggacgccaagccccagcccaccagcggcggcagacccctggaggtgctggagaagcccgtgcacctgcccagacccggccaccccggccccagcgagcccgccgaccagaagctgagcgccgtgggcgagaagcagaccctgagccccaagcaccccaagcccagcaccgtgaaggactgccccaccctgtgcaagcagaccgacaacagacagaccgacaagagccccagccagcccgccgccaacaccgacagaagagccgagggcaagaagtgcaccgaggccctgtacgcccccgccgagggcgacaagctggaggccggcctgagcttcgtgcacagcgagaacagactgaagggcgccgagagacccgccgccggcgtgggcaagggcttccccgaggccagaggcaagggccccggcccccagaagccccccaccgaggccgacaagcccaacggcatgaagagaagccccagcgccaccggccagagcagcttcagaagcaccgccctgcccgagaagagcctgagctgcagcagcagcttccccgagaccagagccggcgtgagagaggccagcgccgccagcagcgacaccagcagcgccaaggccgccggcggcatgctggagctgcccgcccccagcaacagagaccacagaaaggcccagcccgccggcgagggcagaacccacatgaccaagagcgacagcctgcccagcttcagagtgagcaccctgcccctggagagccaccaccccgaccccaacaccatgggcggcgccagccacagagacagagccctgagcgtgaccgccaccgtgggcgagaccaagggcaaggaccccgcccccgcccagcccccccccgccagaaagcagaacgtgggcagagacgtgaccaagcccagccccgcccccaacaccgacagacccatcagcctgagcaacgagaaggacttcgtggtgagacagagaagaggcaaggagagcctgagaagcagcccccacaagaaggccctgtag

SEQ ID NO: 22512 - DNA, 7335 bp, Artificial Sequence
  Description of Artificial Sequence: Synthetic coding sequence
atgaaggcccagagagagagactgcagatccccggcctgaccctggacctgacccccagaagcctgagccccacccccagcagccccggcagcccctgcagccccctgctggccttccacttctggagctgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagcctgaacagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagccccgcctgctgcgaccacgagatcatcatgatgaaccacgtgtacaaggagagattccccaaggccaccgcccagatggaggagagactgaaggagatcatcaccagctacagccccgacaacgtgctgcccctggccgacggcgtgctgagcttcacccaccaccagatcatcgagctggccagagactgcctggacaagagccaccagggcctgatcaccagcagatacttcctggagctgcagcacaagctggacaagctgctgcaggaggcccacgacagaagcgagagcggcgagctggccttcatcaagcagctggtgagaaagatcctgatcgtgatcgccagacccgccagactgctggagtgcctggagttcgaccccgaggagttctactacctgctggaggccgccgagggccacgccaaggagggccagggcatcaagaccgacatccccagatacatcatcagccagctgggcctgaacaaggaccccctggaggagatggcccacctgggcaactacgacagcggcaccgccgagacccccgagaccgacgagagcgtgagcagcagcaacgccagcctgaagctgagaagaaagcccagagagagcgacttcgagaccatcaagctgatcagcaacggcgcctacggcgccgtgtacttcgtgagacacaaggagagcagacagagattcgccatgaagaagatcaacaagcagaacctgatcctgagaaaccagatccagcaggccttcgtggagagagacatcctgaccttcgccgagaaccccttcgtggtgagcatgtactgcagcttcgagaccagaagacacctgtgcatggtgatggagtacgtggagggcggcgactgcgccaccctgatgaagaacatgggccccctgcccgtggacatggccagaatgtacttcgccgagaccgtgctggccctggagtacctgcacaactacggcatcgtgcacagagacctgaagcccgacaacctgctggtgaccagcatgggccacatcaagctgaccgacttcggcctgagcaaggtgggcctgatgagcatgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcaactggcccgagaaggacgaggcccccccccccgacgcccaggacctgatcaccctgctgctgagacagaaccccctggagagactgggcaccggcggcgcctacgaggtgaagcagcacagattcttcagaagcctggactggaacagcctgctgagacagaaggccgagttcatcccccagctggagagcgaggacgacaccagctacttcgacaccagaagcgagaagtaccaccacatggagaccgaggaggaggacgacaccaacgacgaggacttcaacgtggagatcagacagttcagcagctgcagccacagattcagcaaggtgttcagcagcatcgacagaatcacccagaacagcgccgaggagaaggaggacagcgtggacaagaccaagagcaccaccctgcccagcaccgagaccctgagctggagcagcgagtacagcgagatgcagcagctgagcaccagcaacagcagcgacaccgagagcaacagacacaagctgagcagcggcctgctgcccaagctggccatcagcaccgagggcgagcaggacgaggccgccagctgccccggcgacccccacgaggagcccggcaagcccgccctgccccccgaggagtgcgcccaggaggagcccgaggtgaccacccccgccagcaccatcagcagcagcaccctgagcgtgggcagcttcagcgagcacctggaccagatcaacggcagaagcgagtgcgtggacagcaccgacaacagcagcaagcccagcagcgagcccgccagccacatggccagacagagactggagagcaccgagaagaagaagatcagcggcaaggtgaccaagagcctgagcgccagcgccctgagcctgatgatccccggcgacatgttcgccgtgagccccctgggcagccccatgagcccccacagcctgagcagcgaccccagcagcagcagagacagcagccccagcagagacagcagcgccgccagcgccagcccccaccagcccatcgtgatccacagcagcggcaagaactacggcttcaccatcagagccatcagagtgtacgtgggcgacagcgacatctacaccgtgcaccacatcgtgtggaacgtggaggagggcagccccgcctgccaggccggcctgaaggccggcgacctgatcacccacatcaacggcgagcccgtgcacggcctggtgcacaccgaggtgatcgagctgctgctgaagagcggcaacaaggtgagcatcaccaccacccccttcgagaacaccagcatcaagaccggccccgccagaagaaacagctacaagagcagaatggtgagaagaagcaagaagagcaagaagaaggagagcctggagagaagaagaagcctgttcaagaagctggccaagcagcccagccccctgctgcacaccagcagaagcttcagctgcctgaacagaagcctgagcagcggcgagagcctgcccggcagccccacccacagcctgagccccagaagccccacccccagctacagaagcacccccgacttccccagcggcaccaacagcagccagagcagcagccccagcagcagcgcccccaacagccccgccggcagcggccacatcagacccagcaccctgcacggcctggcccccaagctgggcggccagagatacagaagcggcagaagaaagagcgccggcaacatccccctgagccccctggccagaacccccagccccaccccccagcccaccagcccccagagaagccccagccccctgctgggccacagcctgggcaacagcaagatcgcccaggccttccccagcaagatgcacagcccccccaccatcgtgagacacatcgtgagacccaagagcgccgagccccccagaagccccctgctgaagagagtgcagagcgaggagaagctgagccccagctacggcagcgacaagaagcacctgtgcagcagaaagcacagcctggaggtgacccaggaggaggtgcagagagagcagagccagagagaggcccccctgcagagcctggacgagaacgtgtgcgacgtgccccccctgagcagagccagacccgtggagcagggctgcctgaagagacccgtgagcagaaaggtgggcagacaggagagcgtggacgacctggacagagacaagctgaaggccaaggtggtggtgaagaaggccgacggcttccccgagaagcaggagagccaccagaagagccacggccccggcagcgacctggagaacttcgccctgttcaagctggaggagagagagaagaaggtgtaccccaaggccgtggagagaagcagcaccttcgagaacaaggccagcatgcaggaggccccccccctgggcagcctgctgaaggacgccctgcacaagcaggccagcgtgagagccagcgagggcgccatgagcgacggcagagtgcccgccgagcacagacagggcggcggcgacttcagaagagcccccgcccccggcaccctgcaggacggcctgtgccacagcctggacagaggcatcagcggcaagggcgagggcaccgagaagagcagccaggccaaggagctgctgagatgcgagaagctggacagcaagctggccaacatcgactacctgagaaagaagatgagcctggaggacaaggaggacaacctgtgccccgtgctgaagcccaagatgaccgccggcagccacgagtgcctgcccggcaaccccgtgagacccaccggcggccagcaggagcccccccccgccagcgagagcagagccttcgtgagcagcacccacgccgcccagatgagcgccgtgagcttcgtgcccctgaaggccctgaccggcagagtggacagcggcaccgagaagcccggcctggtggcccccgagagccccgtgagaaagagccccagcgagtacaagctggagggcagaagcgtgagctgcctgaagcccatcgagggcaccctggacatcgccctgctgagcggcccccaggccagcaagaccgagctgcccagccccgagagcgcccagagccccagccccagcggcgacgtgagagccagcgtgccccccgtgctgcccagcagcagcggcaagaagaacgacaccaccagcgccagagagctgagccccagcagcctgaagatgaacaagagctacctgctggagccctggttcctgccccccagcagaggcctgcagaacagccccgccgtgagcctgcccgaccccgagttcaagagagacagaaagggcccccaccccaccgccagaagccccggcaccgtgatggagagcaacccccagcagagagagggcagcagccccaagcaccaggaccacaccaccgaccccaagctgctgacctgcctgggccagaacctgcacagccccgacctggccagacccagatgccccctgccccccgaggccagccccagcagagagaagcccggcctgagagagagcagcgagagaggcccccccaccgccagaagcgagagaagcgccgccagagccgacacctgcagagagcccagcatggagctgtgcttccccgagaccgccaagaccagcgacaacagcaagaacctgctgagcgtgggcagaacccaccccgacttctacacccagacccaggccatggagaaggcctgggcccccggcggcaagaccaaccacaaggacggccccggcgaggccagacccccccccagagacaacagcagcctgcacagcgccggcatcccctgcgagaaggagctgggcaaggtgagaagaggcgtggagcccaagcccgaggccctgctggccagaagaagcctgcagccccccggcatcgagagcgagaagagcgagaagctgagcagcttccccagcctgcagaaggacggcgccaaggagcccgagagaaaggagcagcccctgcagagacaccccagcagcatcccccccccccccctgaccgccaaggacctgagcagccccgccgccagacagcactgcagcagccccagccacgccagcggcagagagcccggcgccaagcccagcaccgccgagcccagcagcagcccccaggacccccccaagcccgtggccgcccacagcgagagcagcagccacaagcccagacccggccccgaccccggcccccccaagaccaagcaccccgacagaagcctgagcagccagaagcccagcgtgggcgccaccaagggcaaggagcccgccacccagagcctgggcggcagcagcagagagggcaagggccacagcaagagcggccccgacgtgttccccgccacccccggcagccagaacaaggccagcgacggcatcggccagggcgagggcggccccagcgtgcccctgcacaccgacagagcccccctggacgccaagccccagcccaccagcggcggcagacccctggaggtgctggagaagcccgtgcacctgcccagacccggccaccccggccccagcgagcccgccgaccagaagctgagcgccgtgggcgagaagcagaccctgagccccaagcaccccaagcccagcaccgtgaaggactgccccaccctgtgcaagcagaccgacaacagacagaccgacaagagccccagccagcccgccgccaacaccgacagaagagccgagggcaagaagtgcaccgaggccctgtacgcccccgccgagggcgacaagctggaggccggcctgagcttcgtgcacagcgagaacagactgaagggcgccgagagacccgccgccggcgtgggcaagggcttccccgaggccagaggcaagggccccggcccccagaagccccccaccgaggccgacaagcccaacggcatgaagagaagccccagcgccaccggccagagcagcttcagaagcaccgccctgcccgagaagagcctgagctgcagcagcagcttccccgagaccagagccggcgtgagagaggccagcgccgccagcagcgacaccagcagcgccaaggccgccggcggcatgctggagctgcccgcccccagcaacagagaccacagaaaggcccagcccgccggcgagggcagaacccacatgaccaagagcgacagcctgcccagcttcagagtgagcaccctgcccctggagagccaccaccccgaccccaacaccatgggcggcgccagccacagagacagagccctgagcgtgaccgccaccgtgggcgagaccaagggcaaggaccccgcccccgcccagcccccccccgccagaaagcagaacgtgggcagagacgtgaccaagcccagccccgcccccaacaccgacagacccatcagcctgagcaacgagaaggacttcgtggtgagacagagaagaggcaaggagagcctgagaagcagcccccacaagaaggccctgtag

SEQ ID NO: 22513 - DNA, 7305 bp, Artificial Sequence
  Description of Artificial Sequence: Synthetic coding sequence
atggacgagagcagcatcctgagaagaagaggcctgcagaaggagctgagcctgcccagaagaggcagcctgatcgacagccagaagtggaactgcctggtgaagagatgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagccccgcctgctgcgaccacgagatcatcatgatgaaccacgtgtacaaggagagattccccaaggccaccgcccagatggaggagagactgaaggagatcatcaccagctacagccccgacaacgtgctgcccctggccgacggcgtgctgagcttcacccaccaccagatcatcgagctggccagagactgcctggacaagagccaccagggcctgatcaccagcagatacttcctggagctgcagcacaagctggacaagctgctgcaggaggcccacgacagaagcgagagcggcgagctggccttcatcaagcagctggtgagaaagatcctgatcgtgatcgccagacccgccagactgctggagtgcctggagttcgaccccgaggagttctactacctgctggaggccgccgagggccacgccaaggagggccagggcatcaagaccgacatccccagatacatcatcagccagctgggcctgaacaaggaccccctggaggagatggcccacctgggcaactacgacagcggcaccgccgagacccccgagaccgacgagagcgtgagcagcagcaacgccagcctgaagctgagaagaaagcccagagagagcgacttcgagaccatcaagctgatcagcaacggcgcctacggcgccgtgtacttcgtgagacacaaggagagcagacagagattcgccatgaagaagatcaacaagcagaacctgatcctgagaaaccagatccagcaggccttcgtggagagagacatcctgaccttcgccgagaaccccttcgtggtgagcatgtactgcagcttcgagaccagaagacacctgtgcatggtgatggagtacgtggagggcggcgactgcgccaccctgatgaagaacatgggccccctgcccgtggacatggccagaatgtacttcgccgagaccgtgctggccctggagtacctgcacaactacggcatcgtgcacagagacctgaagcccgacaacctgctggtgaccagcatgggccacatcaagctgaccgacttcggcctgagcaaggtgggcctgatgagcatgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcaactggcccgagaaggacgaggcccccccccccgacgcccaggacctgatcaccctgctgctgagacagaaccccctggagagactgggcaccggcggcgcctacgaggtgaagcagcacagattcttcagaagcctggactggaacagcctgctgagacagaaggccgagttcatcccccagctggagagcgaggacgacaccagctacttcgacaccagaagcgagaagtaccaccacatggagaccgaggaggaggacgacaccaacgacgaggacttcaacgtggagatcagacagttcagcagctgcagccacagattcagcaaggtgttcagcagcatcgacagaatcacccagaacagcgccgaggagaaggaggacagcgtggacaagaccaagagcaccaccctgcccagcaccgagaccctgagctggagcagcgagtacagcgagatgcagcagctgagcaccagcaacagcagcgacaccgagagcaacagacacaagctgagcagcggcctgctgcccaagctggccatcagcaccgagggcgagcaggacgaggccgccagctgccccggcgacccccacgaggagcccggcaagcccgccctgccccccgaggagtgcgcccaggaggagcccgaggtgaccacccccgccagcaccatcagcagcagcaccctgagcgtgggcagcttcagcgagcacctggaccagatcaacggcagaagcgagtgcgtggacagcaccgacaacagcagcaagcccagcagcgagcccgccagccacatggccagacagagactggagagcaccgagaagaagaagatcagcggcaaggtgaccaagagcctgagcgccagcgccctgagcctgatgatccccggcgacatgttcgccgtgagccccctgggcagccccatgagcccccacagcctgagcagcgaccccagcagcagcagagacagcagccccagcagagacagcagcgccgccagcgccagcccccaccagcccatcgtgatccacagcagcggcaagaactacggcttcaccatcagagccatcagagtgtacgtgggcgacagcgacatctacaccgtgcaccacatcgtgtggaacgtggaggagggcagccccgcctgccaggccggcctgaaggccggcgacctgatcacccacatcaacggcgagcccgtgcacggcctggtgcacaccgaggtgatcgagctgctgctgaagagcggcaacaaggtgagcatcaccaccacccccttcgagaacaccagcatcaagaccggccccgccagaagaaacagctacaagagcagaatggtgagaagaagcaagaagagcaagaagaaggagagcctggagagaagaagaagcctgttcaagaagctggccaagcagcccagccccctgctgcacaccagcagaagcttcagctgcctgaacagaagcctgagcagcggcgagagcctgcccggcagccccacccacagcctgagccccagaagccccacccccagctacagaagcacccccgacttccccagcggcaccaacagcagccagagcagcagccccagcagcagcgcccccaacagccccgccggcagcggccacatcagacccagcaccctgcacggcctggcccccaagctgggcggccagagatacagaagcggcagaagaaagagcgccggcaacatccccctgagccccctggccagaacccccagccccaccccccagcccaccagcccccagagaagccccagccccctgctgggccacagcctgggcaacagcaagatcgcccaggccttccccagcaagatgcacagcccccccaccatcgtgagacacatcgtgagacccaagagcgccgagccccccagaagccccctgctgaagagagtgcagagcgaggagaagctgagccccagctacggcagcgacaagaagcacctgtgcagcagaaagcacagcctggaggtgacccaggaggaggtgcagagagagcagagccagagagaggcccccctgcagagcctggacgagaacgtgtgcgacgtgccccccctgagcagagccagacccgtggagcagggctgcctgaagagacccgtgagcagaaaggtgggcagacaggagagcgtggacgacctggacagagacaagctgaaggccaaggtggtggtgaagaaggccgacggcttccccgagaagcaggagagccaccagaagagccacggccccggcagcgacctggagaacttcgccctgttcaagctggaggagagagagaagaaggtgtaccccaaggccgtggagagaagcagcaccttcgagaacaaggccagcatgcaggaggccccccccctgggcagcctgctgaaggacgccctgcacaagcaggccagcgtgagagccagcgagggcgccatgagcgacggcagagtgcccgccgagcacagacagggcggcggcgacttcagaagagcccccgcccccggcaccctgcaggacggcctgtgccacagcctggacagaggcatcagcggcaagggcgagggcaccgagaagagcagccaggccaaggagctgctgagatgcgagaagctggacagcaagctggccaacatcgactacctgagaaagaagatgagcctggaggacaaggaggacaacctgtgccccgtgctgaagcccaagatgaccgccggcagccacgagtgcctgcccggcaaccccgtgagacccaccggcggccagcaggagcccccccccgccagcgagagcagagccttcgtgagcagcacccacgccgcccagatgagcgccgtgagcttcgtgcccctgaaggccctgaccggcagagtggacagcggcaccgagaagcccggcctggtggcccccgagagccccgtgagaaagagccccagcgagtacaagctggagggcagaagcgtgagctgcctgaagcccatcgagggcaccctggacatcgccctgctgagcggcccccaggccagcaagaccgagctgcccagccccgagagcgcccagagccccagccccagcggcgacgtgagagccagcgtgccccccgtgctgcccagcagcagcggcaagaagaacgacaccaccagcgccagagagctgagccccagcagcctgaagatgaacaagagctacctgctggagccctggttcctgccccccagcagaggcctgcagaacagccccgccgtgagcctgcccgaccccgagttcaagagagacagaaagggcccccaccccaccgccagaagccccggcaccgtgatggagagcaacccccagcagagagagggcagcagccccaagcaccaggaccacaccaccgaccccaagctgctgacctgcctgggccagaacctgcacagccccgacctggccagacccagatgccccctgccccccgaggccagccccagcagagagaagcccggcctgagagagagcagcgagagaggcccccccaccgccagaagcgagagaagcgccgccagagccgacacctgcagagagcccagcatggagctgtgcttccccgagaccgccaagaccagcgacaacagcaagaacctgctgagcgtgggcagaacccaccccgacttctacacccagacccaggccatggagaaggcctgggcccccggcggcaagaccaaccacaaggacggccccggcgaggccagacccccccccagagacaacagcagcctgcacagcgccggcatcccctgcgagaaggagctgggcaaggtgagaagaggcgtggagcccaagcccgaggccctgctggccagaagaagcctgcagccccccggcatcgagagcgagaagagcgagaagctgagcagcttccccagcctgcagaaggacggcgccaaggagcccgagagaaaggagcagcccctgcagagacaccccagcagcatcccccccccccccctgaccgccaaggacctgagcagccccgccgccagacagcactgcagcagccccagccacgccagcggcagagagcccggcgccaagcccagcaccgccgagcccagcagcagcccccaggacccccccaagcccgtggccgcccacagcgagagcagcagccacaagcccagacccggccccgaccccggcccccccaagaccaagcaccccgacagaagcctgagcagccagaagcccagcgtgggcgccaccaagggcaaggagcccgccacccagagcctgggcggcagcagcagagagggcaagggccacagcaagagcggccccgacgtgttccccgccacccccggcagccagaacaaggccagcgacggcatcggccagggcgagggcggccccagcgtgcccctgcacaccgacagagcccccctggacgccaagccccagcccaccagcggcggcagacccctggaggtgctggagaagcccgtgcacctgcccagacccggccaccccggccccagcgagcccgccgaccagaagctgagcgccgtgggcgagaagcagaccctgagccccaagcaccccaagcccagcaccgtgaaggactgccccaccctgtgcaagcagaccgacaacagacagaccgacaagagccccagccagcccgccgccaacaccgacagaagagccgagggcaagaagtgcaccgaggccctgtacgcccccgccgagggcgacaagctggaggccggcctgagcttcgtgcacagcgagaacagactgaagggcgccgagagacccgccgccggcgtgggcaagggcttccccgaggccagaggcaagggccccggcccccagaagccccccaccgaggccgacaagcccaacggcatgaagagaagccccagcgccaccggccagagcagcttcagaagcaccgccctgcccgagaagagcctgagctgcagcagcagcttccccgagaccagagccggcgtgagagaggccagcgccgccagcagcgacaccagcagcgccaaggccgccggcggcatgctggagctgcccgcccccagcaacagagaccacagaaaggcccagcccgccggcgagggcagaacccacatgaccaagagcgacagcctgcccagcttcagagtgagcaccctgcccctggagagccaccaccccgaccccaacaccatgggcggcgccagccacagagacagagccctgagcgtgaccgccaccgtgggcgagaccaagggcaaggaccccgcccccgcccagcccccccccgccagaaagcagaacgtgggcagagacgtgaccaagcccagccccgcccccaacaccgacagacccatcagcctgagcaacgagaaggacttcgtggtgagacagagaagaggcaaggagagcctgagaagcagcccccacaagaaggccctgtag

SEQ ID NO: 22514 - DNA, 7881 bp, Artificial Sequence
  Description of Artificial Sequence: Synthetic coding sequence
atgggcgagaaggtgagcgaggcccccgagcccgtgcccagaggctgcagcggccacggcagcagaacccccgccagcgccctggtggccgccagcagccccggcgccagcagcgccgagagcagcagcggcagcgagaccctgagcgaggagggcgagcccggcggcttcagcagagagcaccagccccccccccccccccccctgggcggcaccctgggcgccagagcccccgccgcctgggcccccgccagcgtgctgctggagagaggcgtgctggccctgcccccccccctgcccggcggcgccgtgccccccgcccccagaggcagcagcgccagccaggaggagcaggacgaggagctggaccacatcctgagccccccccccatgcccttcagaaagtgcagcaaccccgacgtggccagcggccccggcaagagcctgaagtacaagagacagctgagcgaggacggcagacagctgagaagaggcagcctgggcggcgccctgaccggcagatacctgctgcccaaccccgtggccggccaggcctggcccgccagcgccgagaccagcaacctggtgagaatgagaagccaggccctgggccagagcgcccccagcctgaccgccagcctgaaggagctgagcctgcccagaagaggcagcttctgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagcctgaacagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagccccgcctgctgcgaccacgagatcatcatgatgaaccacgtgtacaaggagagattccccaaggccaccgcccagatggaggagagactgaaggagatcatcaccagctacagccccgacaacgtgctgcccctggccgacggcgtgctgagcttcacccaccaccagatcatcgagctggccagagactgcctggacaagagccaccagggcctgatcaccagcagatacttcctggagctgcagcacaagctggacaagctgctgcaggaggcccacgacagaagcgagagcggcgagctggccttcatcaagcagctggtgagaaagatcctgatcgtgatcgccagacccgccagactgctggagtgcctggagttcgaccccgaggagttctactacctgctggaggccgccgagggccacgccaaggagggccagggcatcaagaccgacatccccagatacatcatcagccagctgggcctgaacaaggaccccctggaggagatggcccacctgggcaactacgacagcggcaccgccgagacccccgagaccgacgagagcgtgagcagcagcaacgccagcctgaagctgagaagaaagcccagagagagcgacttcgagaccatcaagctgatcagcaacggcgcctacggcgccgtgtacttcgtgagacacaaggagagcagacagagattcgccatgaagaagatcaacaagcagaacctgatcctgagaaaccagatccagcaggccttcgtggagagagacatcctgaccttcgccgagaaccccttcgtggtgagcatgtactgcagcttcgagaccagaagacacctgtgcatggtgatggagtacgtggagggcggcgactgcgccaccctgatgaagaacatgggccccctgcccgtggacatggccagaatgtacttcgccgagaccgtgctggccctggagtacctgcacaactacggcatcgtgcacagagacctgaagcccgacaacctgctggtgaccagcatgggccacatcaagctgaccgacttcggcctgagcaaggtgggcctgatgagcatgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcaactggcccgagaaggacgaggcccccccccccgacgcccaggacctgatcaccctgctgctgagacagaaccccctggagagactgggcaccggcggcgcctacgaggtgaagcagcacagattcttcagaagcctggactggaacagcctgctgagacagaaggccgagttcatcccccagctggagagcgaggacgacaccagctacttcgacaccagaagcgagaagtaccaccacatggagaccgaggaggaggacgacaccaacgacgaggacttcaacgtggagatcagacagttcagcagctgcagccacagattcagcaaggtgttcagcagcatcgacagaatcacccagaacagcgccgaggagaaggaggacagcgtggacaagaccaagagcaccaccctgcccagcaccgagaccctgagctggagcagcgagtacagcgagatgcagcagctgagcaccagcaacagcagcgacaccgagagcaacagacacaagctgagcagcggcctgctgcccaagctggccatcagcaccgagggcgagcaggacgaggccgccagctgccccggcgacccccacgaggagcccggcaagcccgccctgccccccgaggagtgcgcccaggaggagcccgaggtgaccacccccgccagcaccatcagcagcagcaccctgagcgtgggcagcttcagcgagcacctggaccagatcaacggcagaagcgagtgcgtggacagcaccgacaacagcagcaagcccagcagcgagcccgccagccacatggccagacagagactggagagcaccgagaagaagaagatcagcggcaaggtgaccaagagcctgagcgccagcgccctgagcctgatgatccccggcgacatgttcgccgtgagccccctgggcagccccatgagcccccacagcctgagcagcgaccccagcagcagcagagacagcagccccagcagagacagcagcgccgccagcgccagcccccaccagcccatcgtgatccacagcagcggcaagaactacggcttcaccatcagagccatcagagtgtacgtgggcgacagcgacatctacaccgtgcaccacatcgtgtggaacgtggaggagggcagccccgcctgccaggccggcctgaaggccggcgacctgatcacccacatcaacggcgagcccgtgcacggcctggtgcacaccgaggtgatcgagctgctgctgaagagcggcaacaaggtgagcatcaccaccacccccttcgagaacaccagcatcaagaccggccccgccagaagaaacagctacaagagcagaatggtgagaagaagcaagaagagcaagaagaaggagagcctggagagaagaagaagcctgttcaagaagctggccaagcagcccagccccctgctgcacaccagcagaagcttcagctgcctgaacagaagcctgagcagcggcgagagcctgcccggcagccccacccacagcctgagccccagaagccccacccccagctacagaagcacccccgacttccccagcggcaccaacagcagccagagcagcagccccagcagcagcgcccccaacagccccgccggcagcggccacatcagacccagcaccctgcacggcctggcccccaagctgggcggccagagatacagaagcggcagaagaaagagcgccggcaacatccccctgagccccctggccagaacccccagccccaccccccagcccaccagcccccagagaagccccagccccctgctgggccacagcctgggcaacagcaagatcgcccaggccttccccagcaagatgcacagcccccccaccatcgtgagacacatcgtgagacccaagagcgccgagccccccagaagccccctgctgaagagagtgcagagcgaggagaagctgagccccagctacggcagcgacaagaagcacctgtgcagcagaaagcacagcctggaggtgacccaggaggaggtgcagagagagcagagccagagagaggcccccctgcagagcctggacgagaacgtgtgcgacgtgccccccctgagcagagccagacccgtggagcagggctgcctgaagagacccgtgagcagaaaggtgggcagacaggagagcgtggacgacctggacagagacaagctgaaggccaaggtggtggtgaagaaggccgacggcttccccgagaagcaggagagccaccagaagagccacggccccggcagcgacctggagaacttcgccctgttcaagctggaggagagagagaagaaggtgtaccccaaggccgtggagagaagcagcaccttcgagaacaaggccagcatgcaggaggccccccccctgggcagcctgctgaaggacgccctgcacaagcaggccagcgtgagagccagcgagggcgccatgagcgacggcagagtgcccgccgagcacagacagggcggcggcgacttcagaagagcccccgcccccggcaccctgcaggacggcctgtgccacagcctggacagaggcatcagcggcaagggcgagggcaccgagaagagcagccaggccaaggagctgctgagatgcgagaagctggacagcaagctggccaacatcgactacctgagaaagaagatgagcctggaggacaaggaggacaacctgtgccccgtgctgaagcccaagatgaccgccggcagccacgagtgcctgcccggcaaccccgtgagacccaccggcggccagcaggagcccccccccgccagcgagagcagagccttcgtgagcagcacccacgccgcccagatgagcgccgtgagcttcgtgcccctgaaggccctgaccggcagagtggacagcggcaccgagaagcccggcctggtggcccccgagagccccgtgagaaagagccccagcgagtacaagctggagggcagaagcgtgagctgcctgaagcccatcgagggcaccctggacatcgccctgctgagcggcccccaggccagcaagaccgagctgcccagccccgagagcgcccagagccccagccccagcggcgacgtgagagccagcgtgccccccgtgctgcccagcagcagcggcaagaagaacgacaccaccagcgccagagagctgagccccagcagcctgaagatgaacaagagctacctgctggagccctggttcctgccccccagcagaggcctgcagaacagccccgccgtgagcctgcccgaccccgagttcaagagagacagaaagggcccccaccccaccgccagaagccccggcaccgtgatggagagcaacccccagcagagagagggcagcagccccaagcaccaggaccacaccaccgaccccaagctgctgacctgcctgggccagaacctgcacagccccgacctggccagacccagatgccccctgccccccgaggccagccccagcagagagaagcccggcctgagagagagcagcgagagaggcccccccaccgccagaagcgagagaagcgccgccagagccgacacctgcagagagcccagcatggagctgtgcttccccgagaccgccaagaccagcgacaacagcaagaacctgctgagcgtgggcagaacccaccccgacttctacacccagacccaggccatggagaaggcctgggcccccggcggcaagaccaaccacaaggacggccccggcgaggccagacccccccccagagacaacagcagcctgcacagcgccggcatcccctgcgagaaggagctgggcaaggtgagaagaggcgtggagcccaagcccgaggccctgctggccagaagaagcctgcagccccccggcatcgagagcgagaagagcgagaagctgagcagcttccccagcctgcagaaggacggcgccaaggagcccgagagaaaggagcagcccctgcagagacaccccagcagcatcccccccccccccctgaccgccaaggacctgagcagccccgccgccagacagcactgcagcagccccagccacgccagcggcagagagcccggcgccaagcccagcaccgccgagcccagcagcagcccccaggacccccccaagcccgtggccgcccacagcgagagcagcagccacaagcccagacccggccccgaccccggcccccccaagaccaagcaccccgacagaagcctgagcagccagaagcccagcgtgggcgccaccaagggcaaggagcccgccacccagagcctgggcggcagcagcagagagggcaagggccacagcaagagcggccccgacgtgttccccgccacccccggcagccagaacaaggccagcgacggcatcggccagggcgagggcggccccagcgtgcccctgcacaccgacagagcccccctggacgccaagccccagcccaccagcggcggcagacccctggaggtgctggagaagcccgtgcacctgcccagacccggccaccccggccccagcgagcccgccgaccagaagctgagcgccgtgggcgagaagcagaccctgagccccaagcaccccaagcccagcaccgtgaaggactgccccaccctgtgcaagcagaccgacaacagacagaccgacaagagccccagccagcccgccgccaacaccgacagaagagccgagggcaagaagtgcaccgaggccctgtacgcccccgccgagggcgacaagctggaggccggcctgagcttcgtgcacagcgagaacagactgaagggcgccgagagacccgccgccggcgtgggcaagggcttccccgaggccagaggcaagggccccggcccccagaagccccccaccgaggccgacaagcccaacggcatgaagagaagccccagcgccaccggccagagcagcttcagaagcaccgccctgcccgagaagagcctgagctgcagcagcagcttccccgagaccagagccggcgtgagagaggccagcgccgccagcagcgacaccagcagcgccaaggccgccggcggcatgctggagctgcccgcccccagcaacagagaccacagaaaggcccagcccgccggcgagggcagaacccacatgaccaagagcgacagcctgcccagcttcagagtgagcaccctgcccctggagagccaccaccccgaccccaacaccatgggcggcgccagccacagagacagagccctgagcgtgaccgccaccgtgggcgagaccaagggcaaggaccccgcccccgcccagcccccccccgccagaaagcagaacgtgggcagagacgtgaccaagcccagccccgcccccaacaccgacagacccatcagcctgagcaacgagaaggacttcgtggtgagacagagaagaggcaaggagagcctgagaagcagcccccacaagaaggccctgtag

SEQ ID NO: 22515 - DNA, 7335 bp, Artificial Sequence
  Description of Artificial Sequence: Synthetic coding sequence
atgaaggcccagagagagagactgcagatccccggcctgaccctggacctgacccccagaagcctgagccccacccccagcagccccggcagcccctgcagccccctgctggccttccacttctggagctgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagaaacgacagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagccccgcctgctgcgaccacgagatcatcatgatgaaccacgtgtacaaggagagattccccaaggccaccgcccagatggaggagagactgaaggagatcatcaccagctacagccccgacaacgtgctgcccctggccgacggcgtgctgagcttcacccaccaccagatcatcgagctggccagagactgcctggacaagagccaccagggcctgatcaccagcagatacttcctggagctgcagcacaagctggacaagctgctgcaggaggcccacgacagaagcgagagcggcgagctggccttcatcaagcagctggtgagaaagatcctgatcgtgatcgccagacccgccagactgctggagtgcctggagttcgaccccgaggagttctactacctgctggaggccgccgagggccacgccaaggagggccagggcatcaagaccgacatccccagatacatcatcagccagctgggcctgaacaaggaccccctggaggagatggcccacctgggcaactacgacagcggcaccgccgagacccccgagaccgacgagagcgtgagcagcagcaacgccagcctgaagctgagaagaaagcccagagagagcgacttcgagaccatcaagctgatcagcaacggcgcctacggcgccgtgtacttcgtgagacacaaggagagcagacagagattcgccatgaagaagatcaacaagcagaacctgatcctgagaaaccagatccagcaggccttcgtggagagagacatcctgaccttcgccgagaaccccttcgtggtgagcatgtactgcagcttcgagaccagaagacacctgtgcatggtgatggagtacgtggagggcggcgactgcgccaccctgatgaagaacatgggccccctgcccgtggacatggccagaatgtacttcgccgagaccgtgctggccctggagtacctgcacaactacggcatcgtgcacagagacctgaagcccgacaacctgctggtgaccagcatgggccacatcaagctgaccgacttcggcctgagcaaggtgggcctgatgagcatgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcaactggcccgagaaggacgaggcccccccccccgacgcccaggacctgatcaccctgctgctgagacagaaccccctggagagactgggcaccggcggcgcctacgaggtgaagcagcacagattcttcagaagcctggactggaacagcctgctgagacagaaggccgagttcatcccccagctggagagcgaggacgacaccagctacttcgacaccagaagcgagaagtaccaccacatggagaccgaggaggaggacgacaccaacgacgaggacttcaacgtggagatcagacagttcagcagctgcagccacagattcagcaaggtgttcagcagcatcgacagaatcacccagaacagcgccgaggagaaggaggacagcgtggacaagaccaagagcaccaccctgcccagcaccgagaccctgagctggagcagcgagtacagcgagatgcagcagctgagcaccagcaacagcagcgacaccgagagcaacagacacaagctgagcagcggcctgctgcccaagctggccatcagcaccgagggcgagcaggacgaggccgccagctgccccggcgacccccacgaggagcccggcaagcccgccctgccccccgaggagtgcgcccaggaggagcccgaggtgaccacccccgccagcaccatcagcagcagcaccctgagcgtgggcagcttcagcgagcacctggaccagatcaacggcagaagcgagtgcgtggacagcaccgacaacagcagcaagcccagcagcgagcccgccagccacatggccagacagagactggagagcaccgagaagaagaagatcagcggcaaggtgaccaagagcctgagcgccagcgccctgagcctgatgatccccggcgacatgttcgccgtgagccccctgggcagccccatgagcccccacagcctgagcagcgaccccagcagcagcagagacagcagccccagcagagacagcagcgccgccagcgccagcccccaccagcccatcgtgatccacagcagcggcaagaactacggcttcaccatcagagccatcagagtgtacgtgggcgacagcgacatctacaccgtgcaccacatcgtgtggaacgtggaggagggcagccccgcctgccaggccggcctgaaggccggcgacctgatcacccacatcaacggcgagcccgtgcacggcctggtgcacaccgaggtgatcgagctgctgctgaagagcggcaacaaggtgagcatcaccaccacccccttcgagaacaccagcatcaagaccggccccgccagaagaaacagctacaagagcagaatggtgagaagaagcaagaagagcaagaagaaggagagcctggagagaagaagaagcctgttcaagaagctggccaagcagcccagccccctgctgcacaccagcagaagcttcagctgcctgaacagaagcctgagcagcggcgagagcctgcccggcagccccacccacagcctgagccccagaagccccacccccagctacagaagcacccccgacttccccagcggcaccaacagcagccagagcagcagccccagcagcagcgcccccaacagccccgccggcagcggccacatcagacccagcaccctgcacggcctggcccccaagctgggcggccagagatacagaagcggcagaagaaagagcgccggcaacatccccctgagccccctggccagaacccccagccccaccccccagcccaccagcccccagagaagccccagccccctgctgggccacagcctgggcaacagcaagatcgcccaggccttccccagcaagatgcacagcccccccaccatcgtgagacacatcgtgagacccaagagcgccgagccccccagaagccccctgctgaagagagtgcagagcgaggagaagctgagccccagctacggcagcgacaagaagcacctgtgcagcagaaagcacagcctggaggtgacccaggaggaggtgcagagagagcagagccagagagaggcccccctgcagagcctggacgagaacgtgtgcgacgtgccccccctgagcagagccagacccgtggagcagggctgcctgaagagacccgtgagcagaaaggtgggcagacaggagagcgtggacgacctggacagagacaagctgaaggccaaggtggtggtgaagaaggccgacggcttccccgagaagcaggagagccaccagaagagccacggccccggcagcgacctggagaacttcgccctgttcaagctggaggagagagagaagaaggtgtaccccaaggccgtggagagaagcagcaccttcgagaacaaggccagcatgcaggaggccccccccctgggcagcctgctgaaggacgccctgcacaagcaggccagcgtgagagccagcgagggcgccatgagcgacggcagagtgcccgccgagcacagacagggcggcggcgacttcagaagagcccccgcccccggcaccctgcaggacggcctgtgccacagcctggacagaggcatcagcggcaagggcgagggcaccgagaagagcagccaggccaaggagctgctgagatgcgagaagctggacagcaagctggccaacatcgactacctgagaaagaagatgagcctggaggacaaggaggacaacctgtgccccgtgctgaagcccaagatgaccgccggcagccacgagtgcctgcccggcaaccccgtgagacccaccggcggccagcaggagcccccccccgccagcgagagcagagccttcgtgagcagcacccacgccgcccagatgagcgccgtgagcttcgtgcccctgaaggccctgaccggcagagtggacagcggcaccgagaagcccggcctggtggcccccgagagccccgtgagaaagagccccagcgagtacaagctggagggcagaagcgtgagctgcctgaagcccatcgagggcaccctggacatcgccctgctgagcggcccccaggccagcaagaccgagctgcccagccccgagagcgcccagagccccagccccagcggcgacgtgagagccagcgtgccccccgtgctgcccagcagcagcggcaagaagaacgacaccaccagcgccagagagctgagccccagcagcctgaagatgaacaagagctacctgctggagccctggttcctgccccccagcagaggcctgcagaacagccccgccgtgagcctgcccgaccccgagttcaagagagacagaaagggcccccaccccaccgccagaagccccggcaccgtgatggagagcaacccccagcagagagagggcagcagccccaagcaccaggaccacaccaccgaccccaagctgctgacctgcctgggccagaacctgcacagccccgacctggccagacccagatgccccctgccccccgaggccagccccagcagagagaagcccggcctgagagagagcagcgagagaggcccccccaccgccagaagcgagagaagcgccgccagagccgacacctgcagagagcccagcatggagctgtgcttccccgagaccgccaagaccagcgacaacagcaagaacctgctgagcgtgggcagaacccaccccgacttctacacccagacccaggccatggagaaggcctgggcccccggcggcaagaccaaccacaaggacggccccggcgaggccagacccccccccagagacaacagcagcctgcacagcgccggcatcccctgcgagaaggagctgggcaaggtgagaagaggcgtggagcccaagcccgaggccctgctggccagaagaagcctgcagccccccggcatcgagagcgagaagagcgagaagctgagcagcttccccagcctgcagaaggacggcgccaaggagcccgagagaaaggagcagcccctgcagagacaccccagcagcatcccccccccccccctgaccgccaaggacctgagcagccccgccgccagacagcactgcagcagccccagccacgccagcggcagagagcccggcgccaagcccagcaccgccgagcccagcagcagcccccaggacccccccaagcccgtggccgcccacagcgagagcagcagccacaagcccagacccggccccgaccccggcccccccaagaccaagcaccccgacagaagcctgagcagccagaagcccagcgtgggcgccaccaagggcaaggagcccgccacccagagcctgggcggcagcagcagagagggcaagggccacagcaagagcggccccgacgtgttccccgccacccccggcagccagaacaaggccagcgacggcatcggccagggcgagggcggccccagcgtgcccctgcacaccgacagagcccccctggacgccaagccccagcccaccagcggcggcagacccctggaggtgctggagaagcccgtgcacctgcccagacccggccaccccggccccagcgagcccgccgaccagaagctgagcgccgtgggcgagaagcagaccctgagccccaagcaccccaagcccagcaccgtgaaggactgccccaccctgtgcaagcagaccgacaacagacagaccgacaagagccccagccagcccgccgccaacaccgacagaagagccgagggcaagaagtgcaccgaggccctgtacgcccccgccgagggcgacaagctggaggccggcctgagcttcgtgcacagcgagaacagactgaagggcgccgagagacccgccgccggcgtgggcaagggcttccccgaggccagaggcaagggccccggcccccagaagccccccaccgaggccgacaagcccaacggcatgaagagaagccccagcgccaccggccagagcagcttcagaagcaccgccctgcccgagaagagcctgagctgcagcagcagcttccccgagaccagagccggcgtgagagaggccagcgccgccagcagcgacaccagcagcgccaaggccgccggcggcatgctggagctgcccgcccccagcaacagagaccacagaaaggcccagcccgccggcgagggcagaacccacatgaccaagagcgacagcctgcccagcttcagagtgagcaccctgcccctggagagccaccaccccgaccccaacaccatgggcggcgccagccacagagacagagccctgagcgtgaccgccaccgtgggcgagaccaagggcaaggaccccgcccccgcccagcccccccccgccagaaagcagaacgtgggcagagacgtgaccaagcccagccccgcccccaacaccgacagacccatcagcctgagcaacgagaaggacttcgtggtgagacagagaagaggcaaggagagcctgagaagcagcccccacaagaaggccctgtag

SEQ ID NO: 22516 - DNA, 753 bp, Artificial Sequence
  Description of Artificial Sequence: Synthetic coding sequence
atgggcgagaaggtgagcgaggcccccgagcccgtgcccagaggctgcagcggccacggcagcagaacccccgccagcgccctggtggccgccagcagccccggcgccagcagcgccgagagcagcagcggcagcgagaccctgagcgaggagggcgagcccggcggcttcagcagagagcaccagccccccccccccccccccctgggcggcaccctgggcgccagagcccccgccgcctgggcccccgccagcgtgctgctggagagaggcgtgctggccctgcccccccccctgcccggcggcgccgtgccccccgcccccagaggcagcagcgccagccaggaggagcaggacgaggagctggaccacatcctgagccccccccccatgcccttcagaaagtgcagcaaccccgacgtggccagcggccccggcaagagcctgaagtacaagagacagctgagcgaggacggcagacagctgagaagaggcagcctgggcggcgccctgaccggcagatacctgctgcccaaccccgtggccggccaggcctggcccgccagcgccgagaccagcaacctggtgagaatgagaagccaggccctgggccagagcgcccccagcctgaccgccagcctgaaggagctgagcctgcccagaagaggcagcctgatcgacagccagaagtggaactgcctggtgaagagacccgtgtgccccaacgccggcagaaccagccccctgggctag

SEQ ID NO: 22517 - DNA, 2982 bp, Artificial Sequence
  Description of Artificial Sequence: Synthetic coding sequence
atggacatgagcgaccccaacttctggaccgtgctgagcaacttcaccctgccccacctgagaagcggcaacagactgagaagaacccagagctgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagccccgcctgctgcgaccacgagatcatcatgatgaaccacgtgtacaaggagagattccccaaggccaccgcccagatggaggagagactgaaggagatcatcaccagctacagccccgacaacgtgctgcccctggccgacggcgtgctgagcttcacccaccaccagatcatcgagctggccagagactgcctggacaagagccaccagggcctgatcaccagcagatacttcctggagctgcagcacaagctggacaagctgctgcaggaggcccacgacagaagcgagagcggcgagctggccttcatcaagcagctggtgagaaagatcctgatcgtgatcgccagacccgccagactgctggagtgcctggagttcgaccccgaggagttctactacctgctggaggccgccgagggccacgccaaggagggccagggcatcaagaccgacatccccagatacatcatcagccagctgggcctgaacaaggaccccctggaggagatggcccacctgggcaactacgacagcggcaccgccgagacccccgagaccgacgagagcgtgagcagcagcaacgccagcctgaagctgagaagaaagcccagagagagcgacttcgagaccatcaagctgatcagcaacggcgcctacggcgccgtgtacttcgtgagacacaaggagagcagacagagattcgccatgaagaagatcaacaagcagaacctgatcctgagaaaccagatccagcaggccttcgtggagagagacatcctgaccttcgccgagaaccccttcgtggtgagcatgtactgcagcttcgagaccagaagacacctgtgcatggtgatggagtacgtggagggcggcgactgcgccaccctgatgaagaacatgggccccctgcccgtggacatggccagaatgtacttcgccgagaccgtgctggccctggagtacctgcacaactacggcatcgtgcacagagacctgaagcccgacaacctgctggtgaccagcatgggccacatcaagctgaccgacttcggcctgagcaaggtgggcctgatgagcatgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcaactggcccgagaaggacgaggcccccccccccgacgcccaggacctgatcaccctgctgctgagacagaaccccctggagagactgggcaccggcggcgcctacgaggtgaagcagcacagattcttcagaagcctggactggaacagcctgctgagacagaaggccgagttcatcccccagctggagagcgaggacgacaccagctacttcgacaccagaagcgagaagtaccaccacatggagaccgaggaggaggacgacaccaacgacgaggacttcaacgtggagatcagacagttcagcagctgcagccacagattcagcaaggtgttcagcagcatcgacagaatcacccagaacagcgccgaggagaaggaggacagcgtggacaagaccaagagcaccaccctgcccagcaccgagaccctgagctggagcagcgagtacagcgagatgcagcagctgagcaccagcaacagcagcgacaccgagagcaacagacacaagctgagcagcggcctgctgcccaagctggccatcagcaccgagggcgagcaggacgaggccgccagctgccccggcgacccccacgaggagcccggcaagcccgccctgccccccgaggagtgcgcccaggaggagcccgaggtgaccacccccgccagcaccatcagcagcagcaccctgagcgacatgttcgccgtgagccccctgggcagccccatgagcccccacagcctgagcagcgaccccagcagcagcagagacagcagccccagcagagacagcagcgccgccagcgccagcccccaccagcccatcgtgatccacagcagcggcaagaactacggcttcaccatcagagccatcagagtgtacgtgggcgacagcgacatctacaccgtgcaccacatcgtgtggaacgtggaggagggcagccccgcctgccaggccggcctgaaggccggcgacctgatcacccacatcaacggcgagcccgtgcacggcctggtgcacaccgaggtgatcgagctgctgctgaagagcggcaacaaggtgagcatcaccaccacccccttcgagaacaccagcatcaagaccggccccgccagaagaaacagctacaagagcagaatggtgagaagaagcaagaagagctag

SEQ ID NO: 22518 - DNA, 507 bp, Artificial Sequence
  Description of Artificial Sequence: Synthetic coding sequence
atggacatgagcgaccccaacttctggaccgtgctgagcaacttcaccctgccccacctgagaagcggcaacagactgagaagaacccagagctgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagcccctag

SEQ ID NO: 22519 - DNA, 7872 bp, Artificial Sequence
  Description of Artificial Sequence: Synthetic coding sequence
atgggcgagaaggtgagcgaggcccccgagcccgtgcccagaggctgcagcggccacggcagcagaacccccgccagcgccctggtggccgccagcagccccggcgccagcagcgccgagagcagcagcggcagcgagaccctgagcgaggagggcgagcccggcggcttcagcagagagcaccagccccccccccccccccccctgggcggcaccctgggcgccagagcccccgccgcctgggcccccgccagcgtgctgctggagagaggcgtgctggccctgcccccccccctgcccggcggcgccgtgccccccgcccccagaggcagcagcgccagccaggaggagcaggacgaggagctggaccacatcctgagccccccccccatgcccttcagaaagtgcagcaaccccgacgtggccagcggccccggcaagagcctgaagtacaagagacagctgagcgaggacggcagacagctgagaagaggcagcctgggcggcgccctgaccggcagatacctgctgcccaaccccgtggccggccaggcctggcccgccagcgccgagaccagcaacctggtgagaatgagaagccaggccctgggccagagcgcccccagcctgaccgccagcctgaaggagctgagcctgcccagaagaggcagcttctgcagaaccagcaacagaaagagcctgatcggcaacggccagagccccgccctgcccagaccccacagccccctgagcgcccacgccggcaacagcccccaggacagccccagaaacttcagccccagcgccagcgcccacttcagcttcgccagaagaaccgacggcagaagatggagcctggccagcctgcccagcagcggctacggcaccaacacccccagcagcaccgtgagcagcagctgcagcagccaggagaagctgcaccagctgccctaccagcccacccccgacgagctgcacttcctgagcaagcacttctgcaccaccgagagcatcgccaccgagaacagatgcagaaacacccccatgagacccagaagcagaagcctgagccccggcagaagccccgcctgctgcgaccacgagatcatcatgatgaaccacgtgtacaaggagagattccccaaggccaccgcccagatggaggagagactgaaggagatcatcaccagctacagccccgacaacgtgctgcccctggccgacggcgtgctgagcttcacccaccaccagatcatcgagctggccagagactgcctggacaagagccaccagggcctgatcaccagcagatacttcctggagctgcagcacaagctggacaagctgctgcaggaggcccacgacagaagcgagagcggcgagctggccttcatcaagcagctggtgagaaagatcctgatcgtgatcgccagacccgccagactgctggagtgcctggagttcgaccccgaggagttctactacctgctggaggccgccgagggccacgccaaggagggccagggcatcaagaccgacatccccagatacatcatcagccagctgggcctgaacaaggaccccctggaggagatggcccacctgggcaactacgacagcggcaccgccgagacccccgagaccgacgagagcgtgagcagcagcaacgccagcctgaagctgagaagaaagcccagagagagcgacttcgagaccatcaagctgatcagcaacggcgcctacggcgccgtgtacttcgtgagacacaaggagagcagacagagattcgccatgaagaagatcaacaagcagaacctgatcctgagaaaccagatccagcaggccttcgtggagagagacatcctgaccttcgccgagaaccccttcgtggtgagcatgtactgcagcttcgagaccagaagacacctgtgcatggtgatggagtacgtggagggcggcgactgcgccaccctgatgaagaacatgggccccctgcccgtggacatggccagaatgtacttcgccgagaccgtgctggccctggagtacctgcacaactacggcatcgtgcacagagacctgaagcccgacaacctgctggtgaccagcatgggccacatcaagctgaccgacttcggcctgagcaaggtgggcctgatgagcatgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcaactggcccgagaaggacgaggcccccccccccgacgcccaggacctgatcaccctgctgctgagacagaaccccctggagagactgggcaccggcggcgcctacgaggtgaagcagcacagattcttcagaagcctggactggaacagcctgctgagacagaaggccgagttcatcccccagctggagagcgaggacgacaccagctacttcgacaccagaagcgagaagtaccaccacatggagaccgaggaggaggacgacaccaacgacgaggacttcaacgtggagatcagacagttcagcagctgcagccacagattcagcaaggtgttcagcagcatcgacagaatcacccagaacagcgccgaggagaaggaggacagcgtggacaagaccaagagcaccaccctgcccagcaccgagaccctgagctggagcagcgagtacagcgagatgcagcagctgagcaccagcaacagcagcgacaccgagagcaacagacacaagctgagcagcggcctgctgcccaagctggccatcagcaccgagggcgagcaggacgaggccgccagctgccccggcgacccccacgaggagcccggcaagcccgccctgccccccgaggagtgcgcccaggaggagcccgaggtgaccacccccgccagcaccatcagcagcagcaccctgagcgtgggcagcttcagcgagcacctggaccagatcaacggcagaagcgagtgcgtggacagcaccgacaacagcagcaagcccagcagcgagcccgccagccacatggccagacagagactggagagcaccgagaagaagaagatcagcggcaaggtgaccaagagcctgagcgccagcgccctgagcctgatgatccccggcgacatgttcgccgtgagccccctgggcagccccatgagcccccacagcctgagcagcgaccccagcagcagcagagacagcagccccagcagagacagcagcgccgccagcgccagcccccaccagcccatcgtgatccacagcagcggcaagaactacggcttcaccatcagagccatcagagtgtacgtgggcgacagcgacatctacaccgtgcaccacatcgtgtggaacgtggaggagggcagccccgcctgccaggccggcctgaaggccggcgacctgatcacccacatcaacggcgagcccgtgcacggcctggtgcacaccgaggtgatcgagctgctgctgaagagcggcaacaaggtgagcatcaccaccacccccttcgagaacaccagcatcaagaccggccccgccagaagaaacagctacaagagcagaatggtgagaagaagcaagaagagcaagaagaaggagagcctggagagaagaagaagcctgttcaagaagctggccaagcagcccagccccctgctgcacaccagcagaagcttcagctgcctgaacagaagcctgagcagcggcgagagcctgcccggcagccccacccacagcctgagccccagaagccccacccccagctacagaagcacccccgacttccccagcggcaccaacagcagccagagcagcagccccagcagcagcgcccccaacagccccgccggcagcggccacatcagacccagcaccctgcacggcctggcccccaagctgggcggccagagatacagaagcggcagaagaaagagcgccggcaacatccccctgagccccctggccagaacccccagccccaccccccagcccaccagcccccagagaagccccagccccctgctgggccacagcctgggcaacagcaagatcgcccaggccttccccagcaagatgcacagcccccccaccatcgtgagacacatcgtgagacccaagagcgccgagccccccagaagccccctgctgaagagagtgcagagcgaggagaagctgagccccagctacggcagcgacaagaagcacctgtgcagcagaaagcacagcctggaggtgacccaggaggaggtgcagagagagcagagccagagagaggcccccctgcagagcctggacgagaacgtgtgcgacgtgccccccctgagcagagccagacccgtggagcagggctgcctgaagagacccgtgagcagaaaggtgggcagacaggagagcgtggacgacctggacagagacaagctgaaggccaaggtggtggtgaagaaggccgacggcttccccgagaagcaggagagccaccagaagagccacggccccggcagcgacctggagaacttcgccctgttcaagctggaggagagagagaagaaggtgtaccccaaggccgtggagagaagcagcaccttcgagaacaaggccagcatgcaggaggccccccccctgggcagcctgctgaaggacgccctgcacaagcaggccagcgtgagagccagcgagggcgccatgagcgacggcagagtgcccgccgagcacagacagggcggcggcgacttcagaagagcccccgcccccggcaccctgcaggacggcctgtgccacagcctggacagaggcatcagcggcaagggcgagggcaccgagaagagcagccaggccaaggagctgctgagatgcgagaagctggacagcaagctggccaacatcgactacctgagaaagaagatgagcctggaggacaaggaggacaacctgtgccccgtgctgaagcccaagatgaccgccggcagccacgagtgcctgcccggcaaccccgtgagacccaccggcggccagcaggagcccccccccgccagcgagagcagagccttcgtgagcagcacccacgccgcccagatgagcgccgtgagcttcgtgcccctgaaggccctgaccggcagagtggacagcggcaccgagaagcccggcctggtggcccccgagagccccgtgagaaagagccccagcgagtacaagctggagggcagaagcgtgagctgcctgaagcccatcgagggcaccctggacatcgccctgctgagcggcccccaggccagcaagaccgagctgcccagccccgagagcgcccagagccccagccccagcggcgacgtgagagccagcgtgccccccgtgctgcccagcagcagcggcaagaagaacgacaccaccagcgccagagagctgagccccagcagcctgaagatgaacaagagctacctgctggagccctggttcctgccccccagcagaggcctgcagaacagccccgccgtgagcctgcccgaccccgagttcaagagagacagaaagggcccccaccccaccgccagaagccccggcaccgtgatggagagcaacccccagcagagagagggcagcagccccaagcaccaggaccacaccaccgaccccaagctgctgacctgcctgggccagaacctgcacagccccgacctggccagacccagatgccccctgccccccgaggccagccccagcagagagaagcccggcctgagagagagcagcgagagaggcccccccaccgccagaagcgagagaagcgccgccagagccgacacctgcagagagcccagcatggagctgtgcttccccgagaccgccaagaccagcgacaacagcaagaacctgctgagcgtgggcagaacccaccccgacttctacacccagacccaggccatggagaaggcctgggcccccggcggcaagaccaaccacaaggacggccccggcgaggccagacccccccccagagacaacagcagcctgcacagcgccggcatcccctgcgagaaggagctgggcaaggtgagaagaggcgtggagcccaagcccgaggccctgctggccagaagaagcctgcagccccccggcatcgagagcgagaagagcgagaagctgagcagcttccccagcctgcagaaggacggcgccaaggagcccgagagaaaggagcagcccctgcagagacaccccagcagcatcccccccccccccctgaccgccaaggacctgagcagccccgccgccagacagcactgcagcagccccagccacgccagcggcagagagcccggcgccaagcccagcaccgccgagcccagcagcagcccccaggacccccccaagcccgtggccgcccacagcgagagcagcagccacaagcccagacccggccccgaccccggcccccccaagaccaagcaccccgacagaagcctgagcagccagaagcccagcgtgggcgccaccaagggcaaggagcccgccacccagagcctgggcggcagcagcagagagggcaagggccacagcaagagcggccccgacgtgttccccgccacccccggcagccagaacaaggccagcgacggcatcggccagggcgagggcggccccagcgtgcccctgcacaccgacagagcccccctggacgccaagccccagcccaccagcggcggcagacccctggaggtgctggagaagcccgtgcacctgcccagacccggccaccccggccccagcgagcccgccgaccagaagctgagcgccgtgggcgagaagcagaccctgagccccaagcaccccaagcccagcaccgtgaaggactgccccaccctgtgcaagcagaccgacaacagacagaccgacaagagccccagccagcccgccgccaacaccgacagaagagccgagggcaagaagtgcaccgaggccctgtacgcccccgccgagggcgacaagctggaggccggcctgagcttcgtgcacagcgagaacagactgaagggcgccgagagacccgccgccggcgtgggcaagggcttccccgaggccagaggcaagggccccggcccccagaagccccccaccgaggccgacaagcccaacggcatgaagagaagccccagcgccaccggccagagcagcttcagaagcaccgccctgcccgagaagagcctgagctgcagcagcagcttccccgagaccagagccggcgtgagagaggccagcgccgccagcagcgacaccagcagcgccaaggccgccggcggcatgctggagctgcccgcccccagcaacagagaccacagaaaggcccagcccgccggcgagggcagaacccacatgaccaagagcgacagcctgcccagcttcagagtgagcaccctgcccctggagagccaccaccccgaccccaacaccatgggcggcgccagccacagagacagagccctgagcgtgaccgccaccgtgggcgagaccaagggcaaggaccccgcccccgcccagcccccccccgccagaaagcagaacgtgggcagagacgtgaccaagcccagccccgcccccaacaccgacagacccatcagcctgagcaacgagaaggacttcgtggtgagacagagaagaggcaaggagagcctgagaagcagcccccacaagaaggccctgtag

SEQ ID NO: 22520 - DNA, 1152 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22521 - DNA, 1239 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22522 - DNA, 1326 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22523 - DNA, 795 bp, Artificial Sequence
  Description of Artificial Sequence: Synthetic coding sequence
accagagaggccgagggcgccgacggcaagaccaagatcgccacccccaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22524 - DNA, 651 bp, Artificial Sequence
  Description of Artificial Sequence: Synthetic coding sequence
atggccgagcccagacaggagttcgaggtgatggaggaccacgccggcacctacggcctgggcgacagaaaggaccagagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22525 - DNA, 1152 bp, Artificial Sequence; identical to SEQ ID NO: 22520
  Description of Artificial Sequence: Synthetic coding sequence

SEQ ID NO: 22526 - DNA, 951 bp, Artificial Sequence
  Description of Artificial Sequence: Synthetic coding sequence
atgctgagagccctgcagcagagaaagagagaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22527 - DNA, 2277 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggagcccgagagcggcaaggtggtgcaggagggcttcctgagagagcccggcccccccggcctgagccaccagctgatgagcggcatgcccggcgcccccctgctgcccgagggccccagagaggccaccagacagcccagcggcaccggccccgaggacaccgagggcggcagacacgcccccgagctgctgaagcaccagctgctgggcgacctgcaccaggagggccccctgctgaagggcgccggcggcaaggagagacccggcagcaaggaggaggtggacgaggacagagacgtggacgagagcagcccccaggacagcccccccagcaaggccagccccgcccaggacggcagacccccccagaccgccgccagagaggccaccagcatccccggcttccccgccgagggcgccatccccctgcccgtggacttcctgagcaaggtgagcaccgagatccccgccagcgagcccaacggccccagcgccggcagagccaagggccaggacgcccccctggagttcaccttccacgtggagatcacccccaacgtgcagaaggagcaggcccacagcgaggagcacctgggcagagccgccttccccggcgcccccggcgagggccccgaggccagaggccccagcctgggcgaggacaccaaggaggccgacctgcccgagcccagcgagaagcagcccgccgccgcccccagaggcaagcccgtgagctgggtgccccagctgaaggccagaatggtgagcaagagcaaggacggcaccggcagcgacgacaagaaggccaagaccagcaccagaagcagcgccaagaccctgaagaacagaccctgcctgagccccaagcaccccacccccggcagcagcgaccccctgatccagcccagcagccccgccgtgtgccccgagccccccagcagccccaagtacgtgagcagcgtgacccccagaaccggcagcagcggcgccaaggagatgaagctgaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22528 - DNA, 2331 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggagcccgagagcggcaaggtggtgcaggagggcttcctgagagagcccggcccccccggcctgagccaccagctgatgagcggcatgcccggcgcccccctgctgcccgagggccccagagaggccaccagacagcccagcggcaccggccccgaggacaccgagggcggcagacacgcccccgagctgctgaagcaccagctgctgggcgacctgcaccaggagggccccctgctgaagggcgccggcggcaaggagagacccggcagcaaggaggaggtggacgaggacagagacgtggacgagagcagcccccaggacagcccccccagcaaggccagccccgcccaggacggcagacccccccagaccgccgccagagaggccaccagcatccccggcttccccgccgagggcgccatccccctgcccgtggacttcctgagcaaggtgagcaccgagatccccgccagcgagcccaacggccccagcgccggcagagccaagggccaggacgcccccctggagttcaccttccacgtggagatcacccccaacgtgcagaaggagcaggcccacagcgaggagcacctgggcagagccgccttccccggcgcccccggcgagggccccgaggccagaggccccagcctgggcgaggacaccaaggaggccgacctgcccgagcccagcgagaagcagcccgccgccgcccccagaggcaagcccgtgagctgggtgccccagctgaaggccagaatggtgagcaagagcaaggacggcaccggcagcgacgacaagaaggccaagaccagcaccagaagcagcgccaagaccctgaagaacagaccctgcctgagccccaagcaccccacccccggcagcagcgaccccctgatccagcccagcagccccgccgtgtgccccgagccccccagcagccccaagtacgtgagcagcgtgacccccagaaccggcagcagcggcgccaaggagatgaagctgaagggcgccgacggcaagaccaagatcgccacccccagaggcgccgccccccccggccagaagggccaggccaacgccaccagaatccccgccaagaccccccccgcccccaagaccccccccagcagcgccaccaagcaggtgcagagaagacccccccccgccggccccagaagcgagagaggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22529 - DNA, 1233 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 22530 - DNA, 1167 bp, Artificial Sequence
  Description of Artificial Sequence: Synthetic coding sequence
atggtggaggccgaggagctggcccagctgagactgctgaacctggagctgctgagacagctgtgggtgggccaggacgccgtgagaagaagcgtggccagagccgccagcgagagcagcctggagagcagcagcagctacaacagcgagacccccagcacccccgagaccagcagcaccagcctgagcaccagctgccccagaggcagaagcagcgtgtggggcccccccgacgcctgcagaggcgacctgagagacgtggccagaagcggcgtggccagcctgccccccgccaagtgccagcaccaggagagcctgggcagacccagaccccacagcgcccccagcctgggcaccagcagcctgagagaccccgagcccagcggcagactgggcgaccccggcccccaggaggcccagacccccagaagcatcctggcccagcagagcaagctgagcaagcccagagtgaccttcagcgaggagagcgccgtgcccaagagaagctggagactgagaccctacctgggctacgactggatcgccggcagcctggacaccagcagcagcatcaccagccagcccgaggccttcttcagcaagctgcaggagttcagagagaccaacaaggaggagtgcatctgcagccaccccgagccccagctgcccggcctgagagagagcagcggcagcggcgtggaggaggaccacgagtgcgtgtactgctacagagtgaacagaagactgttccccgtgcccgtggaccccggcaccccctgcagactgtgcagaacccccagagaccagcagggccccggcaccctggcccagcccgcccacgtgagagtgagcatccccctgagcatcctggagcccccccacagataccacatccacagaagaaagagcttcgacgccagcgacaccctggccctgcccagacactgcctgctgggctgggacatcttcccccccaagagcgagaagagcagcgcccccagaaacctggacctgtggagcagcgtgagcgccgaggcccagcaccagaagctgagcggcaccagcagccccttccaccccgccagccccatgcagatgctgccccccacccccacctggagcgtgccccaggtgcccagaccccacgtgcccagacagaagccctag

SEQ ID NO: 22531 - DNA, 1077 bp, Artificial Sequence
  Description of Artificial Sequence: Synthetic coding sequence
atggtggaggccgaggagctggcccagctgagactgctgaacctggagctgctgagacagctgtgggtgggccaggacgccgtgagaagaagcgtggccagagccgccagcgagagcagcctggagagcagcagcagctacaacagcgagacccccagcacccccgagaccagcagcaccagcctgagcaccagctgccccagaggcagaagcagcgtgtggggcccccccgacgcctgcagaggcgacctgagagacgtggccagaagcggcgtggccagcctgccccccgccaagtgccagcaccaggagagcctgggcagacccagaccccacagcgcccccagcctgggcaccagcagcctgagagaccccgagcccagcggcagactgggcgaccccggcccccaggaggcccagacccccagaagcatcctggcccagcagagcaagctgagcaagcccagagtgaccttcagcgaggagagcgccgtgcccaagagaagctggagactgagaccctacctgggctacgactggatcgccggcagcctggacaccagcagcagcatcaccagccagcccgaggccttcttcagcaagctgcaggagttcagagagaccaacaaggaggagtgcatctgcagccaccccgagccccagctgcccggcctgagagagagcagcggcagcggcgtggaggaggaccacgagtgcgtgtactgctacagagtgaacagaagactgttccccgtgcccgtggaccccggcaccccctgcagactgtgcagaacccccagagaccagcagggccccggcaccctggcccagcccgcccacgtgagcaccgcctgctgggccggcaccttcttcctgagaagcctgagaaaggcccagccccccggcacctggaccagcggccccctgagccccctgagacccagcaccagaagctgccccgcccccgccgccctgttcaccagaccccaccagtgcagatgctgccccagacccagacccggccagtgccccagaagcctgggccccaccagccacggcagaagccccgaggactag

SEQ ID NO: 22532 - DNA, 2070 bp, Artificial Sequence
  Description of Artificial Sequence: Synthetic coding sequence
agcagcggcctgaccgtgaccgccgtgaaggacagcggcgagtggaacctggaggccggcgccctggtgctggccgacgccggcctgtgctgcatcgacgagttcaacagcctgaaggagcacgacagaaccagcatccacgaggccatggagcagcagaccatcagcgtggccaaggccggcctggtgtgcaagctgaacaccagaaccaccatcctggccgccaccaaccccaagggccagtacgacccccaggagagcgtgagcgtgaacatcgccctgggcagccccctgctgagcagattcgacctgatcctggtgctgctggacaccaagaacgaggactgggacagaatcatcagcagcttcatcctggagaacaagggctaccccagcaagagcgagaagctgtggagcatggagaagatgaagacctacttctgcctgatcagaaacctgcagcccaccctgagcgacgtgggcaaccaggtgctgctgagatactaccagatgcagagacagagcgactgcagaaacgccgccagaaccaccatcagactgctggagagcctgatcagactggccgaggcccacgccagactgatgttcagagacaccgtgaccctggaggacgccatcaccgtggtgagcgtgatggagagcagcatgcagggcggcgccctgctgggcggcgtgaacgccctgcacaccagcttccccgagaaccccggcgagcagtaccagagacagtgcgagctgatcctggagaagctggagctgcagagcctgctgagcgaggagctgagaagactggagagactgcagaaccagagcgtgcaccagagccagcccagagtgctggaggtggagaccacccccggcagcctgagaaacggccccggcgaggagagcaacttcagaaccagcagccagcaggagatcaactacagcacccacatcttcagccccggcggcagccccgagggcagccccgtgctggacccccccccccacctggagcccaacagaagcaccagcagaaagcacagcgcccagcacaagaacaacagagacgacagcctggactggttcgacttcatggccacccaccagagcgagcccaagaacaccgtggtggtgagcccccaccccaagaccagcggcgagaacatggccagcaagatcagcaacagcaccagccagggcaaggagaagagcgagcccggccagagaagcaaggtggacatcggcctgctgcccagccccggcgagaccggcgtgccctggagagccgacaacgtggagagcaacaagaagaagagactggccctggacagcgaggccgccgtgagcgccgacaagcccgacagcgtgctgacccaccacgtgcccagaaacctgcagaagctgtgcaaggagagagcccagaagctgtgcagaaacagcaccagagtgcccgcccagtgcaccgtgcccagccacccccagagcacccccgtgcacagccccgacagaatgctggacagccccaagagaaagagacccaagagcctggcccaggtggaggagcccgccatcgagaacgtgaagccccccggcagccccgtggccaagctggccaagttcaccttcaagcagaagagcaagctgatccacagcttcgaggaccacagccacgtgagccccggcgccaccaagatcgccgtgcacagccccaagatcagccagagaagaaccagaagagacgccgccctgcccgtgaagagacccggcaagctgaccagcacccccggcaaccagatcagcagccagccccagggcgagaccaaggaggtgagccagcagccccccgagaagcacggccccagagagaaggtgatgtgcgcccccgagaagagaatcatccagcccgagctggagctgggcaacgagaccggctgcgcccacctgacctgcgagggcgacaagaaggaggaggtgagcggcagcaacaagagcggcaaggtgcacgcctgcaccctggccagactggccaacttctgcttcaccccccccagcgagagcaagtag

SEQ ID NO: 22533 - DNA, 1176 bp, Artificial Sequence
  Description of Artificial Sequence: Synthetic coding sequence
atgaacagcgaccaggtgaccctggtgggccaggtgttcgagagctacgtgagcgagtaccacaagaacgacatcctgctgatcctgaaggagagagacgaggacgcccactaccccgtggtggtgaacgccatgaccctgttcgagaccaacatggagatcggcgagtacttcaacatgttccccagcgaggtgctgaccatcttcgacagcgccctgagaagaagcgccctgaccatcctgcagagcctgagccagcccgaggccgtgagcatgaagcagaacctgcacgccagaatcagcggcctgcccgtgtgccccgagctggtgagagagcacatccccaagaccaaggacgtgggccacttcctgagcgtgaccggcaccgtgatcagaaccagcctggtgaaggtgctggagttcgagagagactacatgtgcaacaagtgcaagcacgtgttcgtgatcaaggccgacttcgagcagtactacaccttctgcagacccagcagctgccccagcctggagagctgcgacagcagcaagttcacctgcctgagcggcctgagcagcagccccaccagatgcagagactaccaggagatcaagatccaggagcaggtgcagagactgagcgtgggcagcatccccagaagcatgaaggtgatcctggaggacgacctggtggacagctgcaagagcggcgacgacctgaccatctacggcatcgtgatgcagagatggaagcccttccagcaggacgtgagatgcgaggtggagatcgtgctgaaggccaactacatccaggtgaacaacgagcagagcagcggcatcatcatggacgaggaggtgcagaaggagttcgaggacttctgggagtactacaagagcgaccccttcgccggcagaaacgtgatcctggccagcctgtgcccccaggtgttcggcatgtacctggtgaagctggccgtggccatggtgctggccggcggcatccagagaaccgacgccaccggcaccagagtgagaggcgagagccacctgctgctggtgggcgaccccggcaccggcaagagccagttcctgaagtacgccgccaagatcacccccagaagcgtgctgaccaccggcatcggcagcaccagcgccggcatcgtgtgcgacaacttcaagtag

SEQ ID NO: 22534 - DNA, 3432 bp, Artificial Sequence
  Description of Artificial Sequence: Synthetic coding sequence
atgaacagcgaccaggtgaccctggtgggccaggtgttcgagagctacgtgagcgagtaccacaagaacgacatcctgctgatcctgaaggagagagacgaggacgcccactaccccgtggtggtgaacgccatgaccctgttcgagaccaacatggagatcggcgagtacttcaacatgttccccagcgaggtgctgaccatcttcgacagcgccctgagaagaagcgccctgaccatcctgcagagcctgagccagcccgaggccgtgagcatgaagcagaacctgcacgccagaatcagcggcctgcccgtgtgccccgagctggtgagagagcacatccccaagaccaaggacgtgggccacttcctgagcgtgaccggcaccgtgatcagaaccagcctggtgaaggtgctggagttcgagagagactacatgtgcaacaagtgcaagcacgtgttcgtgatcaaggccgacttcgagcagtactacaccttctgcagacccagcagctgccccagcctggagagctgcgacagcagcaagttcacctgcctgagcggcctgagcagcagccccaccagatgcagagactaccaggagatcaagatccaggagcaggtgcagagactgagcgtgggcagcatccccagaagcatgaaggtgatcctggaggacgacctggtggacagctgcaagagcggcgacgacctgaccatctacggcatcgtgatgcagagatggaagcccttccagcaggacgtgagatgcgaggtggagatcgtgctgaaggccaactacatccaggtgaacaacgagcagagcagcggcatcatcatggacgaggaggtgcagaaggagttcgaggacttctgggagtactacaagagcgaccccttcgccggcagaaacgtgatcctggccagcctgtgcccccaggtgttcggcatgtacctggtgaagctggccgtggccatggtgctggccggcggcatccagagaaccgacgccaccggcaccagagtgagaggcgagagccacctgctgctggtgggcgaccccggcaccggcaagagccagttcctgaagtacgccgccaagatcacccccagaagcgtgctgaccaccggcatcggcagcaccagcgccggcctgaccgtgaccgccgtgaaggacagcggcgagtggaacctggaggccggcgccctggtgctggccgacgccggcctgtgctgcatcgacgagttcaacagcctgaaggagcacgacagaaccagcatccacgaggccatggagcagcagaccatcagcgtggccaaggccggcctggtgtgcaagctgaacaccagaaccaccatcctggccgccaccaaccccaagggccagtacgacccccaggagagcgtgagcgtgaacatcgccctgggcagccccctgctgagcagattcgacctgatcctggtgctgctggacaccaagaacgaggactgggacagaatcatcagcagcttcatcctggagaacaagggctaccccagcaagagcgagaagctgtggagcatggagaagatgaagacctacttctgcctgatcagaaacctgcagcccaccctgagcgacgtgggcaaccaggtgctgctgagatactaccagatgcagagacagagcgactgcagaaacgccgccagaaccaccatcagactgctggagagcctgatcagactggccgaggcccacgccagactgatgttcagagacaccgtgaccctggaggacgccatcaccgtggtgagcgtgatggagagcagcatgcagggcggcgccctgctgggcggcgtgaacgccctgcacaccagcttccccgagaaccccggcgagcagtaccagagacagtgcgagctgatcctggagaagctggagctgcagagcctgctgagcgaggagctgagaagactggagagactgcagaaccagagcgtgcaccagagccagcccagagtgctggaggtggagaccacccccggcagcctgagaaacggccccggcgaggagagcaacttcagaaccagcagccagcaggagatcaactacagcacccacatcttcagccccggcggcagccccgagggcagccccgtgctggacccccccccccacctggagcccaacagaagcaccagcagaaagcacagcgcccagcacaagaacaacagagacgacagcctggactggttcgacttcatggccacccaccagagcgagcccaagaacaccgtggtggtgagcccccaccccaagaccagcggcgagaacatggccagcaagatcagcaacagcaccagccagggcaaggagaagagcgagcccggccagagaagcaaggtggacatcggcctgctgcccagccccggcgagaccggcgtgccctggagagccgacaacgtggagagcaacaagaagaagagactggccctggacagcgaggccgccgtgagcgccgacaagcccgacagcgtgctgacccaccacgtgcccagaaacctgcagaagctgtgcaaggagagagcccagaagctgtgcagaaacagcaccagagtgcccgcccagtgcaccgtgcccagccacccccagagcacccccgtgcacagccccgacagaatgctggacagccccaagagaaagagacccaagagcctggcccaggtggaggagcccgccatcgagaacgtgaagccccccggcagccccgtggccaagctggccaagttcaccttcaagcagaagagcaagctgatccacagcttcgaggaccacagccacgtgagccccggcgccaccaagatcgccgtgcacagccccaagatcagccagagaagaaccagaagagacgccgccctgcccgtgaagagacccggcaagctgaccagcacccccggcaaccagatcagcagccagccccagggcgagaccaaggaggtgagccagcagccccccgagaagcacggccccagagagaaggtgatgtgcgcccccgagaagagaatcatccagcccgagctggagctgggcaacgagaccggctgcgcccacctgacctgcgagggcgacaagaaggaggaggtgagcggcagcaacaagagcggcaaggtgcacgcctgcaccctggccagactggccaacttctgcttcaccccccccagcgagagcaagagcaagagccccccccccgagagaaagaacagaggcgagagaggccccagcagcccccccaccaccaccgcccccatgagagtgagcaagagaaagagcttccagctgagaggcagcaccgagaagctgatcgtgagcaaggagagcctgttcaccctgcccgagctgggcgacgaggccttcgactgcgactgggacgaggagatgagaaagaagagctag

SEQ ID NO: 22535 - DNA, 471 bp, Artificial Sequence
  Description of Artificial Sequence: Synthetic coding sequence
atgaacagcgaccaggtgaccctggtgggccaggtgttcgagagctacgtgagcgagtaccacaagaacgacatcctgctgatcctgaaggagagagacgaggacgcccactaccccgtggtggtgaacgccatgaccctgttcgagaccaacatggagatcggcgagtacttcaacatgttccccagcgaggtgctgaccatcttcgacagcgccctgagaagaagcgccctgaccatcctgcagagcctgagccagcccgaggccgtgagcatgaagcagaacctgcacgccagaatcagcggcctgcccgtgtgccccgagctggtgagagagcacatccccaagaccaaggacgtgggccacttcctgagcgtgaccggcaccgtgatcagaaccagcctggtgaaggtgctggagttcgagagagactacatgtgcaacaagtgcaagcacgtgttcgtgatctag

SEQ ID NO: 22536 - DNA, 237 bp, Artificial Sequence
  Description of Artificial Sequence: Synthetic coding sequence
atgaacagcgaccaggtgaccctggtgggccaggtgttcgagagctacgtgagcgagtaccacaagaacgacatcctgctgatcctgaaggagagagacgaggacgcccactaccccgtggtggtgaacgccatgaccctgttcgagaccaacatggagatcggcgagtacttcaacatgttccccagcgaggtgctgaccatcttcgacagcgccctgagaagaagcgccctgtag

SEQ ID NO: 22537 - DNA, 2628 bp, Artificial Sequence
  Description of Artificial Sequence: Synthetic coding sequence
atgagcggcaccaagcccgacatcctgtgggccccccaccacgtggacagattcgtggtgtgcgacagcgagctgagcctgtaccacgtggagagcaccgtgaacagcgagctgaaggccggcagcctgagactgagcgaggacagcgccgccaccctgctgagcatcaacagcgacaccccctacatgaagtgcgtggcctggtacctgaactacgaccccgagtgcctgctggccgtgggccaggccaacggcagagtggtgctgaccagcctgggccaggaccacaacagcaagttcaaggacctgatcggcaaggagttcgtgcccaagcacgccagacagtgcaacaccctggcctggaaccccctggacagcaactggctggccgccggcctggacaagcacagagccgacttcagcgtgctgatctgggacatctgcagcaagtacacccccgacatcgtgcccatggagaaggtgaagctgagcgccggcgagaccgagaccaccctgctggtgaccaagcccctgtacgagctgggccagaacgacgcctgcctgagcctgtgctggctgcccagagaccagaagctgctgctggccggcatgcacagaaacctggccatcttcgacctgagaaacaccagccagaagatgttcgtgaacaccaaggccgtgcagggcgtgaccgtggacccctacttccacgacagagtggccagcttctacgagggccaggtggccatctgggacctgagaaagttcgagaagcccgtgctgaccctgaccgagcagcccaagcccctgaccaaggtggcctggtgccccaccagaaccggcctgctggccaccctgaccagagacagcaacatcatcagactgtacgacatgcagcacacccccacccccatcggcgacgagaccgagcccaccatcatcgagagaagcgtgcagccctgcgacaactacatcgccagcttcgcctggcaccccaccagccagaacagaatgatcgtggtgacccccaacagaaccatgagcgacttcaccgtgttcgagagaatcagcctggcctggagccccatcaccagcctgatgtgggcctgcggcagacacctgtacgagtgcaccgaggaggagaacgacaacagcctggagaaggacatcgccaccaagatgagactgagagccctgagcagatacggcctggacaccgagcaggtgtggagaaaccacatcctggccggcaacgaggacccccagctgaagagcctgtggtacaccctgcacttcatgaagcagtacaccgaggacatggaccagaagagccccggcaacaagggcagcctggtgtacgccggcatcaagagcatcgtgaagagcagcctgggcatggtggagagcagcagacacaactggagcggcctggacaagcagagcgacatccagaacctgaacgaggagagaatcctggccctgcagctgtgcggctggatcaagaagggcaccgacgtggacgtgggccccttcctgaacagcctggtgcaggagggcgagtgggagagagccgccgccgtggccctgttcaacctggacatcagaagagccatccagatcctgaacgagggcgccagcagcgagaagggcgacctgaacctgaacgtggtggccatggccctgagcggctacaccgacgagaagaacagcctgtggagagagatgtgcagcaccctgagactgcagctgaacaacccctacctgtgcgtgatgttcgccttcctgaccagcgagaccggcagctacgacggcgtgctgtacgagaacaaggtggccgtgagagacagagtggccttcgcctgcaagttcctgagcgacacccagctgaacagatacatcgagaagctgaccaacgagatgaaggaggccggcaacctggagggcatcctgctgaccggcctgaccaaggacggcgtggacctgatggagagctacgtggacagaaccggcgacgtgcagaccgccagctactgcatgctgcagggcagccccctggacgtgctgaaggacgagagagtgcagtactggatcgagaactacagaaacctgctggacgcctggagattctggcacaagagagccgagttcgacatccacagaagcaagctggaccccagcagcaagcccctggcccaggtgttcgtgagctgcaacttctgcggcaagagcatcagctacagctgcagcgccgtgccccaccagggcagaggcttcagccagtacggcgtgagcggcagccccaccaagagcaaggtgaccagctgccccggctgcagaaagcccctgcccagatgcgccctgtgcctgatcaacatgggcacccccgtgagcagctgccccggcggcaccaagagcgacgagaaggtggacctgagcaaggacaagaagctggcccagttcaacaactggttcacctggtgccacaactgcagacacggcggccacgccggccacatgctgagctggttcagagaccacgccgagtgccccgtgagcgcctgcacctgcaagtgcatgcagctggacaccaccggcaacctggtgcccgccgagaccgtgcagccctag

SEQ ID NO: 22538 - DNA, 2628 bp, Artificial Sequence; identical to SEQ ID NO: 22537
  Description of Artificial Sequence: Synthetic coding sequence

SEQ ID NO: 22539 - DNA, 195 bp, Artificial Sequence
  Description of Artificial Sequence: Synthetic coding sequence
atgagcggcaccaagcccgacatcctgtgggccccccaccacgtggacagattcgtggtgtgcgacagcgagctgagcctgtaccacgtggagagcaccgtgaacagcgagctgaaggccggcagcctgagactgagcgaggacagcgccgccaccctgctgagcatcaacagcgacaccccctacatgaagtag

SEQ ID NO: 22540 - DNA, 453 bp, Artificial Sequence
  Description of Artificial Sequence: Synthetic coding sequence
atgagcggcaccaagcccgacatcctgtgggccccccaccacgtggacagattcgtggtgtgcgacagcgagctgagcctgtaccacgtggagagcaccgtgaacagcgagctgaaggccggcagcctgagactgagcgaggacagcgccgccaccctgctgagcatcaacagcgacaccccctacatgaagtgcgtggcctggtacctgaactacgaccccgagtgcctgctggccgtgggccaggccaacggcagagtggtgctgaccagcctgggccaggaccacaacagcaagttcaaggacctgatcggcaaggagttcgtgcccaagcacgccagacagtgcaacaccctggcctggaaccccctggacagcaactggctggccgccggcctggacaagcacagagccgacttcagcgtgctgatctgggacatctgcagcaagtag

SEQ ID NO: 22541 - DNA, 195 bp, Artificial Sequence; identical to SEQ ID NO: 22539
  Description of Artificial Sequence: Synthetic coding sequence

SEQ ID NO: 22542 - DNA, 540 bp, Artificial Sequence
  Description of Artificial Sequence: Synthetic coding sequence
atgagcggcaccaagcccgacatcctgtgggccccccaccacgtggacagattcgtggtgtgcgacagcgagctgagcctgtaccacgtggagagcaccgtgaacagcgagctgaaggccggcagcctgagactgagcgaggacagcgccgccaccctgctgagcatcaacagcgacaccccctacatgaagtgcgtggcctggtacctgaactacgaccccgagtgcctgctggccgtgggccaggccaacggcagagtggtgctgaccagcctgggccaggaccacaacagcaagttcaaggacctgatcggcaaggagttcgtgcccaagcacgccagacagtgcaacaccctggcctggaaccccctggacagcaactggctggccgccggcctggacaagcacagagccgacttcagcgtgctgatctgggacatctgcagcaagtacacccccgacatcgtgcccatggagaaggtgaagctgagcgccggcgagaccgagaccaccctgctggtgaccaagcccctgtactag

SEQ ID NO: 22543 - DNA, 789 bp, Artificial Sequence
  Description of Artificial Sequence: Synthetic coding sequence
atggccctgggcctgaagtgcagcagaatggtgcaccccgccttcagaaactacctggccgccagcatcagacccgtgagcgaggtgaccctgaagaaggtgtacgagagacagcacggccacagacagtacgtggcctacagcgccgtgcccgtgcaccacttcgccaccaagaaggccaaggccaagggcaagggcaagagccagaccagagtgaacatcagcgccgccttcgtggaggacatcatcaacctggaggaggtgaacgaggagatgaagagcgtgatcgaggccagaaaggacaacttcaacaagaccctgaacatcggcaccagccccggcagcctggacaagatcgccgtggtgaccgccgacggcaagctggccctgaaccagatcagacagatcagcgtgaagctgccccagctgatcctggtgaacatggccagcttccccgagttcaccgtggccgccatcaaggccatcagagagagcggcatgaacctgaaccccgaggtggagggcaccctgatcagagtgcccatcccccaggtgatcagagagcacagagagatgctggtgaagctggccaagcagaacaccaacaaggccacctacagcctgagaaaggtgtgcaccaacgccatgaacaagctgaagaagagcaaggacaccgtgagcgagggcaccatcagactgaccgagaagcagatcagccagatggccgacgacaccgtggccgagctgtacagacacctggccgtgaagaccaaggagctgctgggctag

SEQ ID NO: 22544 - DNA, 738 bp, Artificial Sequence
  Description of Artificial Sequence: Synthetic coding sequence
atgagcgacgagttcagcctggccgacgccctgcccgagcacagccccgccaagaccagcgccgtgagcaacaccaagcccggccagcccccccagggctggcccggcagcaacccctggaacaaccccagcgcccccagcagcgtgcccagcggcctgccccccagcgccacccccagcaccgtgcccttcggccccgcccccaccggcatgtaccccagcgtgccccccaccggccccccccccggcccccccgcccccttcccccccagcggccccagctgccccccccccggcggcccctaccccgcccccaccgtgcccggccccggccccaccggcccctaccccacccccaacatgcccttccccgagctgcccagaccctacggcgcccccaccgaccccgccgccgccggccccctgggcccctggggcagcatgagcagcggcccctgggcccccggcatgggcggccagtaccccacccccaacatgccctaccccagccccggcccctaccccgcccccccccccccccaggcccccggcgccgccccccccgtgccctggggcaccgtgccccccggcgcctggggcccccccgccccctaccccgcccccaccggcagctaccccacccccggcctgtaccccacccccagcaaccccttccaggtgcccagcggccccagcggcgccccccccatgcccggcggcccccacagctaccactag

SEQ ID NO: 22545 - DNA, 690 bp, Artificial Sequence
  Description of Artificial Sequence: Synthetic coding sequence
atgagcagccacctggtggagccccccccccccctgcacaacaacaacaacaactgcgaggagaacgagcagagcctgcccccccccgccggcctgaacagcagctgggtggagctgcccatgaacagcagcaacggcaacgacaacggcaacggcaagaacggcggcctggagcacgtgcccagcagcagcagcatccacaacggcgacatggagaagatcctgctggacgcccagcacgagagcggccagagcagcagcagaggcagcagccactgcgacagccccagcccccaggaggacggccagatcatgttcgacgtggagatgcacaccagcagagaccacagcagccagagcgaggaggaggtggtggagggcgagaaggaggtggaggccctgaagaagagcgccgactgggtgagcgactggagcagcagacccgagaacatcccccccaaggagttccacttcagacaccccaagagaagcgtgagcctgagcatgagaaagagcggcgccatgaagaagggcggcatcttcagcgccgagttcctgaaggtgttcatccccagcctgttcctgagccacgtgctggccctgggcctgggcatctacatcggcaagagactgagcaccccctgccagcacctgctgagagagagaaagagcccctggaagtgcgtgtag

SEQ ID NO: 22546 - DNA, 4044 bp, Artificial Sequence
  Description of Artificial Sequence: Synthetic coding sequence
atgcccgccgtgagagtgtgggacgtggccgagcacagccaggtggccgagctgcaggagcacaagtacggcgtggcctgcgtggccttcagccccagcgccaagtacatcgtgagcgtgggctaccagcacgacatgatcgtgaacgtgtgggcctggaagaagaacatcgtggtggccagcaacaaggtgagcagcagagtgaccgccgtgagcttcagcgaggactgcagctacttcgtgaccgccggcaacagacacatcaagttctggtacctggacgacagcaagaccagcaaggtgaacgccaccgtgcccctgctgggcagaagcggcctgctgggcgagctgagaaacaacctgttcaccgacgtggcctgcggcagaggcaagaaggccgacagcaccttctgcatcaccagcagcggcctgctgtgcgagttcagcgacagaagactgctggacaagtgggtggagctgagaaccaccgtggcccactgcatcagcgtgagccaggactacatcttctgcggctgcgccgacggcaccgtgagactgttcaaccccagcaacctgcacttcctgagcaccctgcccagaccccacgccctgggcaccgacatcgccagcgtgaccgaggccagcagactgttcagcggcgtggccaacgccagataccccgacaccatcgccctgaccttcgaccccaccaaccagtggctgagctgcgtgtacaacgaccacagcatctacgtgtgggacgtgagagaccccaagaaggtgggcaaggtgtacagcgccctgtaccacagcagctgcgtgtggagcgtggaggacctgatcaagatcatctacgtggacggcaacacccaggccctgctggacaccgagctgcccggcggcgacaaggccgacgccagcctgctggaccccagagtgggcatcagaagcgtgtgcgtgagccccaacggccagcacctggccagcggcgacagaatgggcaccctgagagtgcacgagctgcagagcctgagcgagatgctgaaggtggaggcccacgacagcgagatcctgtgcctggagtacagcaagcccgacaccggcctgaagctgctggccagcgccagcagagacagactgatccacgtgctggacgccggcagagagtacagcctgcagcagaccctggacgagcacagcagcagcatcaccgccgtgaagttcgccgccagcgacggccaggtgagaatgatcagctgcggcgccgacaagagcatctacttcagaaccgcccagaagagcggcgacggcgtgcagttcaccagaacccaccacgtggtgagaaagaccaccctgtacgacatggacgtggagcccagctggaagtacaccgccatcggctgccaggacagaaacatcagaatcttcaacatcagcagcggcaagcagaagaagctgttcaagggcagccagggcgaggacggcaccctgatcaaggtgcagaccgaccccagcggcatctacatcgccaccagctgcagcgacaagaacctgagcatcttcgacttcagcagcggcgagtgcgtggccaccatgttcggccacagcgagatcgtgaccggcatgaagttcagcaacgactgcaagcacctgatcagcgtgagcggcgacagctgcatcttcgtgtggagactgagcagcgagatgaccatcagcatgagacagagactggccgagctgagacagagacagagaggcggcaagcagcagggccccagcagcccccagagagccagcggccccaacagacaccaggcccccagcatgctgagccccggccccgccctgagcagcgacagcgacaaggagggcgaggacgagggcaccgaggaggagctgcccgccctgcccgtgctggccaagagcaccaagaaggccctggccagcgtgcccagccccgccctgcccagaagcctgagccactgggagatgagcagagcccaggagagcgtgggcttcctggaccccgcccccgccgccaaccccggccccagaagaagaggcagatgggtgcagcccggcgtggagctgagcgtgagaagcatgctggacctgagacagctggagaccctggcccccagcctgcaggaccccagccaggacagcctggccatcatccccagcggccccagaaagcacggccaggaggccctggagaccagcctgaccagccagaacgagaagccccccagaccccaggccagccagccctgcagctacccccacatcatcagactgctgagccaggaggagggcgtgttcgcccaggacctggagcccgcccccatcgaggacggcatcgtgtaccccgagcccagcgacaaccccaccatggacaccagcgagttccaggtgcaggcccccgccagaggcaccctgggcagagtgtaccccggcagcagaagcagcgagaagcacagccccgacagcgcctgcagcgtggactacagcagcagctgcctgagcagccccgagcaccccaccgaggacagcgagagcaccgagcccctgagcgtggacggcatcagcagcgacctggaggagcccgccgagggcgacgaggaggaggaggaggaggagggcggcatgggcccctacggcctgcaggagggcagcccccagacccccgaccaggagcagttcctgaagcagcacttcgagaccctggccagcggcgccgcccccggcgcccccgtgcaggtgcccgagagaagcgagagcagaagcatcagcagcagattcctgctgcaggtgcagaccagacccctgagagagcccagccccagcagcagcagcctggccctgatgagcagacccgcccaggtgccccaggccagcggcgagcagcccagaggcaacggcgccaacccccccggcgccccccccgaggtggagcccagcagcggcaaccccagcccccagcaggccgccagcgtgctgctgcccagatgcagactgaaccccgacagcagctgggcccccaagagagtggccaccgccagccccttcagcggcctgcagaaggcccagagcgtgcacagcctggtgccccaggagagacacgaggccagcctgcaggcccccagccccggcgccctgctgagcagagagatcgaggcccaggacggcctgggcagcctgccccccgccgacggcagacccagcagaccccacagctaccagaaccccaccaccagcagcatggccaagatcagcagaagcatcagcgtgggcgagaacctgggcctggtggccgagccccaggcccacgcccccatcagagtgagccccctgagcaagctggccctgcccagcagagcccacctggtgctggacatccccaagcccctgcccgacagacccaccctggccgccttcagccccgtgaccaagggcagagcccccggcgaggccgagaagcccggcttccccgtgggcctgggcaaggcccacagcaccaccgagagatgggcctgcctgggcgagggcaccacccccaagcccagaaccgagtgccaggcccaccccggccccagcagcccctgcgcccagcagctgcccgtgagcagcctgttccagggccccgagaacctgcagccccccccccccgagaagacccccaaccccatggagtgcaccaagcccggcgccgccctgagccaggacagcgagcccgccgtgagcctggagcagtgcgagcagctggtggccgagctgagaggcagcgtgagacaggccgtgagactgtaccacagcgtggccggctgcaagatgcccagcgccgagcagagcagaatcgcccagctgctgagagacaccttcagcagcgtgagacaggagctggaggccgtggccggcgccgtgctgagcagccccggcagcagccccggcgccgtgggcgccgagcagacccaggccctgctggagcagtacagcgagctgctgctgagagccgtggagagaagaatggagagaaagctgtag

SEQ ID NO: 22547 - DNA, 4545 bp, Artificial Sequence
  Description of Artificial Sequence: Synthetic coding sequence
atggccgtggagggcagcaccatcaccagcagaatcaagaacctgctgagaagccccagcatcaagctgagaagaagcaaggccggcaacagaagagaggacctgagcagcaaggtgaccctggagaaggtgctgggcatcaccgtgagcggcggcagaggcctggcctgcgaccccagaagcggcctggtggcctaccccgccggctgcgtggtggtgctgttcaaccccagaaagcacaagcagcaccacatcctgaacagcagcagaaagaccatcaccgccctggccttcagccccgacggcaagtacctggtgaccggcgagagcggccacatgcccgccgtgagagtgtgggacgtggccgagcacagccaggtggccgagctgcaggagcacaagtacggcgtggcctgcgtggccttcagccccagcgccaagtacatcgtgagcgtgggctaccagcacgacatgatcgtgaacgtgtgggcctggaagaagaacatcgtggtggccagcaacaaggtgagcagcagagtgaccgccgtgagcttcagcgaggactgcagctacttcgtgaccgccggcaacagacacatcaagttctggtacctggacgacagcaagaccagcaaggtgaacgccaccgtgcccctgctgggcagaagcggcctgctgggcgagctgagaaacaacctgttcaccgacgtggcctgcggcagaggcaagaaggccgacagcaccttctgcatcaccagcagcggcctgctgtgcgagttcagcgacagaagactgctggacaagtgggtggagctgagaaacatcgacagcttcaccaccaccgtggcccactgcatcagcgtgagccaggactacatcttctgcggctgcgccgacggcaccgtgagactgttcaaccccagcaacctgcacttcctgagcaccctgcccagaccccacgccctgggcaccgacatcgccagcgtgaccgaggccagcagactgttcagcggcgtggccaacgccagataccccgacaccatcgccctgaccttcgaccccaccaaccagtggctgagctgcgtgtacaacgaccacagcatctacgtgtgggacgtgagagaccccaagaaggtgggcaaggtgtacagcgccctgtaccacagcagctgcgtgtggagcgtggaggtgtaccccgaggtgaaggacagcaaccaggcctgcctgccccccagcagcttcatcacctgcagcagcgacaacaccatcagactgtggaacaccgagagcagcggcgtgcacggcagcaccctgcacagaaacatcctgagcagcgacctgatcaagatcatctacgtggacggcaacacccaggccctgctggacaccgagctgcccggcggcgacaaggccgacgccagcctgctggaccccagagtgggcatcagaagcgtgtgcgtgagccccaacggccagcacctggccagcggcgacagaatgggcaccctgagagtgcacgagctgcagagcctgagcgagatgctgaaggtggaggcccacgacagcgagatcctgtgcctggagtacagcaagcccgacaccggcctgaagctgctggccagcgccagcagagacagactgatccacgtgctggacgccggcagagagtacagcctgcagcagaccctggacgagcacagcagcagcatcaccgccgtgaagttcgccgccagcgacggccaggtgagaatgatcagctgcggcgccgacaagagcatctacttcagaaccgcccagaagagcggcgacggcgtgcagttcaccagaacccaccacgtggtgagaaagaccaccctgtacgacatggacgtggagcccagctggaagtacaccgccatcggctgccaggacagaaacatcagaatcttcaacatcagcagcggcaagcagaagaagctgttcaagggcagccagggcgaggacggcaccctgatcaaggtgcagaccgaccccagcggcatctacatcgccaccagctgcagcgacaagaacctgagcatcttcgacttcagcagcggcgagtgcgtggccaccatgttcggccacagcgagatcgtgaccggcatgaagttcagcaacgactgcaagcacctgatcagcgtgagcggcgacagctgcatcttcgtgtggagactgagcagcgagatgaccatcagcatgagacagagactggccgagctgagacagagacagagaggcggcaagcagcagggccccagcagcccccagagagccagcggccccaacagacaccaggcccccagcatgctgagccccggccccgccctgagcagcgacagcgacaaggagggcgaggacgagggcaccgaggaggagctgcccgccctgcccgtgctggccaagagcaccaagaaggccctggccagcgtgcccagccccgccctgcccagaagcctgagccactgggagatgagcagagcccaggagagcgtgggcttcctggaccccgcccccgccgccaaccccggccccagaagaagaggcagatgggtgcagcccggcgtggagctgagcgtgagaagcatgctggacctgagacagctggagaccctggcccccagcctgcaggaccccagccaggacagcctggccatcatccccagcggccccagaaagcacggccaggaggccctggagaccagcctgaccagccagaacgagaagccccccagaccccaggccagccagccctgcagctacccccacatcatcagactgctgagccaggaggagggcgtgttcgcccaggacctggagcccgcccccatcgaggacggcatcgtgtaccccgagcccagcgacaaccccaccatggacaccagcgagttccaggtgcaggcccccgccagaggcaccctgggcagagtgtaccccggcagcagaagcagcgagaagcacagccccgacagcgcctgcagcgtggactacagcagcagctgcctgagcagccccgagcaccccaccgaggacagcgagagcaccgagcccctgagcgtggacggcatcagcagcgacctggaggagcccgccgagggcgacgaggaggaggaggaggaggagggcggcatgggcccctacggcctgcaggagggcagcccccagacccccgaccaggagcagttcctgaagcagcacttcgagaccctggccagcggcgccgcccccggcgcccccgtgcaggtgcccgagagaagcgagagcagaagcatcagcagcagattcctgctgcaggtgcagaccagacccctgagagagcccagccccagcagcagcagcctggccctgatgagcagacccgcccaggtgccccaggccagcggcgagcagcccagaggcaacggcgccaacccccccggcgccccccccgaggtggagcccagcagcggcaaccccagcccccagcaggccgccagcgtgctgctgcccagatgcagactgaaccccgacagcagctgggcccccaagagagtggccaccgccagccccttcagcggcctgcagaaggcccagagcgtgcacagcctggtgccccaggagagacacgaggccagcctgcaggcccccagccccggcgccctgctgagcagagagatcgaggcccaggacggcctgggcagcctgccccccgccgacggcagacccagcagaccccacagctaccagaaccccaccaccagcagcatggccaagatcagcagaagcatcagcgtgggcgagaacctgggcctggtggccgagccccaggcccacgcccccatcagagtgagccccctgagcaagctggccctgcccagcagagcccacctggtgctggacatccccaagcccctgcccgacagacccaccctggccgccttcagccccgtgaccaagggcagagcccccggcgaggccgagaagcccggcttccccgtgggcctgggcaaggcccacagcaccaccgagagatgggcctgcctgggcgagggcaccacccccaagcccagaaccgagtgccaggcccaccccggccccagcagcccctgcgcccagcagctgcccgtgagcagcctgttccagggccccgagaacctgcagccccccccccccgagaagacccccaaccccatggagtgcaccaagcccggcgccgccctgagccaggacagcgagcccgccgtgagcctggagcagtgcgagcagctggtggccgagctgagaggcagcgtgagacaggccgtgagactgtaccacagcgtggccggctgcaagatgcccagcgccgagcagagcagaatcgcccagctgctgagagacaccttcagcagcgtgagacaggagctggaggccgtggccggcgccgtgctgagcagccccggcagcagccccggcgccgtgggcgccgagcagacccaggccctgctggagcagtacagcgagctgctgctgagagccgtggagagaagaatggagagaaagctgtag

SEQ ID NO: 22548 - DNA, 4527 bp, Artificial Sequence
  Description of Artificial Sequence: Synthetic coding sequence
atggccgtggagggcagcaccatcaccagcagaatcaagaacctgctgagaagccccagcatcaagctgagaagaagcaaggccggcaacagaagagaggacctgagcagcaaggtgaccctggagaaggtgctgggcatcaccgtgagcggcggcagaggcctggcctgcgaccccagaagcggcctggtggcctaccccgccggctgcgtggtggtgctgttcaaccccagaaagcacaagcagcaccacatcctgaacagcagcagaaagaccatcaccgccctggccttcagccccgacggcaagtacctggtgaccggcgagagcggccacatgcccgccgtgagagtgtgggacgtggccgagcacagccaggtggccgagctgcaggagcacaagtacggcgtggcctgcgtggccttcagccccagcgccaagtacatcgtgagcgtgggctaccagcacgacatgatcgtgaacgtgtgggcctggaagaagaacatcgtggtggccagcaacaaggtgagcagcagagtgaccgccgtgagcttcagcgaggactgcagctacttcgtgaccgccggcaacagacacatcaagttctggtacctggacgacagcaagaccagcaaggtgaacgccaccgtgcccctgctgggcagaagcggcctgctgggcgagctgagaaacaacctgttcaccgacgtggcctgcggcagaggcaagaaggccgacagcaccttctgcatcaccagcagcggcctgctgtgcgagttcagcgacagaagactgctggacaagtgggtggagctgagaaccaccgtggcccactgcatcagcgtgagccaggactacatcttctgcggctgcgccgacggcaccgtgagactgttcaaccccagcaacctgcacttcctgagcaccctgcccagaccccacgccctgggcaccgacatcgccagcgtgaccgaggccagcagactgttcagcggcgtggccaacgccagataccccgacaccatcgccctgaccttcgaccccaccaaccagtggctgagctgcgtgtacaacgaccacagcatctacgtgtgggacgtgagagaccccaagaaggtgggcaaggtgtacagcgccctgtaccacagcagctgcgtgtggagcgtggaggtgtaccccgaggtgaaggacagcaaccaggcctgcctgccccccagcagcttcatcacctgcagcagcgacaacaccatcagactgtggaacaccgagagcagcggcgtgcacggcagcaccctgcacagaaacatcctgagcagcgacctgatcaagatcatctacgtggacggcaacacccaggccctgctggacaccgagctgcccggcggcgacaaggccgacgccagcctgctggaccccagagtgggcatcagaagcgtgtgcgtgagccccaacggccagcacctggccagcggcgacagaatgggcaccctgagagtgcacgagctgcagagcctgagcgagatgctgaaggtggaggcccacgacagcgagatcctgtgcctggagtacagcaagcccgacaccggcctgaagctgctggccagcgccagcagagacagactgatccacgtgctggacgccggcagagagtacagcctgcagcagaccctggacgagcacagcagcagcatcaccgccgtgaagttcgccgccagcgacggccaggtgagaatgatcagctgcggcgccgacaagagcatctacttcagaaccgcccagaagagcggcgacggcgtgcagttcaccagaacccaccacgtggtgagaaagaccaccctgtacgacatggacgtggagcccagctggaagtacaccgccatcggctgccaggacagaaacatcagaatcttcaacatcagcagcggcaagcagaagaagctgttcaagggcagccagggcgaggacggcaccctgatcaaggtgcagaccgaccccagcggcatctacatcgccaccagctgcagcgacaagaacctgagcatcttcgacttcagcagcggcgagtgcgtggccaccatgttcggccacagcgagatcgtgaccggcatgaagttcagcaacgactgcaagcacctgatcagcgtgagcggcgacagctgcatcttcgtgtggagactgagcagcgagatgaccatcagcatgagacagagactggccgagctgagacagagacagagaggcggcaagcagcagggccccagcagcccccagagagccagcggccccaacagacaccaggcccccagcatgctgagccccggccccgccctgagcagcgacagcgacaaggagggcgaggacgagggcaccgaggaggagctgcccgccctgcccgtgctggccaagagcaccaagaaggccctggccagcgtgcccagccccgccctgcccagaagcctgagccactgggagatgagcagagcccaggagagcgtgggcttcctggaccccgcccccgccgccaaccccggccccagaagaagaggcagatgggtgcagcccggcgtggagctgagcgtgagaagcatgctggacctgagacagctggagaccctggcccccagcctgcaggaccccagccaggacagcctggccatcatccccagcggccccagaaagcacggccaggaggccctggagaccagcctgaccagccagaacgagaagccccccagaccccaggccagccagccctgcagctacccccacatcatcagactgctgagccaggaggagggcgtgttcgcccaggacctggagcccgcccccatcgaggacggcatcgtgtaccccgagcccagcgacaaccccaccatggacaccagcgagttccaggtgcaggcccccgccagaggcaccctgggcagagtgtaccccggcagcagaagcagcgagaagcacagccccgacagcgcctgcagcgtggactacagcagcagctgcctgagcagccccgagcaccccaccgaggacagcgagagcaccgagcccctgagcgtggacggcatcagcagcgacctggaggagcccgccgagggcgacgaggaggaggaggaggaggagggcggcatgggcccctacggcctgcaggagggcagcccccagacccccgaccaggagcagttcctgaagcagcacttcgagaccctggccagcggcgccgcccccggcgcccccgtgcaggtgcccgagagaagcgagagcagaagcatcagcagcagattcctgctgcaggtgcagaccagacccctgagagagcccagccccagcagcagcagcctggccctgatgagcagacccgcccaggtgccccaggccagcggcgagcagcccagaggcaacggcgccaacccccccggcgccccccccgaggtggagcccagcagcggcaaccccagcccccagcaggccgccagcgtgctgctgcccagatgcagactgaaccccgacagcagctgggcccccaagagagtggccaccgccagccccttcagcggcctgcagaaggcccagagcgtgcacagcctggtgccccaggagagacacgaggccagcctgcaggcccccagccccggcgccctgctgagcagagagatcgaggcccaggacggcctgggcagcctgccccccgccgacggcagacccagcagaccccacagctaccagaaccccaccaccagcagcatggccaagatcagcagaagcatcagcgtgggcgagaacctgggcctggtggccgagccccaggcccacgcccccatcagagtgagccccctgagcaagctggccctgcccagcagagcccacctggtgctggacatccccaagcccctgcccgacagacccaccctggccgccttcagccccgtgaccaagggcagagcccccggcgaggccgagaagcccggcttccccgtgggcctgggcaaggcccacagcaccaccgagagatgggcctgcctgggcgagggcaccacccccaagcccagaaccgagtgccaggcccaccccggccccagcagcccctgcgcccagcagctgcccgtgagcagcctgttccagggccccgagaacctgcagccccccccccccgagaagacccccaaccccatggagtgcaccaagcccggcgccgccctgagccaggacagcgagcccgccgtgagcctggagcagtgcgagcagctggtggccgagctgagaggcagcgtgagacaggccgtgagactgtaccacagcgtggccggctgcaagatgcccagcgccgagcagagcagaatcgcccagctgctgagagacaccttcagcagcgtgagacaggagctggaggccgtggccggcgccgtgctgagcagccccggcagcagccccggcgccgtgggcgccgagcagacccaggccctgctggagcagtacagcgagctgctgctgagagccgtggagagaagaatggagagaaagctgtag

SEQ ID NO: 22549 - DNA, 471 bp, Artificial Sequence
  Description of Artificial Sequence: Synthetic coding sequence
atggccgtggagggcagcaccatcaccagcagaatcaagaacctgctgagaagccccagcatcaagctgagaagaagcaaggccggcaacagaagagaggacctgagcagcaaggtgaccctggagaaggtgctgggcatcaccgtgagcggcggcagaggcctggcctgcgaccccagaagcggcctggtggcctaccccgccggctgcgtggtggtgctgttcaaccccagaaagcacaagcagcaccacatcctgaacagcagcagaaagaccatcaccgccctggccttcagccccgacggcaagtacctggtgaccggcgagagcggccacatgcccgccgtgagagtgtgggacgtggccgagcacagccaggtggccgagctgcaggagcacaagtacggcgtggcctgcgtggccttcagccccagcgccaagtacatcgtgagcgtgggctaccagcactag

SEQ ID NO: 22550 - DNA, 3696 bp, Artificial Sequence
  Description of Artificial Sequence: Synthetic coding sequence
atggccgtggagggcagcaccatcaccagcagaatcaagaacctgctgagaagccccagcatcaagctgagaagaagcaaggccggcaacagaagagaggacctgagcagcaaggtgaccctggagaaggtgctgggcatcaccgtgagcggcggcagaggcctggcctgcgaccccagaagcggcctggtggcctaccccgccggctgcgtggtggtgctgttcaaccccagaaagcacaagcagcaccacatcctgaacagcagcagaaagaccatcaccgccctggccttcagccccgacggcaagtacctggtgaccggcgagagcggccacatgcccgccgtgagagtgtgggacgtggccgagcacagccaggtggccgagctgcaggagcacaagtacggcgtggcctgcgtggccttcagccccagcgccaagtacatcgtgagcgtgggctaccagcacgacatgatcgtgaacgtgtgggcctggaagaagaacatcgtggtggccagcaacaaggtgagcagcagagtgaccgccgtgagcttcagcgaggactgcagctacttcgtgaccgccggcaacagacacatcaagttctggtacctggacgacagcaagaccagcaaggtgaacgccaccgtgcccctgctgggcagaagcggcctgctgggcgagctgagaaacaacctgttcaccgacgtggcctgcggcagaggcaagaaggccgacagcaccttctgcatcaccagcagcggcctgctgtgcgagttcagcgacagaagactgctggacaagtgggtggagctgagaaccaccgtggcccactgcatcagcgtgagccaggactacatcttctgcggctgcgccgacggcaccgtgagactgttcaaccccagcaacctgcacttcctgagcaccctgcccagaccccacgccctgggcaccgacatcgccagcgtgaccgaggccagcagactgttcagcggcgtggccaacgccagataccccgacaccatcgccctgaccttcgaccccaccaaccagtggctgagctgcgtgtacaacgaccacagcatctacgtgtgggacgtgagagaccccaagaaggtgggcaaggtgtacagcgccctgtaccacagcagctgcgtgtggagcgtggaggtgtaccccgaggtgaaggacagcaaccaggcctgcctgccccccagcagcttcatcacctgcagcagcgacaacaccatcagactgtggaacaccgagagcagcggcgtgcacggcagcaccctgcacagaaacatcctgagcagcgacctgatcaagatcatctacgtggacggcaacacccaggccctgctggacaccgagctgcccggcggcgacaaggccgacgccagcctgctggaccccagagtgggcatcagaagcgtgtgcgtgagccccaacggccagcacctggccagcggcgacagaatgggcaccctgagagtgcacgagctgcagagcctgagcgagatgctgaaggtggaggcccacgacagcgagatcctgtgcctggagtacagcaagcccgacaccggcctgaagctgctggccagcgccagcagagacagactgatccacgtgctggacgccggcagagagtacagcctgcagcagaccctggacgagcacagcagcagcatcaccgccgtgaagttcgccgccagcgacggccaggtgagaatgatcagctgcggcgccgacaagagcatctacttcagaaccgcccagaagagcggcgacggcgtgcagttcaccagaacccaccacgtggtgagaaagaccaccctgtacgacatggacgtggagcccagctggaagtacaccgccatcggctgccaggacagaaacatcagaatcttcaacatcagcagcggcaagcagaagaagctgttcaagggcagccagggcgaggacggcaccctgatcaaggtgcagaccgaccccagcggcatctacatcgccaccagctgcagcgacaagaacctgagcatcttcgacttcagcagcggcgagtgcgtggccaccatgttcggccacagcgagatcgtgaccggcatgaagttcagcaacgactgcaagcacctgatcagcgtgagcggcgacagctgcatcttcgtgtggagactgagcagcgagatgaccatcagcatgagacagagactggccgagctgagacagagacagagaggcggcaagcagcagggccccagcagcccccagagagccagcggccccaacagacaccaggcccccagcatgctgagccccggccccgccctgagcagcgacagcgacaaggagggcgaggacgagggcaccgaggaggagctgcccgccctgcccgtgctggccaagagcaccaagaaggccctggccagcgtgcccagccccgccctgcccagaagcctgagccactgggagatgagcagagcccaggagagcgtgggcttcctggaccccgcccccgccgccaaccccggccccagaagaagaggcagatgggtgcagcccggcgtggagctgagcgtgagaagcatgctggacctgagacagctggagaccctggcccccagcctgcaggaccccagccaggacagcctggccatcatccccagcggccccagaaagcacggccaggaggccctggagaccagcctgaccagccagaacgagaagccccccagaccccaggccagccagccctgcagctacccccacatcatcagactgctgagccaggaggagggcgtgttcgcccaggacctggagcccgcccccatcgaggacggcatcgtgtaccccgagcccagcgacaaccccaccatggacaccagcgagttccaggtgcaggcccccgccagaggcaccctgggcagagtgtaccccggcagcagaagcagcgagaagcacagccccgacagcgcctgcagcgtggactacagcagcagctgcctgagcagccccgagcaccccaccgaggacagcgagagcaccgagcccctgagcgtggacggcatcagcagcgacctggaggagcccgccgagggcgacgaggaggaggaggaggaggagggcggcatgggcccctacggcctgcaggagggcagcccccagacccccgaccaggagcagttcctgaagcagcacttcgagaccctggccagcggcgccgcccccggcgcccccgtgcaggtgcccgagagaagcgagagcagaagcatcagcagcagattcctgctgcaggtgcagaccagacccctgagagagcccagccccagcagcagcagcctggccctgatgagcagacccgcccaggtgccccaggccagcgagcccgccgtgagcctggagcagtgcgagcagctggtggccgagctgagaggcagcgtgagacaggccgtgagactgtaccacagcgtggccggctgcaagatgcccagcgccgagcagagcagaatcgcccagctgctgagagacaccttcagcagcgtgagacaggagctggaggccgtggccggcgccgtgctgagcagccccggcagcagccccggcgccgtgggcgccgagcagacccaggccctgctggagcagtacagcgagctgctgctgagagccgtggagagaagaatggagagaaagctgtag

SEQ ID NO: 22551 - DNA, 2685 bp, Artificial Sequence
  Description of Artificial Sequence: Synthetic coding sequence
atgaaccccggcttcgacctgagcagaagaaacccccaggaggacttcgagctgatccagagaatcggcagcggcacctacggcgacgtgtacaaggccagaaacgtgaacaccggcgagctggccgccatcaaggtgatcaagctggagcccggcgaggacttcgccgtggtgcagcaggagatcatcatgatgaaggactgcaagcaccccaacatcgtggcctacttcggcagctacctgagaagagacaagctgtggatctgcatggagttctgcggcggcggcagcctgcaggacatctaccacgtgaccggccccctgagcgagctgcagatcgcctacgtgagcagagagaccctgcagggcctgtactacctgcacagcaagggcaagatgcacagagacatcaagggcgccaacatcctgctgaccgacaacggccacgtgaagctggccgacttcggcgtgagcgcccagatcaccgccaccatcgccaagagaaagagcttcatcggcaccccctactggatggcccccgaggtggccgccgtggagagaaagggcggctacaaccagctgtgcgacctgtgggccgtgggcatcaccgccatcgagctggccgagctgcagccccccatgttcgacctgcaccccatgagagccctgttcctgatgaccaagagcaacttccagccccccaagctgaaggacaagatgaagtggagcaacagcttccaccacttcgtgaagatggccctgaccaagaaccccaagaagagacccaccgccgagaagctgctgcagcaccccttcgtgacccagcacctgaccagaagcctggccatcgagctgctggacaaggtgaacaaccccgaccacagcacctaccacgacttcgacgacgacgaccccgagcccctggtggccgtgccccacagaatccacagcaccagcagaaacgtgagagaggagaagaccagaagcgagatcaccttcggccaggtgaagttcgacccccccctgagaaaggagaccgagccccaccacgagctgcccgacagcgacggcttcctggacagcagcgaggagatctactacaccgccagaagcaacctggacctgcagctggagtacggccagggccaccagggcggctacttcctgggcgccaacaagagcctgctgaagagcgtggaggaggagctgcaccagagaggccacgtggcccacctggaggacgacgagggcgacgacgacgagagcaagcacagcaccctgaaggccaagatccccccccccctgccccccaagcccaagagcatcttcatcccccaggagatgcacagcaccgaggacgagaaccagggcaccatcaagagatgccccatgagcggcagccccgccaagcccagccaggtgccccccagaccccccccccccagactgcccccccacaagcccgtggccctgggcaacggcatgagcagcttccagctgaacggcgagagagacggcagcctgtgccagcagcagaacgagcacagaggcaccaacctgagcagaaaggagaagaaggacgtgcccaagcccatcagcaacggcctgccccccacccccaaggtgcacatgggcgcctgcttcagcaaggtgttcaacggctgccccctgaagatccactgcgccagcagctggatcaaccccgacaccagagaccagtacctgatcttcggcgccgaggagggcatctacaccctgaacctgaacgagctgcacgagaccagcatggagcagctgttccccagaagatgcacctggctgtacgtgatgaacaactgcctgctgagcatcagcggcaaggccagccagctgtacagccacaacctgcccggcctgttcgactacgccagacagatgcagaagctgcccgtggccatccccgcccacaagctgcccgacagaatcctgcccagaaagttcagcgtgagcgccaagatccccgagaccaagtggtgccagaagtgctgcgtggtgagaaacccctacaccggccacaagtacctgtgcggcgccctgcagaccagcatcgtgctgctggagtgggtggagcccatgcagaagttcatgctgatcaagcacatcgacttccccatcccctgccccctgagaatgttcgagatgctggtggtgcccgagcaggagtaccccctggtgtgcgtgggcgtgagcagaggcagagacttcaaccaggtggtgagattcgagaccgtgaaccccaacagcaccagcagctggttcaccgagagcgacaccccccagaccaacgtgacccacgtgacccagctggagagagacaccatcctggtgtgcctggactgctgcatcaagatcgtgaacctgcagggcagactgaagagcagcagaaagctgagcagcgagctgaccttcgacttccagatcgagagcatcgtgtgcctgcaggacagcgtgctggccttctggaagcacggcatgcagggcagaagcttcagaagcaacgaggtgacccaggagatcagcgacagcaccagaatcttcagactgctgggcagcgacagagtggtggtgctggagagcagacccaccgacaaccccaccgccaacagcaacctgtacatcctggccggccacgagaacagctactag

SEQ ID NO: 22552 - DNA, 2622 bp, Artificial Sequence
  Description of Artificial Sequence: Synthetic coding sequence
atgaaccccggcttcgacctgagcagaagaaacccccaggaggacttcgagctgatccagagaatcggcagcggcacctacggcgacgtgtacaaggccagaaacgtgaacaccggcgagctggccgccatcaaggtgatcaagctggagcccggcgaggacttcgccgtggtgcagcaggagatcatcatgatgaaggactgcaagcaccccaacatcgtggcctacttcggcagctacctgagaagagacaagctgtggatctgcatggagttctgcggcggcggcagcctgcaggacatctaccacgtgaccggccccctgagcgagctgcagatcgcctacgtgagcagagagaccctgcagggcctgtactacctgcacagcaagggcaagatgcacagagacatcaagggcgccaacatcctgctgaccgacaacggccacgtgaagctggccgacttcggcgtgagcgcccagatcaccgccaccatcgccaagagaaagagcttcatcggcaccccctactggatggcccccgaggtggccgccgtggagagaaagggcggctacaaccagctgtgcgacctgtgggccgtgggcatcaccgccatcgagctggccgagctgcagccccccatgttcgacctgcaccccatgagagccctgttcctgatgaccaagagcaacttccagccccccaagctgaaggacaagatgaagtggagcaacagcttccaccacttcgtgaagatggccctgaccaagaaccccaagaagagacccaccgccgagaagctgctgcagcaccccttcgtgacccagcacctgaccagaagcctggccatcgagctgctggacaaggtgaacaaccccgaccacagcacctaccacgacttcgacgacgacgaccccgagcccctggtggccgtgccccacagaatccacagcaccagcagaaacgtgagagaggagaagaccagaagcgagatcaccttcggccaggtgaagttcgacccccccctgagaaaggagaccgagccccaccacgagctggacctgcagctggagtacggccagggccaccagggcggctacttcctgggcgccaacaagagcctgctgaagagcgtggaggaggagctgcaccagagaggccacgtggcccacctggaggacgacgagggcgacgacgacgagagcaagcacagcaccctgaaggccaagatccccccccccctgccccccaagcccaagagcatcttcatcccccaggagatgcacagcaccgaggacgagaaccagggcaccatcaagagatgccccatgagcggcagccccgccaagcccagccaggtgccccccagaccccccccccccagactgcccccccacaagcccgtggccctgggcaacggcatgagcagcttccagctgaacggcgagagagacggcagcctgtgccagcagcagaacgagcacagaggcaccaacctgagcagaaaggagaagaaggacgtgcccaagcccatcagcaacggcctgccccccacccccaaggtgcacatgggcgcctgcttcagcaaggtgttcaacggctgccccctgaagatccactgcgccagcagctggatcaaccccgacaccagagaccagtacctgatcttcggcgccgaggagggcatctacaccctgaacctgaacgagctgcacgagaccagcatggagcagctgttccccagaagatgcacctggctgtacgtgatgaacaactgcctgctgagcatcagcggcaaggccagccagctgtacagccacaacctgcccggcctgttcgactacgccagacagatgcagaagctgcccgtggccatccccgcccacaagctgcccgacagaatcctgcccagaaagttcagcgtgagcgccaagatccccgagaccaagtggtgccagaagtgctgcgtggtgagaaacccctacaccggccacaagtacctgtgcggcgccctgcagaccagcatcgtgctgctggagtgggtggagcccatgcagaagttcatgctgatcaagcacatcgacttccccatcccctgccccctgagaatgttcgagatgctggtggtgcccgagcaggagtaccccctggtgtgcgtgggcgtgagcagaggcagagacttcaaccaggtggtgagattcgagaccgtgaaccccaacagcaccagcagctggttcaccgagagcgacaccccccagaccaacgtgacccacgtgacccagctggagagagacaccatcctggtgtgcctggactgctgcatcaagatcgtgaacctgcagggcagactgaagagcagcagaaagctgagcagcgagctgaccttcgacttccagatcgagagcatcgtgtgcctgcaggacagcgtgctggccttctggaagcacggcatgcagggcagaagcttcagaagcaacgaggtgacccaggagatcagcgacagcaccagaatcttcagactgctgggcagcgacagagtggtggtgctggagagcagacccaccgacaaccccaccgccaacagcaacctgtacatcctggccggccacgagaacagctactag

SEQ ID NO: 22553 - DNA, 1344 bp, Artificial Sequence
  Description of Artificial Sequence: Synthetic coding sequence
atgcacagcaccgaggacgagaaccagggcaccatcaagagatgccccatgagcggcagccccgccaagcccagccaggtgccccccagaccccccccccccagactgcccccccacaagcccgtggccctgggcaacggcatgagcagcttccagctgaacggcgagagagacggcagcctgtgccagcagcagaacgagcacagaggcaccaacctgagcagaaaggagaagaaggacgtgcccaagcccatcagcaacggcctgccccccacccccaaggtgcacatgggcgcctgcttcagcaaggtgttcaacggctgccccctgaagatccactgcgccagcagctggatcaaccccgacaccagagaccagtacctgatcttcggcgccgaggagggcatctacaccctgaacctgaacgagctgcacgagaccagcatggagcagctgttccccagaagatgcacctggctgtacgtgatgaacaactgcctgctgagcatcagcggcaaggccagccagctgtacagccacaacctgcccggcctgttcgactacgccagacagatgcagaagctgcccgtggccatccccgcccacaagctgcccgacagaatcctgcccagaaagttcagcgtgagcgccaagatccccgagaccaagtggtgccagaagtgctgcgtggtgagaaacccctacaccggccacaagtacctgtgcggcgccctgcagaccagcatcgtgctgctggagtgggtggagcccatgcagaagttcatgctgatcaagcacatcgacttccccatcccctgccccctgagaatgttcgagatgctggtggtgcccgagcaggagtaccccctggtgtgcgtgggcgtgagcagaggcagagacttcaaccaggtggtgagattcgagaccgtgaaccccaacagcaccagcagctggttcaccgagagcgacaccccccagaccaacgtgacccacgtgacccagctggagagagacaccatcctggtgtgcctggactgctgcatcaagatcgtgaacctgcagggcagactgaagagcagcagaaagctgagcagcgagctgaccttcgacttccagatcgagagcatcgtgtgcctgcaggacagcgtgctggccttctggaagcacggcatgcagggcagaagcttcagaagcaacgaggtgacccaggagatcagcgacagcaccagaatcttcagactgctgggcagcgacagagtggtggtgctggagagcagacccaccgacaaccccaccgccaacagcaacctgtacatcctggccggccacgagaacagctactag

SEQ ID NO: 22554 - DNA, 480 bp, Artificial Sequence
  Description of Artificial Sequence: Synthetic coding sequence
atgcagaagttcatgctgatcaagcacatcgacttccccatcccctgccccctgagaatgttcgagatgctggtggtgcccgagcaggagtaccccctggtgtgcgtgggcgtgagcagaggcagagacttcaaccaggtggtgagattcgagaccgtgaaccccaacagcaccagcagctggttcaccgagagcgacaccccccagaccaacgtgacccacgtgacccagctggagagagacaccatcctggtgtgcctggactgctgcatcaagatcgtgaacctgcagggcagactgaagagcagcagaaagctgagcagcgagctgaccttcgacttccagatcgagagcatcgtgtgcctgcaggacagcgtgctggccttctggaagcacggcatgcagggcagaagcttcagaagcaacgaggtgacccaggagatcagcgacagcaagaacttccaggccgcctggatctag

SEQ ID NO: 22555 - DNA, 1449 bp, Artificial Sequence
  Description of Artificial Sequence: Synthetic coding sequence
atgttcttcctggtgaccagcgacgagagcaacaagacctggggcagaaacaccgtgttcagacaggaggagttcgaggacgtgaagagaaacttcaagaagaagggctgcacctggggccccaacagcatccagatgaaggacagaaccgactgcaaggagagaatcagacccctgagcgacggcaacagcccctggagcaccatcctgatcaagaaccagaagaccatgcccctggccagcctgttcgtggaccagcccggcagctgcgaggagcccaagctgagccccgacggcctggagcacagaaagcccaagcagatcaagctgcccagccaggcctacatcgacctgcccctgggcaaggacgcccagagagagaaccccgccgaggccgagagctgggaggaggccgccagcgccaacgccgccaccgtgagcatcgagatgacccccaccaacagcctgagcagaagcccccagagaaagaagaccgagagcgccctgtacggctgcaccgtgctgctggccagcgtggccctgggcctggacctgagagagctgcacaaggcccaggccgccgaggagcccctgcccaaggaggagaagaagaagagagagggcatcttccagagagccagcaagagcagaagaagcgccagcccccccaccagcctgcccagcacctgcggcgaggccagcagcccccccagcctgcccctgagcagcgccctgggcatcctgagcacccccagcttcagcaccaagtgcctgctgcagatggacagcgaggaccccctggtggacagcgcccccgtgacctgcgacagcgagatgctgacccccgacttctgccccaccgcccccggcagcggcagagagcccgccctgatgcccagactggacaccgactgcagcgtgagcagaaacctgcccagcagcttcctgcagcagacctgcggcaacgtgccctactgcgccagcagcaagcacagacccagccaccacagaagaaccatgagcgacggcaaccccacccccaccggcgccaccatcatcagcgccaccggcgccagcgccctgcccctgtgccccagccccgccccccacagccacctgcccagagaggtgagccccaagaagcacagcaccgtgcacatcgtgccccagagaagacccgccagcctgagaagcagaagcgacctgccccaggcctacccccagaccgccgtgagccagctggcccagaccgcctgcgtggtgggcagacccggcccccaccccacccagttcctggccgccaaggagagaaccaagagccacgtgcccagcctgctggacgccgacgtggagggccagagcagagactacaccgtgcccctgtgcagaatgagaagcaagaccagcagacccagcatctacgagctggagaaggagttcctgagctag

SEQ ID NO: 22556 - DNA, 1713 bp, Artificial Sequence
  Description of Artificial Sequence: Synthetic coding sequence
atggccctgagaggcgccgccggcgccaccgacacccccgtgagcagcgccggcggcgcccccggcggcagcgccagcagcagcagcaccagcagcggcggcagcgccagcgccggcgccggcctgtgggccgccctgtacgactacgaggccagaggcgaggacgagctgagcctgagaagaggccagctggtggaggtgctgagccaggacgccgccgtgagcggcgacgagggctggtgggccggccaggtgcagagaagactgggcatcttccccgccaactacgtggccccctgcagacccgccgccagccccgcccccccccccagcagacccagcagccccgtgcacgtggccttcgagagactggagctgaaggagctgatcggcgccggcggcttcggccaggtgtacagagccacctggcagggccaggaggtggccgtgaaggccgccagacaggaccccgagcaggacgccgccgccgccgccgagagcgtgagaagagaggccagactgttcgccatgctgagacaccccaacatcatcgagctgagaggcgtgtgcctgcagcagccccacctgtgcctggtgctggagttcgccagaggcggcgccctgaacagagccctggccgccgccaacgccgcccccgaccccagagcccccggccccagaagagccagaagaatccccccccacgtgctggtgaactgggccgtgcagatcgccagaggcatgctgtacctgcacgaggaggccttcgtgcccatcctgcacagagacctgaagagcagcaacatcctgctgctggagaagatcgagcacgacgacatctgcaacaagaccctgaagatcaccgacttcggcctggccagagagtggcacagaaccaccaagatgagcaccgccggcacctacgcctggatggcccccgaggtgatcaagagcagcctgttcagcaagggcagcgacatctggagctacggcgtgctgctgtgggagctgctgaccggcgaggtgccctacagaggcatcgacggcctggccgtggcctacggcgtggccgtgaacaagctgaccctgcccatccccagcacctgccccgagcccttcgccaagctgatgaaggagtgctggcagcaggacccccacatcagacccagcttcgccctgatcctggagcagctgaccgccatcgagggcgccgtgatgaccgagatgccccaggagagcttccacagcatgcaggacgactggaagctggagatccagcagatgttcgacgagctgagaaccaaggagaaggagctgagaagcagagaggaggagctgaccagagccgccctgcagcagaagagccaggaggagctgctgaagagaagagagcagcagctggccgagagagagatcgacgtgctggagagagagctgaacatcctgatcttccagctgaaccaggagaagcccaaggtgaagaagagaaagggcaagttcaagagaagcagactgaagctgaaggacggccacagaatcagcctgcccagcgacttccagcacaagatcaccgtgcaggccagccccaacctggacaagagaagaagcctgaacagcagcagcagcagcccccccagcagccccaccatgatgcccagactgagagccatccagtgcgagctgagcgccctgcccagaggcctgctgtgctag

SEQ ID NO: 22557 - DNA, 3111 bp, Artificial Sequence
  Description of Artificial Sequence: Synthetic coding sequence
atggccctgagaggcgccgccggcgccaccgacacccccgtgagcagcgccggcggcgcccccggcggcagcgccagcagcagcagcaccagcagcggcggcagcgccagcgccggcgccggcctgtgggccgccctgtacgactacgaggccagaggcgaggacgagctgagcctgagaagaggccagctggtggaggtgctgagccaggacgccgccgtgagcggcgacgagggctggtgggccggccaggtgcagagaagactgggcatcttccccgccaactacgtggccccctgcagacccgccgccagccccgcccccccccccagcagacccagcagccccgtgcacgtggccttcgagagactggagctgaaggagctgatcggcgccggcggcttcggccaggtgtacagagccacctggcagggccaggaggtggccgtgaaggccgccagacaggaccccgagcaggacgccgccgccgccgccgagagcgtgagaagagaggccagactgttcgccatgctgagacaccccaacatcatcgagctgagaggcgtgtgcctgcagcagccccacctgtgcctggtgctggagttcgccagaggcggcgccctgaacagagccctggccgccgccaacgccgcccccgaccccagagcccccggccccagaagagccagaagaatccccccccacgtgctggtgaactgggccgtgcagatcgccagaggcatgctgtacctgcacgaggaggccttcgtgcccatcctgcacagagacctgaagagcagcaacatcctgctgctggagaagatcgagcacgacgacatctgcaacaagaccctgaagatcaccgacttcggcctggccagagagtggcacagaaccaccaagatgagcaccgccggcacctacgcctggatggcccccgaggtgatcaagagcagcctgttcagcaagggcagcgacatctggagctacggcgtgctgctgtgggagctgctgaccggcgaggtgccctacagaggcatcgacggcctggccgtggcctacggcgtggccgtgaacaagctgaccctgcccatccccagcacctgccccgagcccttcgccaagctgatgaaggagtgctggcagcaggacccccacatcagacccagcttcgccctgatcctggagcagctgaccgccatcgagggcgccgtgatgaccgagatgccccaggagagcttccacagcatgcaggacgactggaagctggagatccagcagatgttcgacgagctgagaaccaaggagaaggagctgagaagcagagaggaggagctgaccagagccgccctgcagcagaagagccaggaggagctgctgaagagaagagagcagcagctggccgagagagagatcgacgtgctggagagagagctgaacatcctgatcttccagctgaaccaggagaagcccaaggtgaagaagagaaagggcaagttcaagagaagcagactgaagctgaaggacggccacagaatcagcctgcccagcgacttccagcacaagatcaccgtgcaggccagccccaacctggacaagagaagaagcctgaacagcagcagcagcagcccccccagcagccccaccatgatgcccagactgagagccatccagctgaccagcgacgagagcaacaagacctggggcagaaacaccgtgttcagacaggaggagttcgaggacgtgaagagaaacttcaagaagaagggctgcacctggggccccaacagcatccagatgaaggacagaaccgactgcaaggagagaatcagacccctgagcgacggcaacagcccctggagcaccatcctgatcaagaaccagaagaccatgcccctggccagcctgttcgtggaccagcccggcagctgcgaggagcccaagctgagccccgacggcctggagcacagaaagcccaagcagatcaagctgcccagccaggcctacatcgacctgcccctgggcaaggacgcccagagagagaaccccgccgaggccgagagctgggaggaggccgccagcgccaacgccgccaccgtgagcatcgagatgacccccaccaacagcctgagcagaagcccccagagaaagaagaccgagagcgccctgtacggctgcaccgtgctgctggccagcgtggccctgggcctggacctgagagagctgcacaaggcccaggccgccgaggagcccctgcccaaggaggagaagaagaagagagagggcatcttccagagagccagcaagagcagaagaagcgccagcccccccaccagcctgcccagcacctgcggcgaggccagcagcccccccagcctgcccctgagcagcgccctgggcatcctgagcacccccagcttcagcaccaagtgcctgctgcagatggacagcgaggaccccctggtggacagcgcccccgtgacctgcgacagcgagatgctgacccccgacttctgccccaccgcccccggcagcggcagagagcccgccctgatgcccagactggacaccgactgcagcgtgagcagaaacctgcccagcagcttcctgcagcagacctgcggcaacgtgccctactgcgccagcagcaagcacagacccagccaccacagaagaaccatgagcgacggcaaccccacccccaccggcgccaccatcatcagcgccaccggcgccagcgccctgcccctgtgccccagccccgccccccacagccacctgcccagagaggtgagccccaagaagcacagcaccgtgcacatcgtgccccagagaagacccgccagcctgagaagcagaagcgacctgccccaggcctacccccagaccgccgtgagccagctggcccagaccgcctgcgtggtgggcagacccggcccccaccccacccagttcctggccgccaaggagagaaccaagagccacgtgcccagcctgctggacgccgacgtggagggccagagcagagactacaccgtgcccctgtgcagaatgagaagcaagaccagcagacccagcatctacgagctggagaaggagttcctgagctag

SEQ ID NO: 22558 - DNA, 792 bp, Artificial Sequence
  Description of Artificial Sequence: Synthetic coding sequence
atggagaacctgaagcacatcatcaccctgggccaggtgatccacaagagatgcgaggagatgaagtactgcaagaagcagtgcagaagactgggccacagagtgctgggcctgatcaagcccctggagatgctgcaggaccagggcaagagaagcgtgcccagcgagaagctgaccaccgccatgaacagattcaaggccgccctggaggaggccaacggcgagatcgagaagttcagcaacagaagcaacatctgcagattcctgaccgccagccaggacaagatcctgttcaaggacgtgaacagaaagctgagcgacgtgtggaaggagctgagcctgctgctgcaggtggagcagagaatgcccgtgagccccatcagccagggcgccagctgggcccaggaggaccagcaggacgccgacgaggacagaagagccttccagatgctgagaagagacaacgagaagatcgaggccagcctgagaagactggagatcaacatgaaggagatcaaggagaccctgagacagagcctggagagcagcagcggcaagagccccctggagatcagcagattcaaggtgaagaacgtgaagaccggcagcgccagcggctgcaacagcgagaagatcagaaagctggtggccgtgaagagacagcaggagcccctgggcgaggactgccccagcgagctgagagagatcatcgacgagtgcagagcccacgaccccagcgtgagacccagcgtggacgagatcctgaagaagctgagcaccttcagcaagtag

SEQ ID NO: 22559 - DNA, 1416 bp, Artificial Sequence
  Description of Artificial Sequence: Synthetic coding sequence
atggagaacctgaagcacatcatcaccctgggccaggtgatccacaagagatgcgaggagatgaagtactgcaagaagcagtgcagaagactgggccacagagtgctgggcctgatcaagcccctggagatgctgcaggaccagggcaagagaagcgtgcccagcgagaagctgaccaccgccatgaacagattcaaggccgccctggaggaggccaacggcgagatcgagaagttcagcaacagaagcaacatctgcagattcctgaccgccagccaggacaagatcctgttcaaggacgtgaacagaaagctgagcgacgtgtggaaggagctgagcctgctgctgcaggtggagcagagaatgcccgtgagccccatcagccagggcgccagctgggcccaggaggaccagcaggacgccgacgaggacagaagagccttccagatgctgagaagagacaacgagaagatcgaggccagcctgagaagactggagatcaacatgaaggagatcaaggagaccctgagacagtacctgccccccaagtgcatgcaggagatcccccaggagcagatcaaggagatcaagaaggagcagctgagcggcagcccctggatcctgctgagagagaacgaggtgagcaccctgtacaagggcgagtaccacagagcccccgtggccatcaaggtgttcaagaagctgcaggccggcagcatcgccatcgtgagacagaccttcaacaaggagatcaagaccatgaagaagttcgagagccccaacatcctgagaatcttcggcatctgcatcgacgagaccgtgacccccccccagttcagcatcgtgatggagtactgcgagctgggcaccctgagagagctgctggacagagagaaggacctgaccctgggcaagagaatggtgctggtgctgggcgccgccagaggcctgtacagactgcaccacagcgaggcccccgagctgcacggcaagatcagaagcagcaacttcctggtgacccagggctaccaggtgaagctggccggcttcgagctgagaaagacccagaccagcatgagcctgggcaccaccagagagaagaccgacagagtgaagagcaccgcctacctgagcccccaggagctggaggacgtgttctaccagtacgacgtgaagagcgagatctacagcttcggcatcgtgctgtgggagatcgccaccggcgacatccccttccagggctgcaacagcgagaagatcagaaagctggtggccgtgaagagacagcaggagcccctgggcgaggactgccccagcgagctgagagagatcatcgacgagtgcagagcccacgaccccagcgtgagacccagcgtggacgagatcctgaagaagctgagcaccttcagcaagtag

SEQ ID NO: 22560 - DNA, 651 bp, Artificial Sequence
  Description of Artificial Sequence: Synthetic coding sequence
atgagcttcctgttcagcagcagaagcagcaagaccttcaagcccaagaagaacatccccgagggcagccaccagtacgagctgctgaagcacgccgaggccaccctgggcagcggcaacctgagacaggccgtgatgctgcccgagggcgaggacctgaacgagtggatcgccgtgaacaccgtggacttcttcaaccagatcaacatgctgtacggcaccatcaccgagttctgcaccgaggccagctgccccgtgatgagcgccggccccagatacgagtaccactgggccgacggcaccaacatcaagaagcccatcaagtgcagcgcccccaagtacatcgactacctgatgacctgggtgcaggaccagctggacgacgagaccctgttccccagcaagatcggcgtgcccttccccaagaacttcatgagcgtggccaagaccatcctgaagagactgttcagagtgtacgcccacatctaccaccagcacttcgacagcgtgatgcagctgcaggaggaggcccacctgaacaccagcttcaagcacttcatcttcttcgtgcaggagttcaacctgatcgacagaagagagctggcccccctgcaggagctgatcgagaagctgggcagcaaggacagatag

SEQ ID NO: 22561 - DNA, 447 bp, Artificial Sequence
  Description of Artificial Sequence: Synthetic coding sequence
atgctgttctacctgagcagcagaagcagcaagaccttcaagcccaagaagaacatccccgagggcagccaccagtacgagctgctgaagcacgccgaggccaccctgggcagcggcaacctgagacaggccgtgatgctgcccgagggcgaggacctgaacgagtggatcgccgtgaacaccgtggacttcttcaaccagatcaacatgctgtacggcaccatcaccgagttctgcaccgaggccagctgccccgtgatgagcgccggccccagatacgagtaccactgggccgacggcaccaacatcaagaagcccatcaagtgcagcgcccccaagtacatcgactacctgatgacctgggtgcaggaccagctggacgacgagaccctgttccccagcaagatcggcgagctgaccctgagcaagtacagcttcttcttctag

SEQ ID NO: 22562 - DNA, 807 bp, Artificial Sequence
  Description of Artificial Sequence: Synthetic coding sequence
atgctgggcgaccactgcagcctgcccgaggaccaggccagacccggccagagcctgcagagcggcctgtgctgcaagatggtgctgcaggccgtgagcaaggtgctgagaaagagcaaggccaagcccaacggcaagaagcccgccgccgaggagagaaaggcctacctggagcccgagcacaccaaggccagaatcaccgacttccagttcaaggagctggtggtgctgcccagagagatcgacctgaacgagtggctggccagcaacaccaccaccttcttccaccacatcaacctgcagtacagcaccatcagcgagttctgcaccggcgagacctgccagaccatggccgtgtgcaacacccagtactactggtacgacgagagaggcaagaaggtgaagtgcaccgccccccagtacgtggacttcgtgatgagcagcgtgcagaagctggtgaccgacgaggacgtgttccccaccaagtacggcagagagttccccagcagcttcgagagcctggtgagaaagatctgcagacacctgttccacgtgctggcccacatctactgggcccacttcaaggagaccctggccctggagctgcacggccacctgaacaccctgtacgtgcacttcatcctgttcgccagagagttcaacctgctggaccccaaggagaccgccatcatggacgacctgaccgaggtgctgtgcagcggcgccggcggcgtgcacagcggcggcagcggcgacggcgccggcagcggcggccccggcgcccagaaccacgtgaaggagagatag

SEQ ID NO: 22563 - DNA, 654 bp, Artificial Sequence
  Description of Artificial Sequence: Synthetic coding sequence
atgagcaaccccttcctgaagcaggtgttcaacaaggacaagaccttcagacccaagagaaagttcgagcccggcacccagagattcgagctgcacaagaaggcccaggccagcctgaacgccggcctggacctgagactggccgtgcagctgccccccggcgaggacctgaacgactgggtggccgtgcacgtggtggacttcttcaacagagtgaacctgatctacggcaccatcagcgacggctgcaccgagcagagctgccccgtgatgagcggcggccccaagtacgagtacagatggcaggacgagcacaagttcagaaagcccaccgccctgagcgcccccagatacatggacctgctgatggactggatcgaggcccagatcaacaacgaggacctgttccccaccaacgtgggcacccccttccccaagaacttcctgcagaccgtgagaaagatcctgagcagactgttcagagtgttcgtgcacgtgtacatccaccacttcgacagaatcgcccagatgggcagcgaggcccacgtgaacacctgctacaagcacttctactacttcgtgaaggagttcggcctgatcgacaccaaggagctggagcccctgaaggagatgaccgccagaatgtgccactag

SEQ ID NO: 22564 - DNA, 651 bp, Artificial Sequence
  Description of Artificial Sequence: Synthetic coding sequence
atgagcatcgccctgaagcaggtgttcaacaaggacaagaccttcagacccaagagaaagttcgagcccggcacccagagattcgagctgcacaagagagcccaggccagcctgaacagcggcgtggacctgaaggccgccgtgcagctgcccagcggcgaggaccagaacgactgggtggccgtgcacgtggtggacttcttcaacagaatcaacctgatctacggcaccatctgcgagttctgcaccgagagaacctgccccgtgatgagcggcggccccaagtacgagtacagatggcaggacgacctgaagtacaagaagcccaccgccctgcccgccccccagtacatgaacctgctgatggactggatcgaggtgcagatcaacaacgaggagatcttccccacctgcgtgggcgtgcccttccccaagaacttcctgcagatctgcaagaagatcctgtgcagactgttcagagtgttcgtgcacgtgtacatccaccacttcgacagagtgatcgtgatgggcgccgaggcccacgtgaacacctgctacaagcacttctactacttcgtgaccgagatgaacctgatcgacagaaaggagctggagcccctgaaggagatgaccagcagaatgtgccactag

SEQ ID NO: 22565 - DNA, 807 bp, Artificial Sequence
  Description of Artificial Sequence: Synthetic coding sequence
atgaagagaagaaacctgttcgccctggagaccggcgtgcccccctggggcctgctgtgggtgagaagcagaagagtgggcatggacgagatgaccttccacatctggtacccccaggtgagagcccccggccagcagccccaggcccagctggccatggccctgtgcctgaagcaggtgttcgccaaggacaagaccttcagacccagaaagagattcgagcccggcacccagagattcgagctgtacaagaaggcccaggccagcctgaagagcggcctggacctgagaagcgtggtgagactgccccccggcgagaacatcgacgactggatcgccgtgcacgtggtggacttcttcaacagaatcaacctgatctacggcaccatggccgagagatgcagcgagaccagctgccccgtgatggccggcggccccagatacgagtacagatggcaggacgagagacagtacagaagacccgccaagctgagcgcccccagatacatggccctgctgatggactggatcgagggcctgatcaacgacgaggaggtgttccccaccagagtgggcgtgcccttccccaagaacttccagcaggtgtgcaccaagatcctgaccagactgttcagagtgttcgtgcacgtgtacatccaccacttcgacagcatcctgagcatgggcgccgaggcccacgtgaacacctgctacaagcacttctactacttcatcagagagttcagcctggtggaccagagagagctggagcccctgagagagatgaccgagagaatctgccactag

SEQ ID NO: 22566 - DNA, 651 bp, Artificial Sequence
  Description of Artificial Sequence: Synthetic coding sequence
atggccctgtgcctgaagcaggtgttcgccaaggacaagaccttcagacccagaaagagattcgagcccggcacccagagattcgagctgtacaagaaggcccaggccagcctgaagagcggcctggacctgagaagcgtggtgagactgccccccggcgagaacatcgacgactggatcgccgtgcacgtggtggacttcttcaacagaatcaacctgatctacggcaccatggccgagagatgcagcgagaccagctgccccgtgatggccggcggccccagatacgagtacagatggcaggacgagagacagtacagaagacccgccaagctgagcgcccccagatacatggccctgctgatggactggatcgagggcctgatcaacgacgaggaggtgttccccaccagagtgggcgtgcccttccccaagaacttccagcaggtgtgcaccaagatcctgaccagactgttcagagtgttcgtgcacgtgtacatccaccacttcgacagcatcctgagcatgggcgccgaggcccacgtgaacacctgctacaagcacttctactacttcatcagagagttcagcctggtggaccagagagagctggagcccctgagagagatgaccgagagaatctgccactag

SEQ ID NO: 22567 - DNA, 720 bp, Artificial Sequence
  Description of Artificial Sequence: Synthetic coding sequence
atgcccctgagcctggccggctacccccaggtgagagcccccggccagcagccccaggcccagctggccatggccctgtgcctgaagcaggtgttcgccaaggacaagaccttcagacccagaaagagattcgagcccggcacccagagattcgagctgtacaagaaggcccaggccagcctgaagagcggcctggacctgagaagcgtggtgagactgccccccggcgagaacatcgacgactggatcgccgtgcacgtggtggacttcttcaacagaatcaacctgatctacggcaccatggccgagagatgcagcgagaccagctgccccgtgatggccggcggccccagatacgagtacagatggcaggacgagagacagtacagaagacccgccaagctgagcgcccccagatacatggccctgctgatggactggatcgagggcctgatcaacgacgaggaggtgttccccaccagagtgggcgtgcccttccccaagaacttccagcaggtgtgcaccaagatcctgaccagactgttcagagtgttcgtgcacgtgtacatccaccacttcgacagcatcctgagcatgggcgccgaggcccacgtgaacacctgctacaagcacttctactacttcatcagagagttcagcctggtggaccagagagagctggagcccctgagagagatgaccgagagaatctgccactag

SEQ ID NO: 22568 - DNA, 1959 bp, Artificial Sequence
  Description of Artificial Sequence: Synthetic coding sequence
atgcaccccggcggcggccccagcagagccgagagactggagctgggcctgggcagagagagacccgccaaggccatcttcctgcacagaagacccggcgagggcggcggcagagagagatgcctgagatgcggccacgtgtgcgtgagaagaggccccggccccagagaggccgtgcccagcggcagacccagacccgacaccctgacccccccctgggtgagacagagagccgtgaccggcaccttctgcgccagctggacccccctgagaaacagaagagcccagagaatggccaccgacatgcagagaaagagaagcagcgagtgcctggacggcaccctgacccccagcgacggccagagcatggagagagccgagagccccacccccggcatggcccagggcatggagcccggcgccggccaggagggcgccatgttcgtgcacgccagaagctacgaggacctgaccgagagcgaggacggcgccgccagcggcgacagccacaaggagggcaccagaggccccccccccctgcccaccgacatgagacagatcagccaggacttcagcgagctgagcacccagctgaccggcgtggccagagacctgcaggaggagatgctgcccggcagcagcgaggactggctggagccccccggcgccgtgggcagacccgccaccgagccccccagagagggcaccaccgagggcgacgaggaggacgccaccgaggcctggagactgcaccagaagcacgtgttcgtgctgagcgaggccggcaagcccgtgtacagcagatacggcagcgaggaggccctgagcagcaccatgggcgtgatggtggccctggtgagcttcctggaggccgacaagaacgccatcagaagcatccacgccgacggctacaaggtggtgttcgtgagaagaagccccctggtgctggtggccgtggccagaaccagacagagcgcccaggagctggcccaggagctgctgtacatctactaccagatcctgagcctgctgaccggcgcccagctgagccacatcttccagcagaagcagaactacgacctgagaagactgctgagcggcagcgagagaatcaccgacaacctgctgcagctgatggccagagaccccagcttcctgatgggcgccgccagatgcctgcccctggccgccgccgtgagagacaccgtgagcgccagcctgcagcaggccagagccagaagcctggtgttcagcatcctgctggccagaaaccagctggtggccctggtgagaagaaaggaccagttcctgcaccccatcgacctgcacctgctgttcaacctgatcagcagcagcagcagcttcagagagggcgaggcctggacccccgtgtgcctgcccaagttcaacgccgccggcttcttccacgcccacatcagctacctggagcccgacaccgacctgtgcctgctgctggtgagcaccgacagagaggacttcttcgccgtgagcgactgcagaagaagattccaggagagactgagaaagagaggcgcccacctggccctgagagaggccctgagaaccccctactacagcgtggcccaggtgggcatccccgacctgagacacttcctgtacaagagcaagagcagcggcctgttcaccagccccgagatcgaggccccctacaccagcgaggaggagcaggagagactgctgggcctgtaccagtacctgcacagcagagcccacaacgccagcagacccctgaagaccatctactacaccggccccaacgagaacctgctggcctgggtgaccggcgccttcgagctgtacatgtgctacagccccctgggcaccaaggccagcgccgtgagcgccatccacaagctgatgagatggatcagaaaggaggaggacagactgttcatcctgacccccctgacctactag

SEQ ID NO: 22569 - DNA, 1473 bp, Artificial Sequence
  Description of Artificial Sequence: Synthetic coding sequence
atgcaccccggcggcggccccagcagagccgagagactggagctgggcctgggcagagagagacccgccaaggccatcttcctgcacagaagacccggcgagggcggcggcagagagagatgcctgagatgcggccacgtgtgcgtgagaagaggccccggccccagagaggccgtgcccagcggcagacccagacccgacaccctgacccccccctgggtgagacagagagccgtgaccggcaccttctgcgccagctggacccccctgagaaacagaagagcccagagaatggccaccgacatgcagagaaagagaagcagcgagtgcctggacggcaccctgacccccagcgacggccagagcatggagagagccgagagccccacccccggcatggcccagggcatggagcccgacggctacaaggtggtgttcgtgagaagaagccccctggtgctggtggccgtggccagaaccagacagagcgcccaggagctggcccaggagctgctgtacatctactaccagatcctgagcctgctgaccggcgcccagctgagccacatcttccagcagaagcagaactacgacctgagaagactgctgagcggcagcgagagaatcaccgacaacctgctgcagctgatggccagagaccccagcttcctgatgggcgccgccagatgcctgcccctggccgccgccgtgagagacaccgtgagcgccagcctgcagcaggccagagccagaagcctggtgttcagcatcctgctggccagaaaccagctggtggccctggtgagaagaaaggaccagttcctgcaccccatcgacctgcacctgctgttcaacctgatcagcagcagcagcagcttcagagagggcgaggcctggacccccgtgtgcctgcccaagttcaacgccgccggcttcttccacgcccacatcagctacctggagcccgacaccgacctgtgcctgctgctggtgagcaccgacagagaggacttcttcgccgtgagcgactgcagaagaagattccaggagagactgagaaagagaggcgcccacctggccctgagagaggccctgagaaccccctactacagcgtggcccaggtgggcatccccgacctgagacacttcctgtacaagagcaagagcagcggcctgttcaccagccccgagatcgaggccccctacaccagcgaggaggagcaggagagactgctgggcctgtaccagtacctgcacagcagagcccacaacgccagcagacccctgaagaccatctactacaccggccccaacgagaacctgctggcctgggtgaccggcgccttcgagctgtacatgtgctacagccccctgggcaccaaggccagcgccgtgagcgccatccacaagctgatgagatggatcagaaaggaggaggacagactgttcatcctgacccccctgacctactag

SEQ ID NO: 22570 - DNA, 2043 bp, Artificial Sequence
  Description of Artificial Sequence: Synthetic coding sequence
atgggctgcggcaccaaggagcccaagatcacccagctgtgcctggccgccatccagagactgatgagccacgaggtggtgagcgagaccgccgccggcaacatcatcaacatgctgtggcagctgatggagaacagcctggaggagctgaagctgctgcagaccgtgctggtgctgctgaccaccaacaccgtggtgcacgacgaggccctgagcaaggccatcgtgctgtgcttcagactgcacttcaccaaggacaacatcaccaacaacaccgccgccgccaccgtgagacaggtggtgaccgtggtgttcgagagaatggtggccgaggacgagagacacagagacatcatcgagcagcccgtgctggtgcagggcaacagcaacagaagaagcgtgagcaccctgaagccctgcgccaaggacgcctacatgctgttccaggacctgtgccagctggtgaacgccgacgccccctactggctggtgggcatgaccgagatgaccagaaccttcggcctggagctgctggagagcgtgctgaacgacttcccccaggtgttcctgcagcaccaggagttcagcttcctgctgaaggagagagtgtgccccctggtgatcaagctgttcagccccaacatcaagttcagacagggcagcagcaccagcagcagccccgcccccgtggagaagccctacttccccatctgcatgagactgctgagagtggtgagcgtgctgatcaagcagttctacagcctgctggtgaccgagtgcgagatcttcctgagcctgctggtgaagttcctggacgccgacaagccccagtggctgagagccgtggccgtggagagcatccacagattctgcgtgcagccccagctgctgagaagcttctgccagagctacgacatgaagcagcacagcaccaaggtgttcagagacatcgtgaacgccctgggcagcttcatccagagcctgttcctggtgccccccaccggcaaccccgccaccagcaaccaggccggcaacaacaacctgggcggcagcgtgagcgcccccgccaacagcggcatggtgggcatcggcggcggcgtgaccctgctgcccgccttcgagtacagaggcacctggatccccatcctgaccatcaccgtgcagggcagcgccaaggccacctacctggagatgctggacaaggtggagccccccaccatccccgagggctacgccatgagcgtggccttccactgcctgctggacctggtgagaggcatcaccagcatgatcgagggcgagctgggcgagctggagaccgagtgccagaccaccaccgaggagggcagcagccccacccagagcaccgagcagcaggacctgcagagcaccagcgaccagatggacaaggagatcgtgagcagagccgtgtgggaggagatggtgaacgcctgctggtgcggcctgctggccgccctgagcctgctgctggacgccagcaccgacgaggccgccaccgagaacatcctgaaggccgagctgaccatggccgccctgtgcggcagactgggcctggtgaccagcagagacgccttcatcaccgccatctgcaagggcagcctgcccccccactacgccctgaccgtgctgaacaccaccaccgccgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgagaaccctgctgaacctggcccactgccacggcgccgtgctgggcaccagctggcagctggtgctggccaccctgcagcacctggtgtggatcctgggcctgaagcccagcagcggcggcgccctgaagcccggcagagccgtggagggccccagcaccgtgcccttcaaggacttcatgcagccccccgccagcagagtgcagaacggcgagagctag

SEQ ID NO: 22571 - DNA, 5031 bp, Artificial Sequence
  Description of Artificial Sequence: Synthetic coding sequence
atgagcggcaccagcagccccgaggccgtgaagaagctgctggagaacatgcagagcgacctgagagccctgagcctggagtgcaagaagaagttcccccccgtgaaggaggccgccgagagcggcatcatcaaggtgaagaccatcgccgccagaaacaccgagatcctggccgccctgaaggagaacagcagcgaggtggtgcagcccttcctgatgggctgcggcaccaaggagcccaagatcacccagctgtgcctggccgccatccagagactgatgagccacgaggtggtgagcgagaccgccgccggcaacatcatcaacatgctgtggcagctgatggagaacagcctggaggagctgaagctgctgcagaccgtgctggtgctgctgaccaccaacaccgtggtgcacgacgaggccctgagcaaggccatcgtgctgtgcttcagactgcacttcaccaaggacaacatcaccaacaacaccgccgccgccaccgtgagacaggtggtgaccgtggtgttcgagagaatggtggccgaggacgagagacacagagacatcatcgagcagcccgtgctggtgcagggcaacagcaacagaagaagcgtgagcaccctgaagccctgcgccaaggacgcctacatgctgttccaggacctgtgccagctggtgaacgccgacgccccctactggctggtgggcatgaccgagatgaccagaaccttcggcctggagctgctggagagcgtgctgaacgacttcccccaggtgttcctgcagcaccaggagttcagcttcctgctgaaggagagagtgtgccccctggtgatcaagctgttcagccccaacatcaagttcagacagggcagcagcaccagcagcagccccgcccccgtggagaagccctacttccccatctgcatgagactgctgagagtggtgagcgtgctgatcaagcagttctacagcctgctggtgaccgagtgcgagatcttcctgagcctgctggtgaagttcctggacgccgacaagccccagtggctgagagccgtggccgtggagagcatccacagattctgcgtgcagccccagctgctgagaagcttctgccagagctacgacatgaagcagcacagcaccaaggtgttcagagacatcgtgaacgccctgggcagcttcatccagagcctgttcctggtgccccccaccggcaaccccgccaccagcaaccaggccggcaacaacaacctgggcggcagcgtgagcgcccccgccaacagcggcatggtgggcatcggcggcggcgtgaccctgctgcccgccttcgagtacagaggcacctggatccccatcctgaccatcaccgtgcagggcagcgccaaggccacctacctggagatgctggacaaggtggagccccccaccatccccgagggctacgccatgagcgtggccttccactgcctgctggacctggtgagaggcatcaccagcatgatcgagggcgagctgggcgagctggagaccgagtgccagaccaccaccgaggagggcagcagccccacccagagcaccgagcagcaggacctgcagagcaccagcgaccagatggacaaggagatcgtgagcagagccgtgtgggaggagatggtgaacgcctgctggtgcggcctgctggccgccctgagcctgctgctggacgccagcaccgacgaggccgccaccgagaacatcctgaaggccgagctgaccatggccgccctgtgcggcagactgggcctggtgaccagcagagacgccttcatcaccgccatctgcaagggcagcctgcccccccactacgccctgaccgtgctgaacaccaccaccgccgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgagaaccctgctgaacctggcccactgccacggcgccgtgctgggcaccagctggcagctggtgctggccaccctgcagcacctggtgtggatcctgggcctgaagcccagcagcggcggcgccctgaagcccggcagagccgtggagggccccagcaccgtgctgaccaccgccgtgatgaccgacctgcccgtgatcagcaacatcctgagcagactgttcgagagcagccagtacctggacgacgtgagcctgcaccacctgatcaacgccctgtgcagcctgagcctggaggccatggacatggcctacggcaacaacaaggagcccagcctgttcgccgtggccaagctgctggagaccggcctggtgaacatgcacagaatcgagatcctgtggagacccctgaccggccacctgctggagaaggtgtgccagcaccccaacagcagaatgagagagtggggcgccgaggccctgaccagcctgatcaaggccggcctgaccttcaaccacgacccccccctgagccagaaccagagactgcagctgctgctgctgaaccccctgaaggagatgagcaacatcaaccaccccgacatcagactgaagcagctggagtgcgtgctgcagatcctgcagagccagggcgacagcctgggccccggctggcccctggtgctgggcgtgatgggcgccatcagaaacgaccagggcgagagcctgatcagaaccgccttccagtgcctgcagctggtggtgaccgacttcctgcccaccatgccctgcacctgcctgcagatcgtggtggacgtggccggcagcttcggcctgcacaaccaggagctgaacatcagcctgaccagcatcggcctgctgtggaacatcagcgactacttcttccagagaggcgagaccatcgagaaggagctgaacaaggaggaggccgcccagcagaagcaggccgaggagaagggcgtggtgctgaacagacccttccaccccgccccccccttcgactgcctgtggctgtgcctgtacgccaagctgggcgagctgtgcgtggaccccagacccgccgtgagaaagagcgccggccagaccctgttcagcaccatcggcgcccacggcaccctgctgcagcacagcacctggcacaccgtgatctggaaggtgctgttccacctgctggacagagtgagagagagcagcaccaccgccgacaaggagaagatcgagagcggcggcggcaacatcctgatccaccacagcagagacaccgccgagaagcagtgggccgagacctgggtgctgaccctggccggcgtggccagaatcttcaacaccagaagatacctgctgcagcccctgggcgacttcagcagagcctgggacgtgctgctggaccacatccagagcgccgccctgagcaagaacaacgaggtgagcctggccgccctgaagagcttccaggagatcctgcagatcgtgagccccgtgagagacagcgacaagcccgagaccccccccgtggtgaacgtgcccgtgcccgtgctgatcggccccatcagcggcatgagcagacccttcgtgagaaccgacagcatcggcgagaagctgggcagatacagcagcagcgagccccccatcgtgaccgacgagctggaggacctgaacctgtggtgggccgcctggaacacctggtacagaatcggcagcgagagcaccaagccccccatcaccttcgacaagctgaccttcatccccagccagcccttcctgaccgccctgatccagatcttccccgccctgtaccagcacatcaagaccggcttcaacatggacgacctgcagaagctgggcgtgatcctgcacagcgccatcagcgtgcccatcagcagcgacgccagccccttcatcctgcccagctacaccgaggccgtgctgaccagcctgcaggaggccgtgctgaccgccctggacgtgctgcagaaggccatctgcgtgggccccgagaacatgcagatcatgtaccccgccatcttcgaccagctgctggccttcgtggagttcagctgcaagcccccccagtacggccagctggagaccaagcacatcgccaacgccaagtacaaccagatccagctgttcgcccccgccgagtgggtggccctgaactacgtgcccttcgccgagagaagcctggaggtggtggtggacctgtaccagaagaccgcctgccacaaggccgtggtgaacgagaaggtgctgcagaacatcatcaagaccctgagagtgcccctgagcctgaagtacagctgccccagcgagagcacctggaagctggccgtgagcagcctgctgagagtgctgagcatcggcctgcccgtggccagacagcacgccagcagcggcaagttcgacagcatgtggcccgagctggccaacaccttcgaggacttcctgttcaccaagagcatcccccccgacaacctgagcatccaggagttccagagaaacgagaacatcgacgtggaggtggtgcagctgatcagcaacgagatcctgccctacgccaacttcatccccaaggagttcgtgggccagatcatgaccatgctgaacaagggcagcatccacagccagagcagcagcttcaccgaggccgagatcgacatcagactgagagaggagttcagcaagatgtgcttcgagaccctgctgcagttcagcttcagcaacaaggtgaccaccccccaggagggctacatcagcagaatggccctgagcgtgctgctgaagagaagccaggacgtgctgcacagatacatcgaggacgagagactgagcggcaagtgccccctgcccagacagcaggtgaccgagatcatcttcgtgctgaaggccgtgagcaccctgatcgacagcctgaagaagacccagcccgagaacgcctgcatcagcctgttcggcatccccccctacttctag

SEQ ID NO: 22572 - DNA, 5154 bp, Artificial Sequence
  Description of Artificial Sequence: Synthetic coding sequence
atgagcggcaccagcagccccgaggccgtgaagaagctgctggagaacatgcagagcgacctgagagccctgagcctggagtgcaagaagaagttcccccccgtgaaggaggccgccgagagcggcatcatcaaggtgaagaccatcgccgccagaaacaccgagatcctggccgccctgaaggagaacagcagcgaggtggtgcagcccttcctgatgggctgcggcaccaaggagcccaagatcacccagctgtgcctggccgccatccagagactgatgagccacgaggtggtgagcgagaccgccgccggcaacatcatcaacatgctgtggcagctgatggagaacagcctggaggagctgaagctgctgcagaccgtgctggtgctgctgaccaccaacaccgtggtgcacgacgaggccctgagcaaggccatcgtgctgtgcttcagactgcacttcaccaaggacaacatcaccaacaacaccgccgccgccaccgtgagacaggtggtgaccgtggtgttcgagagaatggtggccgaggacgagagacacagagacatcatcgagcagcccgtgctggtgcagggcaacagcaacagaagaagcgtgagcaccctgaagccctgcgccaaggacgcctacatgctgttccaggacctgtgccagctggtgaacgccgacgccccctactggctggtgggcatgaccgagatgaccagaaccttcggcctggagctgctggagagcgtgctgaacgacttcccccaggtgttcctgcagcaccaggagttcagcttcctgctgaaggagagagtgtgccccctggtgatcaagctgttcagccccaacatcaagttcagacagggcagcagcaccagcagcagccccgcccccgtggagaagccctacttccccatctgcatgagactgctgagagtggtgagcgtgctgatcaagcagttctacagcctgctggtgaccgagtgcgagatcttcctgagcctgctggtgaagttcctggacgccgacaagccccagtggctgagagccgtggccgtggagagcatccacagattctgcgtgcagccccagctgctgagaagcttctgccagagctacgacatgaagcagcacagcaccaaggtgttcagagacatcgtgaacgccctgggcagcttcatccagagcctgttcctggtgccccccaccggcaaccccgccaccagcaaccaggccggcaacaacaacctgggcggcagcgtgagcgcccccgccaacagcggcatggtgggcatcggcggcggcgtgaccctgctgcccgccttcgagtacagaggcacctggatccccatcctgaccatcaccgtgcagggcagcgccaaggccacctacctggagatgctggacaaggtggagccccccaccatccccgagggctacgccatgagcgtggccttccactgcctgctggacctggtgagaggcatcaccagcatgatcgagggcgagctgggcgagctggagaccgagtgccagaccaccaccgaggagggcagcagccccacccagagcaccgagcagcaggacctgcagagcaccagcgaccagatggacaaggagatcgtgagcagagccgtgtgggaggagatggtgaacgcctgctggtgcggcctgctggccgccctgagcctgctgctggacgccagcaccgacgaggccgccaccgagaacatcctgaaggccgagctgaccatggccgccctgtgcggcagactgggcctggtgaccagcagagacgccttcatcaccgccatctgcaagggcagcctgcccccccactacgccctgaccgtgctgaacaccaccaccgccgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgagaaccctgctgaacctggcccactgccacggcgccgtgctgggcaccagctggcagctggtgctggccaccctgcagcacctggtgtggatcctgggcctgaagcccagcagcggcggcgccctgaagcccggcagagccgtggagggccccagcaccgtgctgaccaccgccgtgatgaccgacctgcccgtgatcagcaacatcctgagcagactgttcgagagcagccagtacctggacgacgtgagcctgcaccacctgatcaacgccctgtgcagcctgagcctggaggccatggacatggcctacggcaacaacaaggagcccagcctgttcgccgtggccaagctgctggagaccggcctggtgaacatgcacagaatcgagatcctgtggagacccctgaccggccacctgctggaggtgtgccagcaccccaacagcagaatgagagagtggggcgccgaggccctgaccagcctgatcaaggccggcctgaccttcaaccacgacccccccctgagccagaaccagagactgcagctgctgctgctgaaccccctgaaggagatgagcaacatcaaccaccccgacatcagactgaagcagctggagtgcgtgctgcagatcctgcagagccagggcgacagcctgggccccggctggcccctggtgctgggcgtgatgggcgccatcagaaacgaccagggcgagagcctgatcagaaccgccttccagtgcctgcagctggtggtgaccgacttcctgcccaccatgccctgcacctgcctgcagatcgtggtggacgtggccggcagcttcggcctgcacaaccaggagctgaacatcagcctgaccagcatcggcctgctgtggaacatcagcgactacttcttccagagaggcgagaccatcgagaaggagctgaacaaggaggaggccgcccagcagaagcaggccgaggagaagggcgtggtgctgaacagacccttccaccccgccccccccttcgactgcctgtggctgtgcctgtacgccaagctgggcgagctgtgcgtggaccccagacccgccgtgagaaagagcgccggccagaccctgttcagcaccatcggcgcccacggcaccctgctgcagcacagcacctggcacaccgtgatctggaaggtgctgttccacctgctggacagagtgagagagagcagcaccaccgccgacaaggagaagatcgagagcggcggcggcaacatcctgatccaccacagcagagacaccgccgagaagcagtgggccgagacctgggtgctgaccctggccggcgtggccagaatcttcaacaccagaagatacctgctgcagcccctgggcgacttcagcagagcctgggacgtgctgctggaccacatccagagcgccgccctgagcaagaacaacgaggtgagcctggccgccctgaagagcttccaggagatcctgcagatcgtgagccccgtgagagacagcgacaagcccgagaccccccccgtggtgaacgtgcccgtgcccgtgctgatcggccccatcagcggcatgagcagacccttcgtgagaaccgacagcatcggcgagaagctgggcagatacagcagcagcgagccccccatcgtgaccgacgagctggaggacctgaacctgtggtgggccgcctggaacacctggtacagaatcggcagcgagagcaccaagccccccatcaccttcgacaagctgaccttcatccccagccagcccttcctgaccgccctgatccagatcttccccgccctgtaccagcacatcaagaccggcttcaacatggacgacctgcagaagctgggcgtgatcctgcacagcgccatcagcgtgcccatcagcagcgacgccagccccttcatcctgcccagctacaccgaggccgtgctgaccagcctgcaggaggccgtgctgaccgccctggacgtgctgcagaaggccatctgcgtgggccccgagaacatgcagatcatgtaccccgccatcttcgaccagctgctggccttcgtggagttcagctgcaagcccccccagtacggccagctggagaccaagcacatcgccaacgccaagtacaaccagatccagctgttcgcccccgccgagtgggtggccctgaactacgtgcccttcgccgagagaagcctggaggtggtggtggacctgtaccagaagaccgcctgccacaaggccgtggtgaacgagaaggtgctgcagaacatcatcaagaccctgagagtgcccctgagcctgaagtacagctgccccagcgagagcacctggaagctggccgtgagcagcctgctgagagtgctgagcatcggcctgcccgtggccagacagcacgccagcagcggcaagttcgacagcatgtggcccgagctggccaacaccttcgaggacttcctgttcaccaagagcatcccccccgacaacctgagcatccaggagttccagagaaacgagaacatcgacgtggaggtggtgcagctgatcagcaacgagatcctgccctacgccaacttcatccccaaggagttcgtgggccagatcatgaccatgctgaacaagggcagcatccacagccagagcagcagcttcaccgaggccgagatcgacatcagactgagagaggagttcagcaagatgtgcttcgagaccctgctgcagttcagcttcagcaacaaggtgaccaccccccaggagggctacatcagcagaatggccctgagcgtgctgctgaagagaagccaggacgtgctgcacagatacatcgaggacgagagactgagcggcaagtgccccctgcccagacagcaggtgaccgagatcatcttcgtgctgaaggccgtgagcaccctgatcgacagcctgaagaagacccagcccgagaacgtggacggcaacacctgggcccaggtgatcgccctgtaccccaccctggtggagtgcatcacctgcagcagcagcgaggtgtgcagcgccctgaaggaggccctggtgcccttcaaggacttcatgcagccccccgccagcagagtgcagaacggcgagagctag

SEQ ID NO: 22573 - DNA, 5028 bp, Artificial Sequence
  Description of Artificial Sequence: Synthetic coding sequence
atgagcggcaccagcagccccgaggccgtgaagaagctgctggagaacatgcagagcgacctgagagccctgagcctggagtgcaagaagaagttcccccccgtgaaggaggccgccgagagcggcatcatcaaggtgaagaccatcgccgccagaaacaccgagatcctggccgccctgaaggagaacagcagcgaggtggtgcagcccttcctgatgggctgcggcaccaaggagcccaagatcacccagctgtgcctggccgccatccagagactgatgagccacgaggtggtgagcgagaccgccgccggcaacatcatcaacatgctgtggcagctgatggagaacagcctggaggagctgaagctgctgcagaccgtgctggtgctgctgaccaccaacaccgtggtgcacgacgaggccctgagcaaggccatcgtgctgtgcttcagactgcacttcaccaaggacaacatcaccaacaacaccgccgccgccaccgtgagacaggtggtgaccgtggtgttcgagagaatggtggccgaggacgagagacacagagacatcatcgagcagcccgtgctggtgcagggcaacagcaacagaagaagcgtgagcaccctgaagccctgcgccaaggacgcctacatgctgttccaggacctgtgccagctggtgaacgccgacgccccctactggctggtgggcatgaccgagatgaccagaaccttcggcctggagctgctggagagcgtgctgaacgacttcccccaggtgttcctgcagcaccaggagttcagcttcctgctgaaggagagagtgtgccccctggtgatcaagctgttcagccccaacatcaagttcagacagggcagcagcaccagcagcagccccgcccccgtggagaagccctacttccccatctgcatgagactgctgagagtggtgagcgtgctgatcaagcagttctacagcctgctggtgaccgagtgcgagatcttcctgagcctgctggtgaagttcctggacgccgacaagccccagtggctgagagccgtggccgtggagagcatccacagattctgcgtgcagccccagctgctgagaagcttctgccagagctacgacatgaagcagcacagcaccaaggtgttcagagacatcgtgaacgccctgggcagcttcatccagagcctgttcctggtgccccccaccggcaaccccgccaccagcaaccaggccggcaacaacaacctgggcggcagcgtgagcgcccccgccaacagcggcatggtgggcatcggcggcggcgtgaccctgctgcccgccttcgagtacagaggcacctggatccccatcctgaccatcaccgtgcagggcagcgccaaggccacctacctggagatgctggacaaggtggagccccccaccatccccgagggctacgccatgagcgtggccttccactgcctgctggacctggtgagaggcatcaccagcatgatcgagggcgagctgggcgagctggagaccgagtgccagaccaccaccgaggagggcagcagccccacccagagcaccgagcagcaggacctgcagagcaccagcgaccagatggacaaggagatcgtgagcagagccgtgtgggaggagatggtgaacgcctgctggtgcggcctgctggccgccctgagcctgctgctggacgccagcaccgacgaggccgccaccgagaacatcctgaaggccgagctgaccatggccgccctgtgcggcagactgggcctggtgaccagcagagacgccttcatcaccgccatctgcaagggcagcctgcccccccactacgccctgaccgtgctgaacaccaccaccgccgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgagaaccctgctgaacctggcccactgccacggcgccgtgctgggcaccagctggcagctggtgctggccaccctgcagcacctggtgtggatcctgggcctgaagcccagcagcggcggcgccctgaagcccggcagagccgtggagggccccagcaccgtgctgaccaccgccgtgatgaccgacctgcccgtgatcagcaacatcctgagcagactgttcgagagcagccagtacctggacgacgtgagcctgcaccacctgatcaacgccctgtgcagcctgagcctggaggccatggacatggcctacggcaacaacaaggagcccagcctgttcgccgtggccaagctgctggagaccggcctggtgaacatgcacagaatcgagatcctgtggagacccctgaccggccacctgctggaggtgtgccagcaccccaacagcagaatgagagagtggggcgccgaggccctgaccagcctgatcaaggccggcctgaccttcaaccacgacccccccctgagccagaaccagagactgcagctgctgctgctgaaccccctgaaggagatgagcaacatcaaccaccccgacatcagactgaagcagctggagtgcgtgctgcagatcctgcagagccagggcgacagcctgggccccggctggcccctggtgctgggcgtgatgggcgccatcagaaacgaccagggcgagagcctgatcagaaccgccttccagtgcctgcagctggtggtgaccgacttcctgcccaccatgccctgcacctgcctgcagatcgtggtggacgtggccggcagcttcggcctgcacaaccaggagctgaacatcagcctgaccagcatcggcctgctgtggaacatcagcgactacttcttccagagaggcgagaccatcgagaaggagctgaacaaggaggaggccgcccagcagaagcaggccgaggagaagggcgtggtgctgaacagacccttccaccccgccccccccttcgactgcctgtggctgtgcctgtacgccaagctgggcgagctgtgcgtggaccccagacccgccgtgagaaagagcgccggccagaccctgttcagcaccatcggcgcccacggcaccctgctgcagcacagcacctggcacaccgtgatctggaaggtgctgttccacctgctggacagagtgagagagagcagcaccaccgccgacaaggagaagatcgagagcggcggcggcaacatcctgatccaccacagcagagacaccgccgagaagcagtgggccgagacctgggtgctgaccctggccggcgtggccagaatcttcaacaccagaagatacctgctgcagcccctgggcgacttcagcagagcctgggacgtgctgctggaccacatccagagcgccgccctgagcaagaacaacgaggtgagcctggccgccctgaagagcttccaggagatcctgcagatcgtgagccccgtgagagacagcgacaagcccgagaccccccccgtggtgaacgtgcccgtgcccgtgctgatcggccccatcagcggcatgagcagacccttcgtgagaaccgacagcatcggcgagaagctgggcagatacagcagcagcgagccccccatcgtgaccgacgagctggaggacctgaacctgtggtgggccgcctggaacacctggtacagaatcggcagcgagagcaccaagccccccatcaccttcgacaagctgaccttcatccccagccagcccttcctgaccgccctgatccagatcttccccgccctgtaccagcacatcaagaccggcttcaacatggacgacctgcagaagctgggcgtgatcctgcacagcgccatcagcgtgcccatcagcagcgacgccagccccttcatcctgcccagctacaccgaggccgtgctgaccagcctgcaggaggccgtgctgaccgccctggacgtgctgcagaaggccatctgcgtgggccccgagaacatgcagatcatgtaccccgccatcttcgaccagctgctggccttcgtggagttcagctgcaagcccccccagtacggccagctggagaccaagcacatcgccaacgccaagtacaaccagatccagctgttcgcccccgccgagtgggtggccctgaactacgtgcccttcgccgagagaagcctggaggtggtggtggacctgtaccagaagaccgcctgccacaaggccgtggtgaacgagaaggtgctgcagaacatcatcaagaccctgagagtgcccctgagcctgaagtacagctgccccagcgagagcacctggaagctggccgtgagcagcctgctgagagtgctgagcatcggcctgcccgtggccagacagcacgccagcagcggcaagttcgacagcatgtggcccgagctggccaacaccttcgaggacttcctgttcaccaagagcatcccccccgacaacctgagcatccaggagttccagagaaacgagaacatcgacgtggaggtggtgcagctgatcagcaacgagatcctgccctacgccaacttcatccccaaggagttcgtgggccagatcatgaccatgctgaacaagggcagcatccacagccagagcagcagcttcaccgaggccgagatcgacatcagactgagagaggagttcagcaagatgtgcttcgagaccctgctgcagttcagcttcagcaacaaggtgaccaccccccaggagggctacatcagcagaatggccctgagcgtgctgctgaagagaagccaggacgtgctgcacagatacatcgaggacgagagactgagcggcaagtgccccctgcccagacagcaggtgaccgagatcatcttcgtgctgaaggccgtgagcaccctgatcgacagcctgaagaagacccagcccgagaacgcctgcatcagcctgttcggcatccccccctacttctag

SEQ ID NO: 22574 - DNA, 2703 bp, Artificial Sequence
  Description of Artificial Sequence: Synthetic coding sequence
atgctgctgtacagaggcgcccccgccggccccggcgcccccggctgcggcctggccagacccggcggcggcccccaggccttcggcatcagactgagcaccatgagccccagatacctgcagagcaacagcagcagccacaccagacccttcagcgccatcgccgagctgctggacaacgccgtggaccccgacgtgagcgccagaaccgtgttcatcgacgtggaggaggtgaagaacaagagctgcctgaccttcaccgacgacggctgcggcatgaccccccacaagctgcacagaatgctgagcttcggcttcaccgacaaggtgatcaagaagagccagtgccccatcggcgtgttcggcaacggcttcaagagcggcagcatgagactgggcaaggacgccctggtgttcaccaagaacggcggcaccctgaccgtgggcctgctgagccagacctacctggagtgcgtgcaggcccaggccgtgatcgtgcccatcgtgcccttcaaccagcagaacaagaagatgatcatcaccgaggacagcctgcccagcctggaggccatcctgaactacagcatcttcaacagagagaacgacctgctggcccagttcgacgccatccccggcaagaagggcaccagagtgctgatctggaacatcagaagaaacaagaacggcaagagcgagctggacttcgacaccgaccagtacgacatcctggtgagcgacttcgacaccgaggagaagatgaccggcggcgtgaccagcgagctgcccgagaccgagtacagcctgagagccttctgcggcatcctgtacatgaagcccagaatgaagatcttcctgagacagaagaaggtgaccacccagatgatcgccaagagcctggccaacgtggagtacgacacctacaagcccaccttcaccaacaagcaggtgagaatcaccttcggcttcagctgcaagaacagcaaccagttcggcatcatgatgtaccacaacaacagactgatcaagagcttcgagaaggtgggctgccaggtgaagcccaccagaggcgagggcgtgggcgtgatcggcgtgatcgagtgcaacttcctgaagcccgcctacaacaagcaggacttcgagtacaccaaggagtacagactgaccatcaacgccctggcccagaagctgaacgcctactggaaggagaagaccagccaggacaacttcgagaccagcaccgtggccagacccatccccaaggtgcccgaccagacctgggtgcagtgcgacgagtgcctgaagtggagaaagctgcccggcaagatcgaccccagcatgctgcccgccagatggttctgctactacaacagccaccccaagtacagaagatgcagcgtgcccgaggagcaggagctgaccgacgaggacctgtgcctgagcaaggccaagaagcaggagcagaccgtggaggagaagaagaagatgcccatggagaacgagaaccaccaggtgttcagcaacccccccaagatcctgaccgtgcaggagatggccggcctgaacaacaagaccatcggctacgagggcatccacagccccagcgtgctgcccagcggcggcgaggagagcagaagccccagcctgcagctgaagcccctggacagcagcgtgctgcagttcagcagcaagtacaagtggatcctgggcgaggagcccgtggagaagagaagaagactgcagaacgagatgaccacccccagcctggactacagcatgcccgccccctacagaagagtggaggcccccgtggcctaccccgagggcgagaacagccacgacaagagcagcagcgagagaagcacccccccctacctgttccccgagtaccccgaggccagcaagaacaccggccagaacagagaggtgagcatcctgtaccccggcgccaaggaccagagacagggcagcctgctgcccgaggagctggaggaccagatgcccagactggtggccgaggagagcaacagaggcagcaccaccatcaacaaggaggaggtgaacaagggccccttcgtggccgtggtgggcgtggccaagggcgtgagagacagcggcgcccccatccagctgatccccttcaacagagaggagctggccgagagaagaaaggccgtggagagctggaaccccgtgccctacagcgtggccagcgccgccatccccgccgccgccatcggcgagaaggccagaggctacgaggagagcgagggccacaacacccccaagctgaagaaccagagagagctggaggagctgaagagaaccaccgagaagctggagagagtgctggccgagagaaacctgttccagcagaaggtggaggagctggagcaggagagaaaccactggcagagcgagttcaagaaggtgcagcacgagctggtgatctacagcacccaggaggccgagggcctgtactggagcaagaagcacatgggctacagacaggccgagttccagatcctgaaggccgagctggagagaaccaaggaggagaagcaggagctgaaggagaagctgaaggagaccgagacccacctggagatgctgcagaaggcccagggcttcggcaaggcctacgccgccacctaccccagacagctgagcccctacttctgcccccccagcctgggcgccagctag

SEQ ID NO: 22575 - DNA, 2814 bp, Artificial Sequence
  Description of Artificial Sequence: Synthetic coding sequence
atgctgctgtacagaggcgcccccgccggccccggcgcccccggctgcggcctggccagacccggcggcggcccccaggccttcggcatcagactgagcaccatgagccccagatacctgcagagcaacagcagcagccacaccagacccttcagcgccatcgccgagctgctggacaacgccgtggaccccgacgtgagcgccagaaccgtgttcatcgacgtggaggaggtgaagaacaagagctgcctgaccttcaccgacgacggctgcggcatgaccccccacaagctgcacagaatgctgagcttcggcttcaccgacaaggtgatcaagaagagccagtgccccatcggcgtgttcggcaacggcttcaagagcggcagcatgagactgggcaaggacgccctggtgttcaccaagaacggcggcaccctgaccgtgggcctgctgagccagacctacctggagtgcgtgcaggcccaggccgtgatcgtgcccatcgtgcccttcaaccagcagaacaagaagatgatcatcaccgaggacagcctgcccagcctggaggccatcctgaactacagcatcttcaacagagagaacgacctgctggcccagttcgacgccatccccggcaagaagggcaccagagtgctgatctggaacatcagaagaaacaagaacggcaagagcgagctggacttcgacaccgaccagtacgacatcctggtgagcgacttcgacaccgaggagaagatgaccggcggcgtgaccagcgagctgcccgagaccgagtacagcctgagagccttctgcggcatcctgtacatgaagcccagaatgaagatcttcctgagacagaagaaggtgaccacccagatgatcgccaagagcctggccaacgtggagtacgacacctacaagcccaccttcaccaacaagcaggtgagaatcaccttcggcttcagctgcaagaacagcaaccagttcggcatcatgatgtaccacaacaacagactgatcaagagcttcgagaaggtgggctgccaggtgaagcccaccagaggcgagggcgtgggcgtgatcggcgtgatcgagtgcaacttcctgaagcccgcctacaacaagcaggacttcgagtacaccaaggagtacagactgaccatcaacgccctggcccagaagctgaacgcctactggaaggagaagaccagccaggacaacttcgagaccagcaccgtggccagacccatccccaaggtgcccgaccagacctgggtgcagtgcgacgagtgcctgaagtggagaaagctgcccggcaagatcgaccccagcatgctgcccgccagatggttctgctactacaacagccaccccaagtacagaagatgcagcgtgcccgaggagcaggagctgaccgacgaggacctgtgcctgagcaaggccaagaagcaggagcagaccgtggaggagaagaagaagatgcccatggagaacgagaaccaccaggtgttcagcaacccccccaagatcctgaccgtgcaggagatggccggcctgaacaacaagaccatcggctacgagggcatccacagccccagcgtgctgcccagcggcggcgaggagagcagaagccccagcctgcagctgaagcccctggacagcagcgtgctgcagttcagcagcaagtacaagtggatcctgggcgaggagcccgtggagaagagaagaagactgcagaacgagatgaccacccccagcctggactacagcatgcccgccccctacagaagagtggaggcccccgtggcctaccccgagggcgagaacagccacgacaagagcagcagcgagagaagcacccccccctacctgttccccgagtaccccgaggccagcaagaacaccggccagaacagagaggtgagcatcctgtaccccggcgccaaggaccagagacagggcagcctgctgcccgaggagctggaggaccagatgcccagactggtggccgaggagagcaacagaggcagcaccaccatcaacaaggaggaggtgaacaagggccccttcgtggccgtggtgggcgtggccaagggcgtgagagacagcggcgcccccatccagctgatccccttcaacagagaggagctggccgagagaagaaaggccgtggagagctggaaccccgtgccctacagcgtggccagcgccgccatccccgccgccgccatcggcgagaaggccagaggctacgaggagagcgagggccacaacacccccaagctgaagaaccagagagagctggaggagctgaagagaaccaccgagaagctggagagagtgctggccgagagaaacctgttccagcagaaggtggaggagctggagcaggagagaaaccactggcagagcgagttcaagaaggtgcagcacgagctggtgatctacagcacccaggaggccgagggcctgtactggagcaagaagcacatgggctacagacaggccgagttccagatcctgaaggccgagctggagagaaccaaggaggagaagcaggagctgaaggagaagctgaaggagaccgagacccacctggagatgctgcagaaggcccaggtgagctacagaacccccgagggcgacgacctggagagagccctggccaagctgaccagactgagaatccacgtgagctacctgctgaccagcgtgctgccccacctggagctgagagagatcggctacgacagcgagcaggtggacggcatcctgtacaccgtgctggaggccaaccacatcctggactag

SEQ ID NO: 22576 - DNA, 1947 bp, Artificial Sequence
  Description of Artificial Sequence: Synthetic coding sequence
atgaccggcggcgtgaccagcgagctgcccgagaccgagtacagcctgagagccttctgcggcatcctgtacatgaagcccagaatgaagatcttcctgagacagaagaaggtgaccacccagatgatcgccaagagcctggccaacgtggagtacgacacctacaagcccaccttcaccaacaagcaggtgagaatcaccttcggcttcagctgcaagaacagcaaccagttcggcatcatgatgtaccacaacaacagactgatcaagagcttcgagaaggtgggctgccaggtgaagcccaccagaggcgagggcgtgggcgtgatcggcgtgatcgagtgcaacttcctgaagcccgcctacaacaagcaggacttcgagtacaccaaggagtacagactgaccatcaacgccctggcccagaagctgaacgcctactggaaggagaagaccagccaggacaacttcgagaccagcaccgtggccagacccatccccaaggtgcccgaccagacctgggtgcagtgcgacgagtgcctgaagtggagaaagctgcccggcaagatcgaccccagcatgctgcccgccagatggttctgctactacaacagccaccccaagtacagaagatgcagcgtgcccgaggagcaggagctgaccgacgaggacctgtgcctgagcaaggccaagaagcaggagcagaccgtggaggagaagaagaagatgcccatggagaacgagaaccaccaggtgttcagcaacccccccaagatcctgaccgtgcaggagatggccggcctgaacaacaagaccatcggctacgagggcatccacagccccagcgtgctgcccagcggcggcgaggagagcagaagccccagcctgcagctgaagcccctggacagcagcgtgctgcagttcagcagcaagtacaagtggatcctgggcgaggagcccgtggagaagagaagaagactgcagaacgagatgaccacccccagcctggactacagcatgcccgccccctacagaagagtggaggcccccgtggcctaccccgagggcgagaacagccacgacaagagcagcagcgagagaagcacccccccctacctgttccccgagtaccccgaggccagcaagaacaccggccagaacagagaggtgagcatcctgtaccccggcgccaaggaccagagacagggcagcctgctgcccgaggagctggaggaccagatgcccagactggtggccgaggagagcaacagaggcagcaccaccatcaacaaggaggaggtgaacaagggccccttcgtggccgtggtgggcgtggccaagggcgtgagagacagcggcgcccccatccagctgatccccttcaacagagaggagctggccgagagaagaaaggccgtggagagctggaaccccgtgccctacagcgtggccagcgccgccatccccgccgccgccatcggcgagaaggccagaggctacgaggagagcgagggccacaacacccccaagctgaagaaccagagagagctggaggagctgaagagaaccaccgagaagctggagagagtgctggccgagagaaacctgttccagcagaaggtggaggagctggagcaggagagaaaccactggcagagcgagttcaagaaggtgcagcacgagctggtgatctacagcacccaggaggccgagggcctgtactggagcaagaagcacatgggctacagacaggccgagttccagatcctgaaggccgagctggagagaaccaaggaggagaagcaggagctgaaggagaagctgaaggagaccgagacccacctggagatgctgcagaaggcccagggcttcggcaaggcctacgccgccacctaccccagacagctgagcccctacttctgcccccccagcctgggcgccagctag

SEQ ID NO: 22577 - DNA, 384 bp, Artificial Sequence
  Description of Artificial Sequence: Synthetic coding sequence
atgagacccctggacatcgacgaggtggaggcccccgaggaggtggaggtgctggagcccgaggaggacttcgagcagttcctgctgcccgtgatcaacgagatgagagaggacatcgccagcctgatcagagagcacggcagagcctacctgagaaccagaagcaagctgtgggagatggacaacatgctgatccagatcaagacccaggtggaggccagcgaggagagcgccctgaaccacgtgcagcaccccagcggcgaggccgacgagagagtgagcgagctgtgcgagaaggccgaggagaaggccaaggagatcgccaagatggccgagatgctggtggagctggtgtggagaatcgagagaagcgagagcagctag

SEQ ID NO: 22578 - DNA, 471 bp, Artificial Sequence
  Description of Artificial Sequence: Synthetic coding sequence
atggccgccgccggcgagggcacccccagcagcagaggccccagaagagacccccccagaagaccccccagaaacggccacggcaagctgctgttcaaggacggcagctactacgagggcgccttcgtggacggcgagatcaccggcgagggcagaagacactgggcctggagcggcgacaccttcagcggccagttcgtgctgggcgagccccagggctacggcgtgatggagtacaaggccggcggctgctacgagggcgaggtgagccacggcatgagagagggccacggcttcctggtggacagagacggccaggtgtaccagggcagcttccacgacaacaagagacacggccccggccagatgctgttccagaacggcgacaagtacgacggcgactgggtgagagacagaagacagggccacggcgtgctgagatgcgccgacggcagcacctacaagctgtag

SEQ ID NO: 22579 - DNA, 1053 bp, Artificial Sequence
  Description of Artificial Sequence: Synthetic coding sequence
atggccgccgccggcgagggcacccccagcagcagaggccccagaagagacccccccagaagaccccccagaaacggctacggcgtgtacgtgtaccccaacagcttcttcagatacgagggcgagtggaaggccggcagaaagcacggccacggcaagctgctgttcaaggacggcagctactacgagggcgccttcgtggacggcgagatcaccggcgagggcagaagacactgggcctggagcggcgacaccttcagcggccagttcgtgctgggcgagccccagggctacggcgtgatggagtacaaggccggcggctgctacgagggcgaggtgagccacggcatgagagagggccacggcttcctggtggacagagacggccaggtgtaccagggcagcttccacgacaacaagagacacggccccggccagatgctgttccagaacggcgacaagtacgacggcgactgggtgagagacagaagacagggccacggcgtgctgagatgcgccgacggcagcacctacaagggccagtggcacagcgacgtgttcagcggcctgggcagcatggcccactgcagcggcgtgacctactacggcctgtggatcaacggccaccccgccgagcaggccaccagaatcgtgatcctgggccccgaggtgatggaggtggcccagggcagccccttcagcgtgaacgtgcagctgctgcaggaccacggcgagatcgccaagagcgagagcggcagagtgctgcagatcagcgccggcgtgagatacgtgcagctgagcgcctacagcgaggtgaacttcttcaaggtggacagagacaaccaggagaccctgatccagacccccttcggcttcgagtgcatcccctaccccgtgagcagccccgccgccggcgtgcccggccccagagccgccaagggcggcgccgaggccgacgtgcccctgcccagaggcgacctggagctgcacctgggcgccctgcacggccaggaggacacccccggcggcctgctgggcagcagcctgttctag

SEQ ID NO: 22580 - DNA, 1494 bp, Artificial Sequence
  Description of Artificial Sequence: Synthetic coding sequence
atggccgccgccggcgagggcacccccagcagcagaggccccagaagagacccccccagaagaccccccagaaacggctacggcgtgtacgtgtaccccaacagcttcttcagatacgagggcgagtggaaggccggcagaaagcacggccacggcaagctgctgttcaaggacggcagctactacgagggcgccttcgtggacggcgagatcaccggcgagggcagaagacactgggcctggagcggcgacaccttcagcggccagttcgtgctgggcgagccccagggctacggcgtgatggagtacaaggccggcggctgctacgagggcgaggtgagccacggcatgagagagggccacggcttcctggtggacagagacggccaggtgtaccagggcagcttccacgacaacaagagacacggccccggccagatgctgttccagaacggcgacaagtacgacggcgactgggtgagagacagaagacagggccacggcgtgctgagatgcgccgacggcagcacctacaagggccagtggcacagcgacgtgttcagcggcctgggcagcatggcccactgcagcggcgtgacctactacggcctgtggatcaacggccaccccgccgagcaggccaccagaatcgtgatcctgggccccgaggtgatggaggtggcccagggcagccccttcagcgtgaacgtgcagctgctgcaggaccacggcgagatcgccaagagcgagagcggcagagtgctgcagatcagcgccggcgtgagatacgtgcagctgagcgcctacagcgaggtgaacttcttcaaggtggacagagacaaccaggagaccctgatccagacccccttcggcttcgagtgcatcccctaccccgtgagcagccccgccgccggcgtgcccggccccagagccgccaagggcggcgccgaggccgacgtgcccctgcccagaggcgacctggagctgcacctgggcgccctgcacggccaggaggacacccccggcggcctgctggccagaggccacgccccccactgccccggcgcctgccagagagtggagcagggctgcgccgagttcaccgacgtgctgctgggcccccccccccccggctaccaccccttcctgttcctggacagcctgcacaagaaggccggcggcagaagcagaggcggcctgcaccccagaggcaccccccccaccgcccaggagccccccggcggcagcagacccgagggcagagccaccgaggagcaggccgccgccgcccacctgggcgagtacgtgctgatgatcagagacgtgaccaccccccccttcctgggcagaagactgccccccgccttcaagcacctgagagtggtggccaagagagccggccagcccccccacgtgctggaggagggccccgaggccagcagcagctggcaggccgcccacagctgcacccccgagccccccgcccccagatag

SEQ ID NO: 22581 - DNA, 456 bp, Artificial Sequence
  Description of Artificial Sequence: Synthetic coding sequence
accgccaccaccagactgcccctgctgagagtggacagcgtgagagtgagccccagaaacggcgacaagtacgacggcgactgggtgagagacagaagacagggccacggcgtgctgagatgcgccgacggcagcacctacaagggccagtggcacagcgacgtgttcagcggcctgggcagcatggcccactgcagcggcgtgacctactacggcctgtggatcaacggccaccccgccgagcaggccaccagaatcgtgatcctgggccccgaggtgatggaggtggcccagggcagccccttcagcgtgaacgtgcagctgctgcaggaccacggcgagatcgccaagaacggcgtgagcctgctgctgagcagactggagtgcagcggcgccatgagcgccctgagaaacctgagactgcccagaagcagcgacagcgccctggccagctag

SEQ ID NO: 22582 - DNA, 558 bp, Artificial Sequence
  Description of Artificial Sequence: Synthetic coding sequence
gtgaccggcagctgctacctgaagatggccgtgatcaccaagggcagactgtggaccgagagaagcagagagaaggccgccggcaccggccccggccaggagacccccagcctggacagcctgttctgggagagcctgaaggccaccgccagctggagcaccaagcccgccgacgtgatgaagggcagaagccccaccgcctgcggcaaggacaccggcttctggtggaccggcatggacaagtgcaccagagcccccagcatgaccaccagaggcaccgccctgggcagatgcagcttcagaaccgtgaccagcaccaccgccaccggcagcggcaccggcgtgagagacaccggctgctgcgccgcccccaccgccccccccaccagcagcgacccccccatctacagcagaagaaacagcagaagacacagactgctgcccagacaccacgagctgagagtgggcgaggccccccccggcgacctgttcagcctgagcaccgccggcgtgttcagcgccaacagagtgagctgcctggccgccagcatcccctag

SEQ ID NO: 22583 - DNA, 240 bp, Artificial Sequence
  Description of Artificial Sequence: Synthetic coding sequence
atgaacggcttcggcagactggagcacttcagcggcgccgtgtacgagggccagttcaaggacaacatgttccacggcctgggcacctacaccttccccaacggcgccaagtacaccggcaacttcaacgagaacagagtggagggcgagggcgagtacaccgacatccagggcctggagtggagcggcaacttccacttcaccgccgcccccgacctgaagctgaagctgcacatgtag

SEQ ID NO: 22584 - DNA, 240 bp, Artificial Sequence; identical to SEQ ID NO: 22583
  Description of Artificial Sequence: Synthetic coding sequence

SEQ ID NO: 22585 - DNA, 240 bp, Artificial Sequence; identical to SEQ ID NO: 22583
  Description of Artificial Sequence: Synthetic coding sequence

SEQ ID NO: 22586 - DNA, 723 bp, Artificial Sequence
  Description of Artificial Sequence: Synthetic coding sequence
atgcccgtgagcaagtgccccaagaagagcgagagcctgtggaagggctgggacagaaaggcccagagaaacggcctgagaagccaggtgtacgccgtgaacggcgactactacgtgggcgagtggaaggacaacgtgaagcacggcaagggcacccaggtgtggaagaagaagggcgccatctacgagggcgactggaagttcggcaagagagacggctacggcaccctgagcctgcccgaccagcagaccggcaagtgcagaagagtgtacagcggctggtggaagggcgacaagaagagcggctacggcatccagttcttcggccccaaggagtactacgagggcgactggtgcggcagccagagaagcggctggggcagaatgtactacagcaacggcgacatctacgagggccagtgggagaacgacaagcccaacggcgagggcatgctgagactgaagaacggcaacagatacgagggctgctgggagagaggcatgaagaacggcgccggcagattcttccacctggaccacggccagctgttcgagggcttctgggtggacaacatggccaagtgcggcaccatgatcgacttcggcagagacgaggcccccgagcccacccagttccccatccccgaggtgaagatcctggaccccgacggcgtgctggccgaggccctggccatgttcagaaagaccgaggagggcgactag

SEQ ID NO: 22587 - DNA, 441 bp, Artificial Sequence
  Description of Artificial Sequence: Synthetic coding sequence
atgaccctgaccaagggcagcttcacctacagcagcggcgaggagtacagaggcgagtggaaggagggcagaagacacggcttcggccagctgatgttcgccgacggcggcacctacctgggccacttcgagaacggcctgttcaacggcttcggcgtgctgaccttcagcgacggcagcagatacgagggcgagttcgcccagggcaagttcaacggcgtgggcgtgttcatcagatacgacaacatgaccttcgagggcgagttcaagaacggcagagtggacggcttcggcctgctgaccttccccgacggcagccacggcatccccagaaacgagggcctgttcgagaacaacaagctgctgagaagagagaagtgcagcgccatcgtgcagagagcccagagcgccagcaagagcgccagaaacctgaccgcctag

SEQ ID NO: 22588 - DNA, 615 bp, Artificial Sequence
  Description of Artificial Sequence: Synthetic coding sequence
atggcctggagcagagccggccccatgagaagcggcgtggcccccggctgcctgggcaacagccagtgggccgccggcatcgtgcccagcgccgtggcccaggacggcggcgtgaagtggggcaacagatggtggagatggagaagagccagatggcagcccggcgcccaccagagaaagagccccagaagatggaaccccgccagcagaagagacggccaccccgagagacccgcccccggcagaagacacggcttcggccagctgatgttcgccgacggcggcacctacctgggccacttcgagaacggcctgttcaacggcttcggcgtgctgaccttcagcgacggcagcagatacgagggcgagttcgcccagggcaagttcaacggcgtgggcgtgttcatcagatacgacaacatgaccttcgagggcgagttcaagaacggcagagtggacggcttcggcctgctgaccttccccgacggcagccacggcatccccagaaacgagggcctgttcgagaacaacaagctgctgagaagagagaagtgcagcgccatcgtgcagagagcccagagcgccagcaagagcgccagaaacctgaccgcctag

SEQ ID NO: 22589 - DNA, 441 bp, Artificial Sequence; identical to SEQ ID NO: 22587
  Description of Artificial Sequence: Synthetic coding sequence

SEQ ID NO: 22590 - DNA, 486 bp, Artificial Sequence
  Description of Artificial Sequence: Synthetic coding sequence
atggagtacaccggcagcaagtacatcggcgagtacgtggacggcagaatggagggcaaggccaagtacatcctgcccaccgagaccatctacgtgggcgagatgaaggacggcatgttccacggcgagggcaccctgtacttccccagcggcagccagtacgacgccatctgggagaacggcctggccatcaagggcacctacaccttcagcgacggcctgcactacgacgagaagaactggcactactgcgacggctacgacagaagattctacaccgagatcctgaacggcctgaagcccgccggcatggcccagctgaccaacatggacccccccagaaagatccccaagggctactacgactgcggcgacggcttctacaaccccgtgaccagagtggtgaaggactacagaaacagattcctgagaaacgccgacgacgacgagcacgagtggatcaccagaacctgcagaaagggctag

SEQ ID NO: 22591 - DNA, 333 bp, Artificial Sequence
  Description of Artificial Sequence: Synthetic coding sequence
atggagggcaaggccaagtacatcctgcccaccgagaccatctacgtgggcgagatgaaggacggcatgttccacggcgagggcaccctgtacttccccagcggcagccagtacgacgccatctgggagaacggcctggccatcaagggcacctacaccttcagcgacggcctgcactacgacgagaagaactggcactactgcgacggctacgacagaagattctacaccgagatcctgaacggcctgaagcccgccggcatggcccagctgaccaacatggacccccccagaaagatccccaagggctactacgactgcggcgacggctag

SEQ ID NO: 22592 - DNA, 528 bp, Artificial Sequence
  Description of Artificial Sequence: Synthetic coding sequence
atggagtacaccggcagcaagtacatcggcgagtacgtggacggcagaatggagggcaaggccaagtacatcctgcccaccgagaccatctacgtgggcgagatgaaggacggcatgttccacggcgagggcaccctgtacttccccagcggcagccagtacgacgccatctgggagaacggcctggccatcaagggcacctacaccttcagcgacggcctgcactacgacgagaagaactggcactactgcgacggctacgacagaagattctacaccgagatcctgaacggcctgaagcccgccggcatggcccagctgaccaacatggacccccccagaaagatccccaagggctactacgactgcggcgacggcttctacaaccccgtgaccagagtggtgaaggactacagaaacagattcctgagaaacgccggcagattcctgcccaccctgcagcacgtgttcagcagccccacctacgagtacgtgcacctgtacgtgcagatgtacgcccacacctag

SEQ ID NO: 22593 - DNA, 1416 bp, Artificial Sequence
  Description of Artificial Sequence: Synthetic coding sequence
atggccgcccccgagcccctgagccccgccggcggcgccggcgaggaggcccccgaggaggacgaggacgaggccgaggccgaggaccccgagagacccaacgccggcgccggcggcggcagaagcggcggcggcggcagcagcgtgagcggcggcggcggcggcggcggcgccggcgccggcggctgcggcggccccggcggcgccctgaccagaagagccgtgaccctgagagtgctgctgaaggacgccctgctggagcccggcgccggcgtgctgagcatctactacctgggcaagaagttcctgggcgacctgcagcccgacggcagaatcatgtggcaggagaccggccagaccttcaacagccccagcgcctgggccacccactgcaagaagctggtgaaccccgccaagaagagcggctgcggctgggccagcgtgaagtacaagggccagaagctggacaagtacaaggccacctggctgagactgcaccagctgcacacccccgccaccgccgccgacgagagccccgccagcgagggcgaggaggaggagctgctgatggaggaggaggaggaggacgtgctggccggcgtgagcgccgaggacaagagcagaagacccctgggcaagagccccagcgagcccgcccaccccgaggccaccacccccggcaagagagtggacagcaagatcagagtgcccgtgagatactgcatgctgggcagcagagacctggccagaaacccccacaccctggtggaggtgaccagcttcgccgccatcaacaagttccagcccttcaacgtggccgtgagcagcaacgtgctgttcctgctggacttccacagccacctgaccagaagcgaggtggtgggctacctgggcggcagatgggacgtgaacagccagatgctgaccgtgctgagagccttcccctgcagaagcagactgggcgacgccgagaccgccgccgccatcgaggaggagatctaccagagcctgttcctgagaggcctgagcctggtgggctggtaccacagccacccccacagccccgccctgcccagcctgcaggacatcgacgcccagatggactaccagctgagactgcagggcagcagcaacggcttccagccctgcctggccctgctgtgcagcccctactacagcggcaaccccggccccgagagcaagatcagccccttctgggtgatgcccccccccgagatgctgctggtggagttctacaagggcagccccgacctggtgagactgcaggagccctggagccaggagcacacctacctggacaagctgaagatcagcctggccagcagaacccccaaggaccagagcctgtgccacgtgctggagcaggtgtgcggcgtgctgaagcagggcagctag

SEQ ID NO: 22594 - DNA, 1356 bp, Artificial Sequence
  Description of Artificial Sequence: Synthetic coding sequence
atggccgcccccgagcccctgagccccgccggcggcgccggcgaggaggcccccgaggaggacgaggacgaggccgaggccgaggaccccgagagacccaacgccggcgccggcggcggcagaagcggcggcggcggcagcagcgtgagcggcggcggcggcggcggcggcgccggcgccggcggctgcggcggccccggcggcgccctgaccagaagagccgtgaccctgagagtgctgctgaaggacgccctgctggagcccggcgccggcgtgctgagcatctactacctgggcaagaagttcctgggcgacctgcagcccgacggcagaatcatgtggcaggagaccggccagaccttcaacagccccagcgcctgggccacccactgcaagaagctggtgaaccccgccaagaagagcggctgcggctgggccagcgtgaagtacaagggccagaagctggacaagtacaaggccacctggctgagactgcaccagctgcacacccccgccaccgccgccgacgagagccccgccagcgagggcgaggaggaggagctgctgatggaggaggaggaggaggacgtgctggccggcgtgagcgccgaggacaagagcagaagacccctgggcaagagccccagcgagcccgcccaccccgaggccaccacccccggcaagagagtggacagcaagatcagagtgcccgtgagatactgcatgctgggcagcagagacctggccagaaacccccacaccctggtggaggtgaccagcttcgccgccatcaacaagttccagcccttcaacgtggccgtgagcagcaacgtgctgttcctgctgatctaccagagcctgttcctgagaggcctgagcctggtgggctggtaccacagccacccccacagccccgccctgcccagcctgcaggacatcgacgcccagatggactaccagctgagactgcagggcagcagcaacggcttccagccctgcctggccctgctgtgcagcccctactacagcggcaaccccggccccgagagcaagatcagccccttctgggtgatgcccccccccgagcagagacccagcgactacggcatccccatggacgtggagatggcctacgtgcaggacagcttcctgaccaacgacatcctgcacgagatgatgctgctggtggagttctacaagggcagccccgacctggtgagactgcaggagccctggagccaggagcacacctacctggacaagctgaagatcagcctggccagcagaacccccaaggaccagagcctgtgccacgtgctggagcaggtgtgcggcgtgctgaagcagggcagctag

SEQ ID NO: 22595 - DNA, 1035 bp, Artificial Sequence
  Description of Artificial Sequence: Synthetic coding sequence
tgagccagcatgctgcccgagcagctgtacttcctgcagagcccccccgaggaggagcccgagtaccaccccgacgccagcgcccaggagctgaacgtgagagagagcgacgtgagagtgtgcgacgagagcagctgcaagtacggcggcgtgtgcaaggaggacggcgacggcctgaagtgcgcctgccagttccagtgccacaccaactacatccccgtgtgcggcagcaacggcgacacctaccagaacgagtgcttcctgagaagagccgcctgcaagcaccagaaggagatcaccgtgatcgccagaggcccctgctacagcgacaacggcagcggcagcggcgagggcgaggaggagggcagcggcgccgaggtgcacagaaagcacagcaagtgcggcccctgcaagtacaaggccgagtgcgacgaggacgccgagaacgtgggctgcgtgtgcaacatcgactgcagcggctacagcttcaaccccgtgtgcgccagcgacggcagcagctacaacaacccctgcttcgtgagagaggccagctgcatcaagcaggagcagatcgacatcagacacctgggccactgcaccgacaccgacgacaccagcctgctgggcaagaaggacgacggcctgcagtacagacccgacgtgaaggacgccagcgaccagagagaggacgtgtacatcggcaaccacatgccctgccccgagaacctgaacggctactgcatccacggcaagtgcgagttcatctacagcacccagaaggccagctgcagatgcgagagcggctacaccggccagcactgcgagaagaccgacttcagcatcctgtacgtggtgcccagcagacagaagctgacccacgtgctgatcgccgccatcatcggcgccgtgcagatcgccatcatcgtggccatcgtgatgtgcatcaccagaaagtgccccaagaacaacagaggcagaagacagaagcagaacctgggccacttcaccagcgacaccagcagcagaatggtgtag

SEQ ID NO: 22596 - DNA, 573 bp, Artificial Sequence
  Description of Artificial Sequence: Synthetic coding sequence
ggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 22597 - DNA, 1146 bp, Artificial Sequence
  Description of Artificial Sequence: Synthetic coding sequence
atggccgccttcggcagacaggtgctggactggcacagactgatccccctgacctgggcctgcatggccagacagaccccccacctgggcgagcagagaagaaccaccgccagcctgctgagaaagctgaccaccgccagcaacggcggcgtgatcgaggagctgagctgcgtgagaagcaacaactacgtgcaggagcccgagtgcagaagaaacctggtgcagtgcctgctggagaagcagggcacccccgtggtgcagggcagcctggagctggagagagtgatgagcagcctgctggacatgggcttcagcaacgcccacatcaacgagctgctgagcgtgagaagaggcgccagcctgcagcagctgctggacatcatcagcgagttcatcctgctgggcctgaaccccgagcccgtgtgcgtggtgctgaagaagagcccccagctgctgaagctgcccatcatgcagatgagaaagagaagcagctacctgcagaagctgggcctgggcgagggcaagctgaagagagtgctgtactgctgccccgagatcttcaccatgagacagcaggacatcaacgacaccgtgagactgctgaaggagaagtgcctgttcaccgtgcagcaggtgaccaagatcctgcacagctgccccagcgtgctgagagaggacctgggccagctggagtacaagttccagtacgcctacttcagaatgggcatcaagcaccccgacatcgtgaagagcgagtacctgcagtacagcctgaccaagatcaagcagagacacatctacctggagagactgggcagataccagacccccgacaagaagggccagacccagatccccaaccccctgctgaaggacatcctgagagtgagcgaggccgagttcctggccagaaccgcctgcaccagcgtggaggagttccaggtgttcaagaagctgctggccagagaggaggaggagagcgagagcagcaccagcgacgacaagagagccagcctggacgaggacgaggacgacgacgacgaggaggacaacgacgaggacgacaacgacgaggacgacgacgacgaggacgacgacgaggccgaggacaacgacgaggacgaggacgacgacgaggaggagtag

SEQ ID NO: 22598 - DNA, 75 bp, Artificial Sequence
  Description of Artificial Sequence: Synthetic coding sequence
atggcccccagaggcttcagctgcctgctgctgagcaccagcgagatcgacctgcccgtgaagagaagaacctag

SEQ ID NO: 22599 - DNA, 75 bp, Artificial Sequence
  Description of Artificial Sequence: Synthetic coding sequence
atgaccaccagaggcttcagctgcctgctgctgctgatcagagagatcgacctgagcgccaagagaagaatctag

SEQ ID NO: 22600 - DNA, 75 bp, Artificial Sequence
  Description of Artificial Sequence: Synthetic coding sequence
atggccaccagaagattcagctgcctgctgctgagcaccagcgagatcgacctgagcgtgaagagaagaatctag

SEQ ID NO: 22601 - DNA, 87 bp, Artificial Sequence
  Description of Artificial Sequence: Synthetic coding sequence
atggccacccagggcttcagctgcctgctgctgagcgtgagcgagatcgacctgagcatgaagagacagtacaagcagatcagatag

SEQ ID NO: 22602 - DNA, 75 bp, Artificial Sequence
  Description of Artificial Sequence: Synthetic coding sequence
atggccacccccggcttcagctgcctgctgctgagcaccagcgagatcgacctgcccatgaagagaagagtgtag

SEQ ID NO: 22603 - DNA, 75 bp, Artificial Sequence
  Description of Artificial Sequence: Synthetic coding sequence
atgacccccagaggcttcagctgcctgctgctgcccaccagcgagaccgacctgcccgtgaagagaagaacctag

SEQ ID NO: 22604 - DNA, 75 bp, Artificial Sequence
  Description of Artificial Sequence: Synthetic coding sequence
atggccaccggcggcttcggctgcctgctgctgctgatcagagagatcgacctgagcgtgaagagacagatctag

SEQ ID NO: 22605 - DNA, 75 bp, Artificial Sequence
  Description of Artificial Sequence: Synthetic coding sequence
atggcccccagaggcttcagctgcctgctgctgagcaccagcgagatcgacctgcccgtgaagagaagagcctag

SEQ ID NO: 22606 - DNA, 75 bp, Artificial Sequence
  Description of Artificial Sequence: Synthetic coding sequence
atggccagaagaggcttcagctgcctgctgctgagcaccaccgccaccgacctgcccgtgaagagaagaacctag

SEQ ID NO: 22607 - DNA, 3447 bp, Artificial Sequence
  Description of Artificial Sequence: Synthetic coding sequence
atgcccctgttcaagaacaccagcgtgagcagcctgtacagcggctgcagactgaccctgctgagacccgagaaggacggcgccgccaccagagtggacgccgtgtgcacccacagacccgaccccaagagccccggcctggacagagagagactgtactggaagctgagccagctgacccacggcatcaccgagctgggcccctacaccctggacagacacagcctgtacgtgaacggcttcacccaccagagcagcatgaccaccaccagaacccccgacaccagcaccatgcacctggccaccagcagaacccccgccagcctgagcggccccatgaccgccagccccctgctggtgctgttcaccatcaacttcaccatcaccaacctgagatacgaggagaacatgcaccaccccggcagcagaaagttcaacaccaccgagagagtgctgcagggcctgctgagacccgtgttcaagaacaccagcgtgggccccctgtacagcggctgcagactgaccctgctgagacccaagaaggacggcgccgccaccaaggtggacgccatctgcacctacagacccgaccccaagagccccggcctggacagagagcagctgtactgggagctgagccagctgacccacagcatcaccgagctgggcccctacaccctggacagagacagcctgtacgtgaacggcttcacccagagaagcagcgtgcccaccaccagcatccccggcacccccaccgtggacctgggcaccagcggcacccccgtgagcaagcccggccccagcgccgccagccccctgctggtgctgttcaccctgaacttcaccatcaccaacctgagatacgaggagaacatgcagcaccccggcagcagaaagttcaacaccaccgagagagtgctgcagggcctgctgagaagcctgttcaagagcaccagcgtgggccccctgtacagcggctgcagactgaccctgctgagacccgagaaggacggcaccgccaccggcgtggacgccatctgcacccaccaccccgaccccaagagccccagactggacagagagcagctgtactgggagctgagccagctgacccacaacatcaccgagctgggcccctacgccctggacaacgacagcctgttcgtgaacggcttcacccacagaagcagcgtgagcaccaccagcacccccggcacccccaccgtgtacctgggcgccagcaagacccccgccagcatcttcggccccagcgccgccagccacctgctgatcctgttcaccctgaacttcaccatcaccaacctgagatacgaggagaacatgtggcccggcagcagaaagttcaacaccaccgagagagtgctgcagggcctgctgagacccctgttcaagaacaccagcgtgggccccctgtacagcggctgcagactgaccctgctgagacccgagaaggacggcgaggccaccggcgtggacgccatctgcacccacagacccgaccccaccggccccggcctggacagagagcagctgtacctggagctgagccagctgacccacagcatcaccgagctgggcccctacaccctggacagagacagcctgtacgtgaacggcttcacccacagaagcagcgtgcccaccaccagcaccggcgtggtgagcgaggagcccttcaccctgaacttcaccatcaacaacctgagatacatggccgacatgggccagcccggcagcctgaagttcaacatcaccgacaacgtgatgcagcacctgctgagccccctgttccagagaagcagcctgggcgccagatacaccggctgcagagtgatcgccctgagaagcgtgaagaacggcgccgagaccagagtggacctgctgtgcacctacctgcagcccctgagcggccccggcctgcccatcaagcaggtgttccacgagctgagccagcagacccacggcatcaccagactgggcccctacagcctggacaaggacagcctgtacctgaacggctacaacgagcccggccccgacgagccccccaccacccccaagcccgccaccaccttcctgccccccctgagcgaggccaccaccgccatgggctaccacctgaagaccctgaccctgaacttcaccatcagcaacctgcagtacagccccgacatgggcaagggcagcgccaccttcaacagcaccgagggcgtgctgcagcacctgctgagacccctgttccagaagagcagcatgggccccttctacctgggctgccagctgatcagcctgagacccgagaaggacggcgccgccaccggcgtggacaccacctgcacctaccaccccgaccccgtgggccccggcctggacatccagcagctgtactgggagctgagccagctgacccacggcgtgacccagctgggcttctacgtgctggacagagacagcctgttcatcaacggctacgccccccagaacctgagcatcagaggcgagtaccagatcaacttccacatcgtgaactggaacctgagcaaccccgaccccaccagcagcgagtacatcaccctgctgagagacatccaggacaaggtgaccaccctgtacaagggcagccagctgcacgacaccttcagattctgcctggtgaccaacctgaccatggacagcgtgctggtgaccgtgaaggccctgttcagcagcaacctggaccccagcctggtggagcaggtgttcctggacaagaccctgaacgccagcttccactggctgggcagcacctaccagctggtggacatccacgtgaccgagatggagagcagcgtgtaccagcccaccagcagcagcagcacccagcacttctacctgaacttcaccatcaccaacctgccctacagccaggacaaggcccagcccggcaccaccaactaccagagaaacaagagaaacatcgaggacgccctgaaccagctgttcagaaacagcagcatcaagagctacttcagcgactgccaggtgagcaccttcagaagcgtgcccaacagacaccacaccggcgtggacagcctgtgcaacttcagccccctggccagaagagtggacagagtggccatctacgaggagttcctgagaatgaccagaaacggcacccagctgcagaacttcaccctggacagaagcagcgtgctggtggacggctacagccccaacagaaacgagcccctgaccggcaacagcgacctgcccttctgggccgtgatcctgatcggcctggccggcctgctgggcgtgatcacctgcctgatctgcggcgtgctggtgaccaccagaagaagaaagaaggagggcgagtacaacgtgcagcagcagtgccccggctactaccagagccacctggacctggaggacctgcagtag

SEQ ID NO: 22608 - DNA, 750 bp, Artificial Sequence
  Description of Artificial Sequence: Synthetic coding sequence
atgaacagccagcagacccccgtgggcacccccaaggacaagagagtgagcaacacccccctgagaaccgtggacggcagccccatgatgaaggccatgtacagcgtggagatcaccgtggagaaggacaaggtgaccggcgagaccagagtgctgagcagcaccaccctgctgcccagacagcccctgcccctgggcatcaaggtgtacgaggacgagaccaaggtggtgcacgccgtggacggcaccgccgagaacggcatccaccccctgagcagcagcgaggtggacgagctgatccacaaggccgacgaggtgaccctgagcgaggccggcagcaccgccggcgccgccgagaccagaggcgccgtggagggcgccgccagaaccacccccagcagaagagagatcaccggcgtgcaggcccagcccggcgaggccaccagcggcccccccggcatccagcccggccaggagccccccgtgaccatgatcttcatgggctaccagaacgtggaggacgaggccgagaccaagaaggtgctgggcctgcaggacaccatcaccgccgagctggtggtgatcgaggacgccgccgagcccaaggagcccgccccccccaacggcagcgccgccgagaccgaggccgccagcagagaggagaaccaggccggccccgaggccaccaccagcgacccccaggacctggacatgaagaagcacagatgcaagtgctgcagcatcatgtag

SEQ ID NO: 22609 - DNA, 1344 bp, Artificial Sequence
  Description of Artificial Sequence: Synthetic coding sequence
accgccgccggccccctgctggtgcccttcaccctgaacttcaccatcaccaacctgcagtacgaggaggacatgcaccaccccggcagcagaaagttcaacaccaccgagagagtgctgcagggcctgctgggccccatgttcaagaacaccagcgtgggcctgctgtacagcggctgcagactgaccctgctgagacccgagaagaacggcgccgccaccggcatggacgccatctgcagccacagactggaccccaagagccccggcctgaacagagagcagctgtactgggagctgagccagctgacccacggcatcaaggagctgggcccctacaccctggacagaaacagcctgtacgtgaacggcttcacccacagaagcagcgtggcccccaccagcacccccggcaccagcaccgtggacctgggcaccagcggcacccccagcagcctgcccagccccaccaccgccgtgcccctgctggtgcccttcaccctgaacttcaccatcaccaacctgcagtacggcgaggacatgagacaccccggcagcagaaagttcaacaccaccgagagagtgctgcagggcctgctgggccccctgttcaagaacagcagcgtgggccccctgtacagcggctgcagactgatcagcctgagaagcgagaaggacggcgccgccaccggcgtggacgccatctgcacccaccacctgaacccccagagccccggcctggacagagagcagctgtactggcagctgagccagatgaccaacggcatcaaggagctgggcccctacaccctggacagaaacagcctgtacgtgaacggcttcacccacagaagcagcggcctgaccaccagcaccaccggccccctgctggtgcccttcaccctgaacttcaccatcaccaacctgcagtacgaggagaacatgggccaccccggcagcagaaagttcaacatcaccgagagcgtgctgcagggcctgctgaagcccctgttcaagagcaccagcgtgggccccctgtacagcggctgcagactgaccctgctgagacccgagaaggacggcgtggccaccagagtggacgccatctgcacccacagacccgaccccaagatccccggcctggacagacagcagctgtactgggagctgagccagctgacccacagcatcaccgagctgggcccctacaccctggacagagacagcctgtacgtgaacggcttcacccagagaagcagcgtgcccaccaccagcacccccggcaccttcaccgtgcagcccgagaccagcgagacccccagcagcctgcccggccccacctag

SEQ ID NO: 22610 - DNA, 5322 bp, Artificial Sequence
  Description of Artificial Sequence: Synthetic coding sequence
atgagaagaggcaacatcagccccgccttctggttcctgtggctgctgctgttcggcctgctgggccccagcagcgagaacaccaccgccttcaccaagggcagcgacaccaccaccgccagcatcaccggcagcgagaccaccatggccagcaccatggccagcaccagcgccctgaccaccggcagcaagatcaccaccgacagcaccaccggcagcgagaccaccagcgccagcaccatggccagcaccgccgccttcaccaccggcagcgagaccaacaccgccagcaccaccgacagcggcaccaccatcgccagcaccagaaccttcaccaccggcagcgacaccaccaccggcagcaccgccggcagcgagaccatcgtggccagcaccaccgtgagcggcaccaccaccaccttcaccatcgccagcaccaccgtgcccgagaccaccatggccagcagcaccaccagcaccgccggcagcgagaagaccatggccagcagcatcatcagcgagaccaccatggccagcaccaccggcagcgagaccgccaccgtgagcaccaccggcagcgagaccaccaccaccagcaccgccagcagcgaggccaccaaggtgagcaccaccggcagcgagaccaccaccgccagcaccgccggcagcgagaccaccaccaccagcaccagcatggccggcagcgaggccaccaccaccagcaccgccgacagcaaggtgatcaccgccagcagcatgagcagcgagaccaccgtggcccccgccgccggcagcaacaccaccaccgccagcaccaccggcagcgagaccaccaccatcctgatcaaggccagcgagaccaccaccgccagcaccgccggcagcgagaccaccacccccagccccaccggcagccagaccaccatcgtgagcatcagcggcagcgagatcaccaccaccagcaccgccggcagcgagaacaccaccgtgagcagcgccggcagcggcaccaccaccgccagcatggccggcagcgagaccaccgtgagcaccgccggcagcgagaccaccaccgtgagcatcaccggcaccgagaccaccatggtgagcgccatgggcagcgagaccaccaccaacagcaccaccagcagcgagaccaccgtgaccagcaccgccggcagcgagaccaccaccgtgagcaccgtgggcagcgagaccaccaccgcctacaccgccgacagcgagaccaccgccgccagcaccaccggcagcgagatgaccaccgtgttcaccgccggcagcgagaccatcacccccagcaccgccggcagcgagaccaccaccgtgagcaccgccggcagcgagaccaccaccgtgagcaccaccggcagcgagaccaccaccgccagcaccgcccacagcgagaccaccgccgccagcaccatgggcagcgagaccaccaaggtgagcaccgccggcagcgagaccaccgtgagcaccgccggcagcgagaccaccgccgccagcaccgaggacagcgagaccaacaccgccttcaccgaggacagcaagaccaccaccgccagcaccaccggcttcgagaccaccgccgccagcaccaccggcagcgagcccaccatggccagcaccatgggcagcgagaccaccatggccagcaccatcggccccgagaccaccaaggtgagcaccgccagcagcgaggtgaccaccgtgttcgccgccggcagcgagaccatcagagccagcaccgtgggcagcgagaccaccaccgtgagcaccaccggcagcgagaccaccaccgccagcatcatgggcagcgagaccagcaccgacagcaccaccggcagcgagaccaccaccgccagcaccgagggcagcgagaccaccaccgccagcaccgagggcagcgaggccaccaccgtgagcaccaccggcagcgagaccaccaccgtgagcatcaccgacagcgagaccaccaccacctgcaccgagggcagcgagatgaccgccgtgagcaccaccgtgttcgagaccaccaccgccagcaccgagggcagcgagatcaccatcgccagcaccagcgacagcgagaccaccaccgccagcaccgagggcagcgagaccaccaccgtgaccaccgccggcagcgagaccaagaccgcctacaccaccggcagcgagaccaccaccgccagcaacaccggcctggagaccaccaccgtgttcaccatcggcagcgacaccaccaccgccagcaccgagggcagcgagaccaccgccgtgagcgccaccggcagcgagatgaccaccgtgagcaccgagggcagcgagaacaccaccgtgagcaccaccggcagcgagaccaccaccgtgagcaccaccggcctggagaccaccaccaccagcaccgagggcagcgagatgaccaccgtgagcaccaccggcgccgagaccaccaccgacagcaccgagggcagcggcaccaccgccgccagcaccgccggcagcgagaccaccaccgtgagcaccgccgacagcgagaacaccaccgccagcaccgccgacagcgagaccaccagcgccagcaccaccggcagcgagaccaccaccgccagcaccaccagcagcgagaccaccaccgccagcaccgagggcagcgagaccaccaccgtgagcaccaccgacagcgagaccaccatggtgagcaccaccggcagcgagagaaccatcaccagcaccgagggcagcgagaccaccaccgtgagcgccaccggcagcgagaccaccgtgagcaccgagggcagcggcaccaccaccgtgagcatcaccggcagcgagaccaccaaggtgagcaccaccggcagcgagaccaccaccaccagcaccgagggcagcgagatcaccaccgccagcatcaccggcagcgagaccaccaccgccagcaccgagggcagcgagaccaccaccgccagcaccgagggcagcgagaccaccagcgccagcaccaccggcagcgagaccaccaccgccagcaccaccagcagcgagaccaccatggccagcatcatgggcagcgagaccaccatggccagcaccatcggcagcgagaccaccaaggtgagcaccgccagcagcaagatgaccaccgtgttcaccgagaacagcgagaccaccatcgccagcaccaccgccagcgagaccaccaccgtgagcaccgccggcagcgagaccatccccgccagcaccgccggcagcgagaccaccaccaccaccagcaccgagggcagcgagaccaccaccgccagcaccgagggcagcgagaccaccaccgccagcaccgagagcagcgagaccaccaccgccaccaccatcggcagcgagaccaccaccgccagcaccgagggcagcgagaccaccaccaccagcaccgagggcagcgagaccaccaccgccagcaccgagggcagcgagatcaccaccgtgagcaccaccggcagcgagaccaccaccgccagcaccgagggcagcgagaccaccaccgccagcaccgagggcagcgagctgaccaccgtgagcaccaccggcagcgagaccatcaccgtgagcgccgagggcagcgagaccaccaccgtgaccaccatgggcagcgagaccaccaccgccagcaccgccggcagcgagaccaccaccgtgagcaccgccggcagcgagaccaccaccgccagcatcgagggcagcgagaccaccaccgtgagcagcaccggcagcgagaccaccaccgtgagcaccaccggcaccgagaccaccatcaccagcaccgagggcagcgagaccaccaccgtgaccaccgccggcagcgagaccaccgccgtgtacaccaccggcagcgagaccaccaccaccagcaccgagggcagcgagaccaccaccgtgagcaccaccggcagcgagaccaccaccgccagcaccgccgacctggagaccaccaccgtgagcaccagcggcagcggcaccaccaccgccagcaccgccggcagcgagaccaccaccgtgtacatcaccggcagcaagaccaccaccgccagcaccgagggcagcgaggccaccaccgtgagcaccaccagcagcgagaccaccaccgccagcaccaccggcagcgagatgaccaccgtgttcaccaccgtgagcgagaccaccaccgtgagcaccatcggcagcgaggccaccaccagcagcgccgccggcagcgaggccaccaccaccagcaccgagggcagcgagaccaccaccgccagcaccgccggcagcgagaccaccaccgccagcaccgccggcagcgagaccaccaccgccagcaccagcggcagcgagaccaacaccgcctgcaccaccggcagcgagaccagcacccccagcagcgccggcagcgagaccaacaccgccttcatcatcggcagcgagagcaccatcgccagcaccgccagcctggagcccaccgccaccagcctgaccggcagcgagaccaccaccgtgagcatcaccgccagcggcgccaccgccgccagcaccaccgtgagcagcaccaccttcgtgctgaccaaggccaccgacgtgagcatccagcccatcaccaacacccccatgagcggcaccagaaccaccggcaccagactgaccgccagcagcagcgtgaccatggcccccggcatggacttcaccgccagcgccgccagccacaccgtgcccggcatcgtgctgaacaccagcggcctgggcaccagcaccatgggcgccagcagcaccaccagcgcccacggcgtgagaaccaccaccggcagcaccagagagcccaccagcagcaccttccaggagaccggccccgtgagcatgggcaccaacaccgtgagcatgagccacacccccaccaacgtgatcaagcccagcggctacctgcagccctgggccatcatcctgatcagcctggccgccgtggtggccgccgtgggcctgagcgtgggcctgagcttctgcctgagaaacctgttcttccccctgagatactgcggcatctactacccccacggccacagccacagcctgggcctggacctgaacctgggcctgggcagcggcaccttccacagcctgggcaacgccctggtgcacggcggcgagctggagatgggccacggcggcacccacggcttcggctacggcgtgggccacggcctgagccacatccacggcgacggctacggcgtgaaccacggcggccactacggccacggcggcggccactag

SEQ ID NO: 22611 - DNA, 1701 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgccagcagcggcatcagcatcgccaccaacagcgagagcagcaccaccagcagcggcgccagcaccgccaccaacagcgagagcagcacccccagcagcggcgccagcaccgccaccaacagcgacagcagcaccaccagcagcggcgccagcaccgccaccaacagcgacagcagcaccaccagcagcgaggccagcaccgccaccaacagcgagagcagcaccaccagcagcggcgccagcaccgccaccaacagcgagagcagcaccgtgagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgagagcagcacccccagcagcggcgccggcaccgccaccaacagcgagagcagcaccaccagcagcggcgccggcaccgccaccaacagcgagagcagcaccgtgagcagcggcatcagcaccgtgaccaacagcgagagcagcacccccagcagcggcgccaacaccgccaccaacagcgagagcagcaccaccagcagcggcgccaacaccgccaccaacagcgacagcagcaccaccagcagcggcgccagcaccgccaccaacagcgagagcagcaccaccagcagcggcgccagcaccgccaccaacagcgagagcagcaccaccagcagcggcgccagcaccgccaccaacagcggcagcagcaccaccagcagcggcaccagcaccgccaccaacagcgagagcagcaccgtgagcagcggcgccagcaccgccaccaccagcgagagcagcaccaccagcagcggcgccagcaccgccaccaacagcgagagcagcaccgtgagcagcggcgccagcaccgccaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 22612 - DNA, 1701 bp, Artificial Sequence; identical to SEQ ID NO: 22611
  Description of Artificial Sequence: Synthetic coding sequence

SEQ ID NO: 22613 - DNA, 1701 bp, Artificial Sequence; identical to SEQ ID NO: 22611
  Description of Artificial Sequence: Synthetic coding sequence

SEQ ID NO: 22614 - DNA, 1251 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgccagcagcggcatcagcatcgccaccaacagcgagagcagcaccaccagcagcggcgccagcaccgccaccaacagcgagagcagcacccccagcagcggcgccagcaccgccaccaacagcgacagcagcaccaccagcagcggcgccagcaccgccaccaacagcgacagcagcaccaccagcagcgaggccagcaccgccaccaacagcgagagcagcaccaccagcagcggcgccagcaccgccaccaacagcgagagcagcaccaccagcagcggcgccagcaccgccaccaacagcgagagcagcaccaccagcagcggcgccagcaccgccaccaacagcggcagcagcaccaccagcagcggcaccagcaccgccaccaacagcgagagcagcaccgtgagcagcggcgccagcaccgccaccaccagcgagagcagcaccaccagcagcggcgccagcaccgccaccaacagcgagagcagcaccgtgagcagcggcgccagcaccgccaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 22615 - DNA, 1251 bp, Artificial Sequence; identical to SEQ ID NO: 22614
  Description of Artificial Sequence: Synthetic coding sequence

SEQ ID NO: 22616 - DNA, 1251 bp, Artificial Sequence; identical to SEQ ID NO: 22614
  Description of Artificial Sequence: Synthetic coding sequence

SEQ ID NO: 22617 - DNA, 471 bp, Artificial Sequence
  Description of Artificial Sequence: Synthetic coding sequence
accgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 22618 - DNA, 1206 bp, Artificial Sequence
  Description of Artificial Sequence: Synthetic coding sequence
atgtggcccgtgctgctgttcgtgttcctgagccagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgtag

SEQ ID NO: 22619 - DNA, 1491 bp, Artificial Sequence
  Description of Artificial Sequence: Synthetic coding sequence
accgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 22620 - DNA, 2187 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccagcaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgtag

SEQ ID NO: 22621 - DNA, 585 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagatag

SEQ ID NO: 22622 - DNA, 1002 bp, Artificial Sequence
  Description of Artificial Sequence: Synthetic coding sequence
aagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtgtacctgagcccccaggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggctag

SEQ ID NO: 22623 - DNA, 471 bp, Artificial Sequence; identical to SEQ ID NO: 22617
  Description of Artificial Sequence: Synthetic coding sequence

SEQ ID NO: 22624 - DNA, 2184 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgtag

SEQ ID NO: 22625 - DNA, 1527 bp, Artificial Sequence
  Description of Artificial Sequence: Synthetic coding sequence
atgtggcccgtgctgctgttcgtgttcctgagccagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 22626 - DNA, 408 bp, Artificial Sequence
  Description of Artificial Sequence: Synthetic coding sequence
ggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgtag

SEQ ID NO: 22627 - DNA, 1494 bp, Artificial Sequence
  Description of Artificial Sequence: Synthetic coding sequence
accgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccagcaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 22628 - DNA, 585 bp, Artificial Sequence; identical to SEQ ID NO: 22621
  Description of Artificial Sequence: Synthetic coding sequence

SEQ ID NO: 22629 - DNA, 1404 bp, Artificial Sequence
  Description of Artificial Sequence: Synthetic coding sequence
accgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccagcaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 22630 - DNA, 198 bp, Artificial Sequence
  Description of Artificial Sequence: Synthetic coding sequence
accgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgtag

SEQ ID NO: 22631 - DNA, 348 bp, Artificial Sequence
  Description of Artificial Sequence: Synthetic coding sequence
atcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatggtgagacccagcaccagcgtgagatag

SEQ ID NO: 22632 - DNA, 1491 bp, Artificial Sequence; identical to SEQ ID NO: 22619
  Description of Artificial Sequence: Synthetic coding sequence

SEQ ID NO: 22633 - DNA, 477 bp, Artificial Sequence
  Description of Artificial Sequence: Synthetic coding sequence
cacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccatccccagccaggtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagaaacccccagcagatgcccctgtag

SEQ ID NO: 22634 - DNA, 477 bp, Artificial Sequence
  Description of Artificial Sequence: Synthetic coding sequence
accgtgtacagcgccctgggcctgagagacgcctgcagaagcctgccccagagcatccagctgttcagagacatcgcccaggagttcagcgacgacctgcaccacatcgccagcctgatcggcaaggtgtacctgagcccccaggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggctag

SEQ ID NO: 22635 - DNA, 2238 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccccccccggcgacctgagattcacccccatccccctgctgatccccagccaggtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccagcaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgtag

SEQ ID NO: 22636 - DNA, 2184 bp, Artificial Sequence; identical to SEQ ID NO: 22624
  Description of Artificial Sequence: Synthetic coding sequence

SEQ ID NO: 22637 - DNA, 1401 bp, Artificial Sequence
  Description of Artificial Sequence: Synthetic coding sequence
accgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 22638 - DNA, 765 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagactggagtgcaacggcgccatcagcgcccagtgcaacctgtgcctgctgggcagcagcgacagccccgccagcgccagctag

SEQ ID NO: 22639 - DNA, 792 bp, Artificial Sequence
  Description of Artificial Sequence: Synthetic coding sequence
cactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctggactggcccagagtgagcggccaggagggcggcgactag

SEQ ID NO: 22640 - DNA, 480 bp, Artificial Sequence
  Description of Artificial Sequence: Synthetic coding sequence
atgcagaacaacgagatcatcaagcccgccaagtacttcagcgagctggagaagagcatcctgctggccctggtggagaagtacaagtacgtgctggagtgcaagaagagcgacgccagaaccatcgccctgaagcagagaacctggcaggccctggcccacgagtacaacagccagcccagcgtgagcctgagagacttcaagcagctgaagaagtgctgggagaacatcaaggccagaaccaagaagatcatggcccacgagagaagagagaaggtgaagagaagcgtgagccccctgctgagcacccacgtgctgggcaaggagaagatcgccagcatgctgcccgagcagctgtacttcctgcagagcccccccgaggaggagcccgagtaccaccccgacgccagcgcccaggtgttcttccaggagagaaagagaagcctggagctgagcatcatcctgagcggcacctggtag

SEQ ID NO: 22641 - DNA, 924 bp, Artificial Sequence
  Description of Artificial Sequence: Synthetic coding sequence
atgggcagcaccatggagccccccggcggcgcctacctgcacctgggcgccgtgaccagccccgtgggcaccgccagagtgctgcagctggccttcggctgcaccaccttcagcctggtggcccacagaggcggcttcgccggcgtgcagggcaccttctgcatggccgcctggggcttctgcttcgccgtgagcgccctggtggtggcctgcgagttcaccagactgcacggctgcctgagactgagctggggcaacttcaccgccgccttcgccatgctggccaccctgctgtgcgccaccgccgccgtgctgtaccccctgtacttcgccagaagagagtgcagccccgagcccgccggctgcgccgccagagacttcagactggccgccagcgtgttcgccggcctgctgttcctggcctacgccgtggaggtggccctgaccagagccagacccggccaggtgagcagctacatggccaccgtgagcggcctgctgaagatcgtgcaggccttcgtggcctgcatcatcttcggcgccctggtgcacgacagcagatacggcagatacgtggccacccagtggtgcgtggccgtgtacagcctgtgcttcctggccaccgtggccgtggtggccctgagcgtgatgggccacaccggcggcctgggctgccccttcgacagactggtggtggtgtacaccttcctggccgtgctgctgtacctgagcgccgccgtgatctggcccgtgttctgcttcgaccccaagtacggcgagcccaagagaccccccaactgcgccagaggcagctgcccctgggacagccagctggtggtggccatcttcacctacgtgaacctgctgctgtacgtggtggacctggcctacagccagagaatcagattcgtgcccagcctgtag

SEQ ID NO: 22642 - DNA, 924 bp, Artificial Sequence; identical to SEQ ID NO: 22641
  Description of Artificial Sequence: Synthetic coding sequence

SEQ ID NO: 22643 - DNA, 759 bp, Artificial Sequence
  Description of Artificial Sequence: Synthetic coding sequence
atgtggagagcccccgaggccgccctgagacccgaggtgagcctggagagaagaggccccgagatgaagcccgccgtggacgagatgttccccgagggcgccggcccctacgtggacctggacgaggtggccagagccagaagagagagccccagcgccggcggcagcaccggcctgctgatggacctggccgccaacgagaaggccgtgcacgccgacttcttcaacgacttcgaggacctgttcgacgacgacgacatccacagcagcggcctgcccagaaccagccagcagagcagcatggtgcccgccctgcagagaggccagagcgagcacggcgtgagaggcaaggccgccgagagacccgtggtgagcgaggagagatgcgagctgaacggcagagaggtggccgccctggacagagccttcggcagcaccggccacggccagggcgccgaggccctgatgttcaccagatgcagagagcaccccctgtgcggcaccaacaaggccaccagcgagggcaagatgggcaccggcagactgagaaacagcctgagaaagaaccagagcaagtggctgggcagctacctggaggtgctgagaaccaccagaagcagaagagaggtgagcgaggacagcaccatcagcgtgagcacccactggagaggcaagtgcttcaagagcgacgagacccccagcgtggccggcggcgaggagggcaagaagaccacccagccctgcatcgacgtgagatag

SEQ ID NO: 22644 - DNA, 237 bp, Artificial Sequence
  Description of Artificial Sequence: Synthetic coding sequence
atgtggagagcccccgaggccgccctgagacccgaggtgagcctggagagaagaggccccgagatgaagcccgccgtggacgagatgttccccgagggcgccggcccctacgtggacctggacgaggccggcggcagcaccggcctgctgatggacctggccgccaacgagaaggccgtgcacgccgacttcttcaacgacttcgaggacctgttcgacgacgacgacatccagtag

SEQ ID NO: 22645 - DNA, 3645 bp, Artificial Sequence
  Description of Artificial Sequence: Synthetic coding sequence
atgaccctgccccacagcctgggcggcgccggcgaccccagacccccccaggccatggaggtgcacagactggagcacagacaggaggaggagcagaaggaggagagacagcacagcctgagaatgggcagcagcgtgagaagaagaaccttcagaagcagcgaggaggagcacgagttcagcgccgccgactacgccctggccgccgccctggccctgaccgccagcagcgagctgagctgggaggcccagctgagaagacagaccagcgccgtggagctggaggagagaggccagaagagagtgggcttcggcaacgactgggagagaaccgagatcgccttcctgcagacccacagactgctgagacagagaagagactggaagaccctgagaagaagaaccgaggagaaggtgcaggaggccaaggagctgagagagctgtgctacggcagaggcccctggttctggatccccctgagaagccacgccgtgtgggagcacaccaccgtgctgctgacctgcaccgtgcaggccagcccccccccccaggtgacctggtacaagaacgacaccagaatcgaccccagactgttcagagccggcaagtacagaatcaccaacaactacggcctgctgagcctggagatcagaagatgcgccatcgaggacagcgccacctacaccgtgagagtgaagaacgcccacggccaggccagcagcttcgccaaggtgctggtgagaacctacctgggcaaggacgccggcttcgacagcgagatcttcaagagaagcaccttcggccccagcgtggagttcaccagcgtgctgaagcccgtgttcgccagagagaaggagcccttcagcctgagctgcctgttcagcgaggacgtgctggacgccgagagcatccagtggttcagagacggcagcctgctgagaagcagcagaagaagaaagatcctgtacaccgacagacaggccagcctgaaggtgagctgcacctacaaggaggacgagggcctgtacatggtgagagtgcccagccccttcggccccagagagcagagcacctacgtgctggtgagagacgccgaggccgagaaccccggcgcccccggcagccccctgaacgtgagatgcctggacgtgaacagagactgcctgatcctgacctgggccccccccagcgacaccagaggcaaccccatcaccgcctacaccatcgagagatgccagggcgagagcggcgagtggatcgcctgccacgaggcccccggcggcacctgcagatgccccatccagggcctggtggagggccagagctacagattcagagtgagagccatcagcagagtgggcagcagcgtgcccagcaaggccagcgagctggtggtgatgggcgaccacgacgccgccagaagaaagaccgagatccccttcgacctgggcaacaagatcaccatcagcaccgacgccttcgaggacaccgtgaccatccccagcccccccaccaacgtgcacgccagcgagatcagagaggcctacgtggtgctggcctgggaggagcccagccccagagacagagcccccctgacctacagcctggagaagagcgtgatcggcagcggcacctgggaggccatcagcagcgagagccccgtgagaagccccagattcgccgtgctggacctggagaagaagaagagctacgtgttcagagtgagagccatgaaccagtacggcctgagcgaccccagcgagcccagcgagcccatcgccctgagaggcccccccgccaccctgcccccccccgcccaggtgcaggccttcagagacacccagaccagcgtgagcctgacctgggaccccgtgaaggaccccgagctgctgggctactacatctacagcagaaaggtgggcaccagcgagtggcagaccgtgaacaacaagcccatccagggcaccagattcaccgtgcccggcctgagaaccggcaaggagtacgagttctgcgtgagaagcgtgagcgaggccggcgtgggcgagagcagcgccgccaccgagcccatcagagtgaagcaggccctggccacccccagcgccccctacggcttcgccctgctgaactgcggcaagaacgagatggtgatcggctggaagccccccaagagaagaggcggcggcaagatcctgggctacttcctggaccagcacgacagcgaggagctggactggcacgccgtgaaccagcagcccatccccaccagagtgtgcaaggtgagcgacctgcacgagggccacttctacgagttcagagccagagccgccaactgggccggcgtgggcgagctgagcgcccccagcagcctgttcgagtgcaaggagtggaccatgccccagcccggccccccctacgacgtgagagccagcgaggtgagagccaccagcctggtgctgcagtgggagccccccctgtacatgggcgccggccccgtgaccggctaccacgtgagcttccaggaggagggcagcgagcagtggaagcccgtgacccccggccccatcagcggcacccacctgagagtgagcgacctgcagcccggcaagagctacgtgttccaggtgcaggccatgaacagcgccggcctgggccagcccagcatgcccaccgaccccgtgctgctggaggacaagcccggcgcccacgagatcgaggtgggcgtggacgaggagggcttcatctacctggccttcgaggcccccgaggcccccgacagcagcgagttccagtggagcaaggactacaagggccccctggacccccagagagtgaagatcgaggacaaggtgaacaagagcaaggtgatcctgaaggagcccggcctggaggacctgggcacctacagcgtgatcgtgaccgacgccgacgaggacatcagcgccagccacaccctgaccgaggaggagctggagaagctgaagaagctgagccacgagatcagaaaccccgtgatcaagctgatcagcggctggaacatcgacatcctggagagaggcgaggtgagactgtggctggaggtggagaagctgagccccgccgccgagctgcacctgatcttcaacaacaaggagatcttcagcagccccaacagaaagatcaacttcgacagagagaagggcctggtggaggtgatcatccagaacctgagcgaggaggacaagggcagctacaccgcccagctgcaggacggcaaggccaagaaccagatcaccctgaccctggtggacgacgacttcgacaagctgctgagaaaggccgacgccaagagaagagactggaagagaaagcagggcccctacttcgagagacccctgcagtggaaggtgaccgaggactgccaggtgcagctgacctgcaaggccagcgtgaccaacaccaagaaggagaccagattccagtggttcttccagagagccgagatgcccgacggccagtacgaccccgagaccggcaccggcctgctgtgcatcgaggaggccagcgtggcccccgccagcggcctgaccttcagcttcggctgcaagcccggcagagccaagagcagcggcctgggcgtgagagccggccccagactgggctag

SEQ ID NO: 22646 - DNA, 4323 bp, Artificial Sequence
  Description of Artificial Sequence: Synthetic coding sequence
atgaccctgccccacagcctgggcggcgccggcgaccccagacccccccaggccatggaggtgcacagactggagcacagacaggaggaggagcagaaggaggagagacagcacagcctgagaatgggcagcagcgtgagaagaagaaccttcagaagcagcagcgaggaggagcacgagttcagcgccgccgactacgccctggccgccgccctggccctgaccgccagcagcgagctgagctgggaggcccagctgagaagacagaccagcgccgtggagctggaggagagaggccagaagagagtgggcttcggcaacgactgggagagaaccgagatcgccttcctgcagacccacagactgctgagacagagaagagactggaagaccctgagaagaagaaccgaggagaaggtgcaggaggccaaggagctgagagagctgtgctacggcagaggcccctggttctggatccccctgagaagccacgccgtgtgggagcacaccaccgtgctgctgacctgcaccgtgcaggccagcccccccccccaggtgacctggtacaagaacgacaccagaatcgaccccagactgttcagagccggcaagtacagaatcaccaacaactacggcctgctgagcctggagatcagaagatgcgccatcgaggacagcgccacctacaccgtgagagtgaagaacgcccacggccaggccagcagcttcgccaaggtgctggtgagaacctacctgggcaaggacgccggcttcgacagcgagatcttcaagagaagcaccttcggccccagcgtggagttcaccagcgtgctgaagcccgtgttcgccagagagaaggagcccttcagcctgagctgcctgttcagcgaggacgtgctggacgccgagagcatccagtggttcagagacggcagcctgctgagaagcagcagaagaagaaagatcctgtacaccgacagacaggccagcctgaaggtgagctgcacctacaaggaggacgagggcctgtacatggtgagagtgcccagccccttcggccccagagagcagagcacctacgtgctggtgagagacgccgaggccgagaaccccggcgcccccggcagccccctgaacgtgagatgcctggacgtgaacagagactgcctgatcctgacctgggccccccccagcgacaccagaggcaaccccatcaccgcctacaccatcgagagatgccagggcgagagcggcgagtggatcgcctgccacgaggcccccggcggcacctgcagatgccccatccagggcctggtggagggccagagctacagattcagagtgagagccatcagcagagtgggcagcagcgtgcccagcaaggccagcgagctggtggtgatgggcgaccacgacgccgccagaagaaagaccgagatccccttcgacctgggcaacaagatcaccatcagcaccgacgccttcgaggacaccgtgaccatccccagcccccccaccaacgtgcacgccagcgagatcagagaggcctacgtggtgctggcctgggaggagcccagccccagagacagagcccccctgacctacagcctggagaagagcgtgatcggcagcggcacctgggaggccatcagcagcgagagccccgtgagaagccccagattcgccgtgctggacctggagaagaagaagagctacgtgttcagagtgagagccatgaaccagtacggcctgagcgaccccagcgagcccagcgagcccatcgccctgagaggcccccccgccaccctgcccccccccgcccaggtgcaggccttcagagacacccagaccagcgtgagcctgacctgggaccccgtgaaggaccccgagctgctgggctactacatctacagcagaaaggtgggcaccagcgagtggcagaccgtgaacaacaagcccatccagggcaccagattcaccgtgcccggcctgagaaccggcaaggagtacgagttctgcgtgagaagcgtgagcgaggccggcgtgggcgagagcagcgccgccaccgagcccatcagagtgaagcaggccctggccacccccagcgccccctacggcttcgccctgctgaactgcggcaagaacgagatggtgatcggctggaagccccccaagagaagaggcggcggcaagatcctgggctacttcctggaccagcacgacagcgaggagctggactggcacgccgtgaaccagcagcccatccccaccagagtgtgcaaggtgagcgacctgcacgagggccacttctacgagttcagagccagagccgccaactgggccggcgtgggcgagctgagcgcccccagcagcctgttcgagtgcaaggagtggaccatgccccagcccggccccccctacgacgtgagagccagcgaggtgagagccaccagcctggtgctgcagtgggagccccccctgtacatgggcgccggccccgtgaccggctaccacgtgagcttccaggaggagggcagcgagcagtggaagcccgtgacccccggccccatcagcggcacccacctgagagtgagcgacctgcagcccggcaagagctacgtgttccaggtgcaggccatgaacagcgccggcctgggccagcccagcatgcccaccgaccccgtgctgctggaggacaagcccggcgcccacgagatcgaggtgggcgtggacgaggagggcttcatctacctggccttcgaggcccccgaggcccccgacagcagcgagttccagtggagcaaggactacaagggccccctggacccccagagagtgaagatcgaggacaaggtgaacaagagcaaggtgatcctgaaggagcccggcctggaggacctgggcacctacagcgtgatcgtgaccgacgccgacgaggacatcagcgccagccacaccctgaccgaggaggagctggagaagctgaagaagctgagccacgagatcagaaaccccgtgatcaagctgatcagcggctggaacatcgacatcctggagagaggcgaggtgagactgtggctggaggtggagaagctgagccccgccgccgagctgcacctgatcttcaacaacaaggagatcttcagcagccccaacagaaagatcaacttcgacagagagaagggcctggtggaggtgatcatccagaacctgagcgaggaggacaagggcagctacaccgcccagctgcaggacggcaaggccaagaaccagatcaccctgaccctggtggacgacgacttcgacaagctgctgagaaaggccgacgccaagagaagagactggaagagaaagcagggcaccggcccctacttcgagagacccctgcagtggaaggtgaccgaggactgccaggtgcagctgacctgcaaggtgaccaacaccaagaaggagaccagattccagtggttcttccagagagccgagatgcccgacggccagtacgaccccgagaccggcaccggcctgctgtgcatcgaggagctgagcaagaaggacaagggcatctacagagccatggtgagcgacgacagaggcgaggacgacaccatcctggacctgaccggcgacgccctggacgccatcttcaccgagctgggcagaatcggcgccctgagcgccacccccctgaagatccagggcaccgaggagggcatcagaatcttcagcaaggtgaagtactacaacgtggagtacatgaagaccacctggttccacaaggacaagagactggagagcggcgacagaatcagaaccggcaccaccctggacgagatctggctgcacatcctggaccccaaggacagcgacaagggcaagtacaccctggagatcgccgccggcaaggaggtgagacagctgagcaccgacctgagcggccaggccttcgaggacgccatggccgagcaccagagactgaagaccctggccatcatcgagaagaacagagccaaggtggtgagaggcctgcccgacgtggccaccatcatggaggacaagaccctgtgcctgacctgcatcgtgagcggcgaccccacccccgagatcagctggctgaagaacgaccagcccgtgaccttcctggacagatacagaatggaggtgagaggcaccgaggtgaccatcaccatcgagaaggtgaacagcgaggacagcggcagatacggcgtgttcgtgaagaacaagtacggcagcgagaccggccaggtgaccatcagcgtgttcaagcacggcgacgagcccaaggagctgaagagcatgtag

SEQ ID NO: 22647 - DNA, 993 bp, Artificial Sequence
  Description of Artificial Sequence: Synthetic coding sequence
atggacatcagcaagaagaacagagtgagacagggcagcagaggcagaggcaagaccatcagcaagaacagcgagagcagaggccagcagagaagacacatggtgaccaacaccaagaaggagaccagattccagtggttcttccagagagccgagatgcccgacggccagtacgaccccgagaccggcaccggcctgctgtgcatcgaggagctgagcaagaaggacaagggcatctacagagccatggtgagcgacgacagaggcgaggacgacaccatcctggacctgaccggcgacgccctggacgccatcttcaccgagctgggcagaatcggcgccctgagcgccacccccctgaagatccagggcaccgaggagggcatcagaatcttcagcaaggtgaagtactacaacgtggagtacatgaagaccacctggttccacaaggacaagagactggagagcggcgacagaatcagaaccggcaccaccctggacgagatctggctgcacatcctggaccccaaggacagcgacaagggcaagtacaccctggagatcgccgccggcaaggaggtgagacagctgagcaccgacctgagcggccaggccttcgaggacgccatggccgagcaccagagactgaagaccctggccatcatcgagaagaacagagccaaggtggtgagaggcctgcccgacgtggccaccatcatggaggacaagaccctgtgcctgacctgcatcgtgagcggcgaccccacccccgagatcagctggctgaagaacgaccagcccgtgaccttcctggacagatacagaatggaggtgagaggcaccgaggtgaccatcaccatcgagaaggtgaacagcgaggacagcggcagatacggcgtgttcgtgaagaacaagtacggcagcgagaccggccaggtgaccatcagcgtgttcaagcacggcgacgagcccaaggagctgaagagcatgtag

SEQ ID NO: 22648 - DNA, 4314 bp, Artificial Sequence
  Description of Artificial Sequence: Synthetic coding sequence
atgaccctgccccacagcctgggcggcgccggcgaccccagacccccccaggccatggaggtgcacagactggagcacagacaggaggaggagcagaaggaggagagacagcacagcctgagaatgggcagcagcgtgagaagaagaaccttcagaagcagcgaggaggagcacgagttcagcgccgccgactacgccctggccgccgccctggccctgaccgccagcagcgagctgagctgggaggcccagctgagaagacagaccagcgccgtggagctggaggagagaggccagaagagagtgggcttcggcaacgactgggagagaaccgagatcgccttcctgcagacccacagactgctgagacagagaagagactggaagaccctgagaagaagaaccgaggagaaggtgcaggaggccaaggagctgagagagctgtgctacggcagaggcccctggttctggatccccctgagaagccacgccgtgtgggagcacaccaccgtgctgctgacctgcaccgtgcaggccagcccccccccccaggtgacctggtacaagaacgacaccagaatcgaccccagactgttcagagccggcaagtacagaatcaccaacaactacggcctgctgagcctggagatcagaagatgcgccatcgaggacagcgccacctacaccgtgagagtgaagaacgcccacggccaggccagcagcttcgccaaggtgctggtgagaacctacctgggcaaggacgccggcttcgacagcgagatcttcaagagaagcaccttcggccccagcgtggagttcaccagcgtgctgaagcccgtgttcgccagagagaaggagcccttcagcctgagctgcctgttcagcgaggacgtgctggacgccgagagcatccagtggttcagagacggcagcctgctgagaagcagcagaagaagaaagatcctgtacaccgacagacaggccagcctgaaggtgagctgcacctacaaggaggacgagggcctgtacatggtgagagtgcccagccccttcggccccagagagcagagcacctacgtgctggtgagagacgccgaggccgagaaccccggcgcccccggcagccccctgaacgtgagatgcctggacgtgaacagagactgcctgatcctgacctgggccccccccagcgacaccagaggcaaccccatcaccgcctacaccatcgagagatgccagggcgagagcggcgagtggatcgcctgccacgaggcccccggcggcacctgcagatgccccatccagggcctggtggagggccagagctacagattcagagtgagagccatcagcagagtgggcagcagcgtgcccagcaaggccagcgagctggtggtgatgggcgaccacgacgccgccagaagaaagaccgagatccccttcgacctgggcaacaagatcaccatcagcaccgacgccttcgaggacaccgtgaccatccccagcccccccaccaacgtgcacgccagcgagatcagagaggcctacgtggtgctggcctgggaggagcccagccccagagacagagcccccctgacctacagcctggagaagagcgtgatcggcagcggcacctgggaggccatcagcagcgagagccccgtgagaagccccagattcgccgtgctggacctggagaagaagaagagctacgtgttcagagtgagagccatgaaccagtacggcctgagcgaccccagcgagcccagcgagcccatcgccctgagaggcccccccgccaccctgcccccccccgcccaggtgcaggccttcagagacacccagaccagcgtgagcctgacctgggaccccgtgaaggaccccgagctgctgggctactacatctacagcagaaaggtgggcaccagcgagtggcagaccgtgaacaacaagcccatccagggcaccagattcaccgtgcccggcctgagaaccggcaaggagtacgagttctgcgtgagaagcgtgagcgaggccggcgtgggcgagagcagcgccgccaccgagcccatcagagtgaagcaggccctggccacccccagcgccccctacggcttcgccctgctgaactgcggcaagaacgagatggtgatcggctggaagccccccaagagaagaggcggcggcaagatcctgggctacttcctggaccagcacgacagcgaggagctggactggcacgccgtgaaccagcagcccatccccaccagagtgtgcaaggtgagcgacctgcacgagggccacttctacgagttcagagccagagccgccaactgggccggcgtgggcgagctgagcgcccccagcagcctgttcgagtgcaaggagtggaccatgccccagcccggccccccctacgacgtgagagccagcgaggtgagagccaccagcctggtgctgcagtgggagccccccctgtacatgggcgccggccccgtgaccggctaccacgtgagcttccaggaggagggcagcgagcagtggaagcccgtgacccccggccccatcagcggcacccacctgagagtgagcgacctgcagcccggcaagagctacgtgttccaggtgcaggccatgaacagcgccggcctgggccagcccagcatgcccaccgaccccgtgctgctggaggacaagcccggcgcccacgagatcgaggtgggcgtggacgaggagggcttcatctacctggccttcgaggcccccgaggcccccgacagcagcgagttccagtggagcaaggactacaagggccccctggacccccagagagtgaagatcgaggacaaggtgaacaagagcaaggtgatcctgaaggagcccggcctggaggacctgggcacctacagcgtgatcgtgaccgacgccgacgaggacatcagcgccagccacaccctgaccgaggaggagctggagaagctgaagaagctgagccacgagatcagaaaccccgtgatcaagctgatcagcggctggaacatcgacatcctggagagaggcgaggtgagactgtggctggaggtggagaagctgagccccgccgccgagctgcacctgatcttcaacaacaaggagatcttcagcagccccaacagaaagatcaacttcgacagagagaagggcctggtggaggtgatcatccagaacctgagcgaggaggacaagggcagctacaccgcccagctgcaggacggcaaggccaagaaccagatcaccctgaccctggtggacgacgacttcgacaagctgctgagaaaggccgacgccaagagaagagactggaagagaaagcagggcccctacttcgagagacccctgcagtggaaggtgaccgaggactgccaggtgcagctgacctgcaaggtgaccaacaccaagaaggagaccagattccagtggttcttccagagagccgagatgcccgacggccagtacgaccccgagaccggcaccggcctgctgtgcatcgaggagctgagcaagaaggacaagggcatctacagagccatggtgagcgacgacagaggcgaggacgacaccatcctggacctgaccggcgacgccctggacgccatcttcaccgagctgggcagaatcggcgccctgagcgccacccccctgaagatccagggcaccgaggagggcatcagaatcttcagcaaggtgaagtactacaacgtggagtacatgaagaccacctggttccacaaggacaagagactggagagcggcgacagaatcagaaccggcaccaccctggacgagatctggctgcacatcctggaccccaaggacagcgacaagggcaagtacaccctggagatcgccgccggcaaggaggtgagacagctgagcaccgacctgagcggccaggccttcgaggacgccatggccgagcaccagagactgaagaccctggccatcatcgagaagaacagagccaaggtggtgagaggcctgcccgacgtggccaccatcatggaggacaagaccctgtgcctgacctgcatcgtgagcggcgaccccacccccgagatcagctggctgaagaacgaccagcccgtgaccttcctggacagatacagaatggaggtgagaggcaccgaggtgaccatcaccatcgagaaggtgaacagcgaggacagcggcagatacggcgtgttcgtgaagaacaagtacggcagcgagaccggccaggtgaccatcagcgtgttcaagcacggcgacgagcccaaggagctgaagagcatgtag

SEQ ID NO: 22649 - DNA, 996 bp, Artificial Sequence
  Description of Artificial Sequence: Synthetic coding sequence
atggacatcagcaagaagaacagagtgagacagggcagcagaggcagaggcaagaccatcagcaagaacagcgagagcagaggccagcagagaagacacatggtgaccaacaccaagaaggagaccagattccagtggttcttccagagagccgagatgcccgacggccagtacgaccccgagaccggcaccggcctgctgtgcatcgaggaggccagcctgagcaagaaggacaagggcatctacagagccatggtgagcgacgacagaggcgaggacgacaccatcctggacctgaccggcgacgccctggacgccatcttcaccgagctgggcagaatcggcgccctgagcgccacccccctgaagatccagggcaccgaggagggcatcagaatcttcagcaaggtgaagtactacaacgtggagtacatgaagaccacctggttccacaaggacaagagactggagagcggcgacagaatcagaaccggcaccaccctggacgagatctggctgcacatcctggaccccaaggacagcgacaagggcaagtacaccctggagatcgccgccggcaaggaggtgagacagctgagcaccgacctgagcggccaggccttcgaggacgccatggccgagcaccagagactgaagttcctgtacatcagccagtacagagccaaggtggtgagaggcctgcccgacgtggccaccatcatggaggacaagaccctgtgcctgacctgcatcgtgagcggcgaccccacccccgagatcagctggctgaagaacgaccagcccgtgaccttcctggacagatacagaatggaggtgagaggcaccgaggtgaccatcaccatcgagaaggtgaacagcgaggacagcggcagatacggcgtgttcgtgaagaacaagtacggcagcgagaccggccaggtgaccatcagcgtgttcaagcacggcgacgagcccaaggagctgaagagcatgtag

SEQ ID NO: 22650 - DNA, 1065 bp, Artificial Sequence
  Description of Artificial Sequence: Synthetic coding sequence
atggaggccgccaccgcccccgaggtggccgccggcagcaagctgaaggtgaaggaggccagccccgccgacgccgagcccccccaggccagccccggccagggcgccggcagccccaccccccagctgctgccccccatcgaggagcaccccaagatctggctgcccagagccctgagacagacctacatcagaaaggtgggcgacaccgtgaacctgctgatccccttccagggcaagcccaagccccaggccatctggacccacgacggctgcgccctggacaccagaagagtgagcgtgagaaacggcgagcaggacagcatcctgttcatcagagaggcccagagagccgacagcggcagataccagctgagagtgcagctgggcggcctggaggccaccgccaccatcgacatcctggtgatcgagagacccggccccccccagagcatcaagctggtggacgtgtggggcttcagcgccaccctggagtggacccccccccaggacaccggcaacaccgccctgctgggctacaccgtgcagaaggccgacaccaagagcggcctgtggttcaccgtgctggagcactaccacagaaccagctgcatcgtgagcgacctgatcatcggcaacagctacgccttcagagtgttcgccgagaaccagtgcggcctgagcgagaccgcccccatcaccaccgacctggcccacatccagaaggccgccaccgtgtacaagaccaagggcttcgcccagagagacttcagcgaggcccccaagttcacccagcccctggccgactgcaccaccgtgaccggctacaacacccagctgttctgctgcgtgagagccagccccagacccaagatcatctggctgaagaacaagatggacatccagggcaaccccaagtacagagccctgacccacctgggcatctgcagcctggagatcagaaagcccggccccttcgacggcggcatctacacctgcaaggccgtgaaccccctgggcgaggccagcgtggactgcagagtggacgtgaaggtgcccaactag

SEQ ID NO: 22651 - DNA, 1464 bp, Artificial Sequence
  Description of Artificial Sequence: Synthetic coding sequence
atgcaggagttcgccagaagatacttcagaagaagccaggccctgctgggccagaccgacggcggcgccgccggcaaggacaccgacagcctggtgcagtacaccaaggcccccatccaggagagcctgctgagcctgagcgacgacgtgagcaagctggccgtggccagcttcctggccctgatgagattcatgggcgaccagagcaagcccagaggcaaggacgagatggacctgctgtacgagctgctgaagctgtgccagcaggagaagctgagagacgagatctactgccaggtgatcaagcaggtgaccggccaccccagacccgagcactgcaccagaggctggagcttcctgagcctgctgaccggcttcttcccccccagcaccagactgatgccctacctgaccaagttcctgcaggacagcggccccagccaggagctggccagaagcagccaggagcacctgcagagaaccgtgaagtacggcggcagaagaagaatgcccccccccggcgagatgaaggccttcctgaagggccaggccatcagactgctgctgatccacctgcccggcggcgtggactacagaaccaacatccagaccttcaccgtggccgccgaggtgcaggaggagctgtgcagacagatgggcatcaccgagccccaggaggtgcaggagttcgccctgttcctgatcaaggagaagagccagctggtgagacccctgcagcccgccgagtacctgaacagcgtggtggtggaccaggacgtgagcctgcacagcagaagactgcactgggagacccccctgcacttcgacaacagcacctacatcagcacccactacagccaggtgctgtgggactacctgcagggcaagctgcccgtgagcgccaaggccgacgcccagctggccagactggccgccctgcagcacctgagcaaggccaacagaaacacccccagcggccaggacctgctggcctacgtgcccaagcagctgcagagacaggtgaacaccgccagcatcaagaacctgatgggccaggagctgagaagactggagggccacagcccccaggaggcccagatcagcttcatcgaggccatgagccagctgcccctgttcggctacaccgtgtacggcgtgctgagagtgagcatgcaggccctgagcggccccaccctgctgggcctgaacagacagcacctgatcctgatggaccccagcagccagagcctgtactgcagaatcgccctgaagagcctgcagagactgcacctgctgagccccctggaggagaagggcccccccggcctggaggtgaactacggcagcgccgacaacccccagaccatctggttcgagctgccccaggcccaggagctgctgtacaccaccgtgttcctgatcgacagcagcgccagctgcaccgagtggcccagcatcaactag

SEQ ID NO: 22652 - DNA, 1998 bp, Artificial Sequence
  Description of Artificial Sequence: Synthetic coding sequence
atggacagacccgccgccgccgccgccgccggctgcgagggcggcggcggccccaaccccggccccgccggcggcagaagaccccccagagccgccggcggcgccaccgccggcagcagacagcccagcgtggagaccctggacagccccaccggcagccacgtggagtggtgcaagcagctgatcgccgccaccatcagcagccagatcagcggcagcgtgaccagcgagaacgtgagcagagactacaaggccctgagagacggcaacaagctggcccagatggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgcccaacgagagctggaagatcagcaagatcaacagcaactacgagttctgcgacacctaccccgccatcatcgtggtgcccaccagcgtgaaggacgacgacctgagcaaggtggccgccttcagagccaagggcagagtgcccgtgctgagctggatccaccccgagagccaggccaccatcaccagatgcagccagcccctggtgggccccaacgacaagagatgcaaggaggacgagaagtacctgcagaccatcatggacgccaacgcccagagccacaagctgatcatcttcgacgccagacagaacagcgtggccgacaccaacaagaccaagggcggcggctacgagagcgagagcgcctaccccaacgccgagctggtgttcctggagatccacaacatccacgtgatgagagagagcctgagaaagctgaaggagatcgtgtaccccagcatcgacgaggccagatggctgagcaacgtggacggcacccactggctggagtacatcagaatgctgctggccggcgccgtgagaatcgccgacaagatcgagagcggcaagaccagcgtggtggtgcactgcagcgacggctgggacagaaccgcccagctgaccagcctggccatgctgatgctggacagctactacagaaccatcaagggcttcgagaccctggtggagaaggagtggatcagcttcggccacagattcgccctgagagtgggccacggcaacgacaaccacgccgacgccgacagaagccccatcttcctgcagttcgtggactgcgtgtggcagatgaccagacagttccccagcgccttcgagttcaacgagctgttcctgatcaccatcctggaccacctgtacagctgcctgttcggcaccttcctgtgcaactgcgagcagcagagattcaaggaggacgtgtacaccaagaccatcagcctgtggagctacatcaacagccagctggacgagttcagcaaccccttcttcgtgaactacgagaaccacgtgctgtaccccgtggccagcctgagccacctggagctgtgggtgaactactacgtgagatggaaccccagaatgagaccccagatgcccatccaccagaacctgaaggagctgctggccgtgagagccgagctgcagaagagagtggagggcctgcagagagaggtggccaccagagccgtgagcagcagcagcgagagaggcagcagccccagccacagcgccaccagcgtgcacaccagcgtgtag

SEQ ID NO: 22653 - DNA, 819 bp, Artificial Sequence
  Description of Artificial Sequence: Synthetic coding sequence
atgatcagcacctgcctgcccgagtacatcgtggtgcccagcagcctggccgaccaggacctgaagatcttcagccacagcttcgtgggcagaagaatgcccctgtggtgctggagccacagcaacggcagcgccctggtgagaatggccctgatcaaggacgtgctgcagcagagaaagatcgaccagagaatctgcaacgccatcaccaagagccacccccagagaagcgacgtgtacaagagcgacctggacaagaccctgcccaacatccaggaggtgcaggccgccttcgtgaagctgaagcagctgtgcgtgaacgagcccttcgaggagaccgaggagaagtggctgagcagcctggagaacaccagatggctggagtacgtgagagccttcctgaagcacagcgccgagctggtgtacatgctggagagcaagcacctgagcgtggtgctgcaggaggaggagggcagagacctgagctgctgcgtggccagcctggtgcaggtgatgctggacccctacttcagaaccatcaccggcttccagagcctgatccagaaggagtgggtgatggccggctaccagttcctggacagatgcaaccacctgaagagaagcgagaaggagagccccctgttcctgctgttcctggacgccacctggcagctgctggagcagtaccccgccgccttcgagttcagcgagacctacctggccgtgctgtacgacagcaccagaatcagcctgttcggcaccttcctgttcaacagcccccaccagagagtgaagcagagcaccgtgtggctgctgtag

SEQ ID NO: 22654 - DNA, 1371 bp, Artificial Sequence
  Description of Artificial Sequence: Synthetic coding sequence
atgcccctgcagaagttccactacagaaacctgctgctgggcgagcacgacgtgcccctgacctgcatcgagcagatcgtgaccgtgaacgaccacaagagaaagcagaaggtgctgggccccaaccagaagctgaagttcaaccccaccgagctgatcatctactgcaaggacttcagaatcgtgagattcagattcgacgagagcggccccgagagcgccaagaaggtgtgcctggccatcgcccactacagccagcccaccgacctgcagctgctgttcgccttcgagtacgtgggcaagaagtaccacaacagcgccaacaagatcaacggcatccccagcggcgacggcggcggcggcggcggcggcggcaacggcgccggcggcggcagcagccagaagacccccctgttcgagacctacagcgactgggacagagagatcaagagaaccggcgccagcggctggagagtgtgcagcatcaacgagggctacatgatcagcacctgcctgcccgagtacatcgtggtgcccagcagcctggccgaccaggacctgaagatcttcagccacagcttcgtgggcagaagaatgcccctgtggtgctggagccacagcaacggcagcgccctggtgagaatggccctgatcaaggacgtgctgcagcagagaaagatcgaccagagaatctgcaacgccatcaccaagagccacccccagagaagcgacgtgtacaagagcgacctggacaagaccctgcccaacatccaggaggtgcaggccgccttcgtgaagctgaagcagctgtgcgtgaacgagcccttcgaggagaccgaggagaagtggctgagcagcctggagaacaccagatggctggagtacgtgagagccttcctgaagcacagcgccgagctggtgtacatgctggagagcaagcacctgagcgtggtgctgcaggaggaggagggcagagacctgagctgctgcgtggccagcctggtgcaggtgatgctggacccctacttcagaaccatcaccggcttccagagcctgatccagaaggagtgggtgatggccggctaccagttcctggacagatgcaaccacctgaagagaagcgagaaggagagccccctgttcctgctgttcctggacgccacctggcagctgctggagcagtaccccgccgccttcgagttcagcgagacctacctggccgtgctgtacgacagcaccagaatcagcctgttcggcaccttcctgttcaacagcccccaccagagagtgaagcagagcaccgacaagaagctgtacaagaccagactgttcagcttcaccagcctgaagttcctggtgaccatccactag

SEQ ID NO: 22655 - DNA, 657 bp, Artificial Sequence
  Description of Artificial Sequence: Synthetic coding sequence
atgttcagcctgaagccccccaagcccaccttcagaagctacctgctgccccccccccagaccgacgacaagatcaacagcgagcccaagatcaagaagctggagcccgtgctgctgcccggcgagatcgtggtgaacgaggtgaacttcgtgagaaagtgcatcgccaccgacaccagccagtacgacctgtggggcaagctgatctgcagcaacttcaagatcagcttcatcaccgacgaccccatgcccctgcagaagttccactacagaaacctgctgctgggcgagcacgacgtgcccctgacctgcatcgagcagatcgtgaccgtgaacgaccacaagagaaagcagaaggtgctgggccccaaccagaagctgaagttcaaccccaccgagctgatcatctactgcaaggacttcagaatcgtgagattcagattcgacgagagcggccccgagagcgccaagaagcagaccaagctgatggagttcccccaggagatggaggaggaggaggaggaggaggtgatggagctggtggtggccgccgccagaaagctgcacagcctgaagctgaccagaatcggcaccgagaagagcagaggccaggtgctgcccggcggcgagttcgtgctgctgaccagagtgacctag

SEQ ID NO: 22656 - DNA, 2334 bp, Artificial Sequence
  Description of Artificial Sequence: Synthetic coding sequence
atgttcagcctgaagccccccaagcccaccttcagaagctacctgctgccccccccccagaccgacgacaagatcaacagcgagcccaagatcaagaagctggagcccgtgctgctgcccggcgagatcgtggtgaacgaggtgaacttcgtgagaaagtgcatcgccaccgacaccagccagtacgacctgtggggcaagctgatctgcagcaacttcaagatcagcttcatcaccgacgaccccatgcccctgcagaagttccactacagaaacctgctgctgggcgagcacgacgtgcccctgacctgcatcgagcagatcgtgaccgtgaacgaccacaagagaaagcagaaggtgctgggccccaaccagaagctgaagttcaaccccaccgagctgatcatctactgcaaggacttcagaatcgtgagattcagattcgacgagagcggccccgagagcgccaagaaggtgtgcctggccatcgcccactacagccagcccaccgacctgcagctgctgttcgccttcgagtacgtgggcaagaagtaccacaacagcgccaacaagatcaacggcatccccagcggcgacggcggcggcggcggcggcggcggcaacggcgccggcggcggcagcagccagaagacccccctgttcgagacctacagcgactgggacagagagatcaagagaaccggcgccagcggctggagagtgtgcagcatcaacgagggctacatgatcagcacctgcctgcccgagtacatcgtggtgcccagcagcctggccgaccaggacctgaagatcttcagccacagcttcgtgggcagaagaatgcccctgtggtgctggagccacagcaacggcagcgccctggtgagaatggccctgatcaaggacgtgctgcagcagagaaagatcgaccagagaatctgcaacgccatcaccaagagccacccccagagaagcgacgtgtacaagagcgacctggacaagaccctgcccaacatccaggaggtgcaggccgccttcgtgaagctgaagcagctgtgcgtgaacgagcccttcgaggagaccgaggagaagtggctgagcagcctggagaacaccagatggctggagtacgtgagagccttcctgaagcacagcgccgagctggtgtacatgctggagagcaagcacctgagcgtggtgctgcaggaggaggagggcagagacctgagctgctgcgtggccagcctggtgcaggtgatgctggacccctacttcagaaccatcaccggcttccagagcctgatccagaaggagtgggtgatggccggctaccagttcctggacagatgcaaccacctgaagagaagcgagaaggagagccccctgttcctgctgttcctggacgccacctggcagctgctggagcagtaccccgccgccttcgagttcagcgagacctacctggccgtgctgtacgacagcaccagaatcagcctgttcggcaccttcctgttcaacagcccccaccagagagtgaagcagagcaccgagttcgccatcagcaagaacatccagctgggcgacgagaagggcctgaagttccccagcgtgtgggactggagcctgcagttcaccgccaaggacagaaccctgttccacaaccccttctacatcggcaagagcaccccctgcatccagaacggcagcgtgaagagcttcaagagaaccaagaagagctacagcagcaccctgagaggcatgcccagcgccctgaagaacggcatcatcagcgaccaggagctgctgcccagaagaaacagcctgatcctgaagcccaagcccgaccccgcccagcagaccgacagccagaacagcgacaccgagcagtacttcagagagtggttcagcaagcccgccaacctgcacggcgtgatcctgcccagagtgagcggcacccacatcaagctgtggaagctgtgctacttcagatgggtgcccgaggcccagatcagcctgggcggcagcatcaccgccttccacaagctgagcctgctggccgacgaggtggacgtgctgagcagaatgctgagacagcagagaagcggccccctggaggcctgctacggcgagctgggccagagcagaatgtacttcaacgccagcggcccccaccacaccgacaccagcggcacccccgagttcctgagcagcagcttccccttcagccccgtgggcaacctgtgcagaagaagcatcctgggcacccccctgagcaagttcctgagcggcgccaagatctggctgagcaccgagaccctggccaacgaggactag

SEQ ID NO: 22657 - DNA, 819 bp, Artificial Sequence
  Description of Artificial Sequence: Synthetic coding sequence
atgtggtggggcggcagaggccagagcttcaacatcgccccccagaaggaggagcccgagatgggcagcgtgcaggagaacagaatgcccgagcccagaagcagacagcccagcagctgcctggccagcagatgcctgcccggcgagcagatcctggcctgggcccccggcgtgagaaagggcctggagcccgagctgagcggcaccctgatctgcaccaacttcagagtgaccttccagccctgcggctggcagtggaaccaggacacccccctgaacagcgagtacgacttcgccctggtgaacatcggcagactggaggccgtgagcggcctgagcagagtgcagctgctgagacccggcagcctgcacaagttcatccccgaggagatcctgatccacggcagagacttcagactgctgagagtgggcttcgaggccggcggcctggagccccaggccttccaggtgaccatggccatcgtgcaggccagagcccagagcaaccaggcccagcagtacagcggcatcaccctgagcaaggccggccagggcagcggcagcagaaagccccccatccccctgatggagaccgccgaggactgggagaccgagagaaagaagcaggccgccagaggctggagagtgagcaccgtgaacgagagattcgacgtggccaccagactgagatgcttcagcagcagcctgatcgtgagcggcagcagcagcagcagcttccagctgatcctgaacagcctgagcttcagcttcctgctgttcatgaccgtgagcggcttcctgacccccctgcccagctag

SEQ ID NO: 22658 - DNA, 1923 bp, Artificial Sequence
  Description of Artificial Sequence: Synthetic coding sequence
atgccccccagagtgaccttccagccctgcggctggcagtggaaccaggacacccccctgaacagcgagtacgacttcgccctggtgaacatcggcagactggaggccgtgagcggcctgagcagagtgcagctgctgagacccggcagcctgcacaagttcatccccgaggagatcctgatccacggcagagacttcagactgctgagagtgggcttcgaggccggcggcctggagccccaggccttccaggtgaccatggccatcgtgcaggccagagcccagagcaaccaggcccagcagtacagcggcatcaccctgagcaaggccggccagggcagcggcagcagaaagccccccatccccctgatggagaccgccgaggactgggagaccgagagaaagaagcaggccgccagaggctggagagtgagcaccgtgaacgagagattcgacgtggccaccagcctgcccagatacttctgggtgcccaacagaatcctggacagcgaggtgagaagagccttcggccacttccaccagggcagaggccccagactgagctggcaccaccccggcggcagcgacctgctgagatgcggcggcttctacaccgccagcgaccccaacaaggaggacatcagagccgtggagctgatgctgcaggccggccacagcgacgtggtgctggtggacaccatggacgagctgcccagcctggccgacgtgcagctggcccacctgagactgagagccctgtgcctgcccgacagcagcgtggccgaggacaagtggctgagcgccctggagggcaccagatggctggactacgtgagagcctgcctgagaaaggccagcgacatcagcgtgctggtgaccagcagagtgagaagcgtgatcctgcaggagagaggcgacagagacctgaacggcctgctgagcagcctggtgcagctgctgagcgcccccgaggccagaaccctgttcggcttccagagcctggtgcagagagagtgggtggccgccggccaccccttcctgaccagactgggcggcaccggcgccagcgaggaggcccccgtgttcctgctgttcctggactgcgtgtggcagctgctgcagcagttccccgccgacttcgagttcagcgagttcttcctgctggccctgcacgacagcgtgagagtgcccgacaccctgaccttcctgagaaacaccccctgggagagaggcaagcagagcggccagctgaacagctacacccaggtgtacacccccggctacagccagccccccgccggcaacagcttcaacctgcagctgagcgtgtgggactgggacctgagatacagcaacgcccagatcctgcagttccagaaccccggctacgaccccgagcactgccccgacagctggctgcccagaccccagcccagcttcatggtgcccggcccccccagcagcgtgtggctgttcagcagaggcgccctgacccccctgaaccagctgtgcccctggagagacagccccagcctgctggccgtgagcagcagatggctgcccagacccgccatcagcagcgagagcctggccgaccaggagtggggcctgcccagccactggggcgcctgccccctgccccccggcctgctgctgcccggctacctgggcccccagatcagactgtggagaagatgctacctgagaggcagacccgaggtgcagatgggcctgagcgcccccaccatcagcggcctgcaggacgagctgagccacctgcaggagctgctgagaaagtggacccccagaatcagccccgaggaccacagcaagaagagagacccccacaccatcctgaaccccaccgagatcgccggcatcctgaagggccagagccaccccttctggatcaccagatgctag

SEQ ID NO: 22659 - DNA, 765 bp, Artificial Sequence
  Description of Artificial Sequence: Synthetic coding sequence
atggccatcgtgcaggccagagcccagagcaaccaggcccagcagtacagcggcatcaccctgagcaaggccggccagggcagcggcagcagaaagccccccatccccctgatggagaccgccgaggactgggagaccgagagaaagaagcaggccgccagaggctggagagtgagcaccgtgaacgagagattcgacgtggccaccagcctgcccagatacttctgggtgcccaacagaatcctggacagcgaggtgagaagagccttcggccacttccaccagggcagaggccccagactgagctggcaccaccccggcggcagcgacctgctgagatgcggcggcttctacaccgccagcgaccccaacaaggaggacatcagagccgtggagctgatgctgcaggccggccacagcgacgtggtgctggtggacaccatggacgagctgcccagcctggccgacgtgcagctggcccacctgagactgagagccctgtgcctgcccgacagcagcgtggccgaggacaagtggctgagcgccctggagggcaccagatggctggactacgtgagagcctgcctgagaaaggccagcgacatcagcgtgctggtgaccagcagagtgagaagcgtgatcctgcaggccgccttcagccccagaagccccaacaccgtgtggctgcccatcaccagcaccgccagagtgggcggcagctggaccagcctgcccgacagcgcctggggcaactggggccagtag

SEQ ID NO: 22660 - DNA, 1065 bp, Artificial Sequence
  Description of Artificial Sequence: Synthetic coding sequence
atgcccgagcccagaagcagacagcccagcagctgcctggccagcagatgcctgcccggcgagcagatcctggcctgggcccccggcgtgagaaagggcctggagcccgagctgagcggcaccctgatctgcaccaacttcagagtgaccttccagccctgcggctggcagtggaaccaggacacccccctgaacagcgagtacgacttcgccctggtgaacatcggcagactggaggccgtgagcggcctgagcagagtgcagctgctgagacccggcagcctgcacaagttcatccccgaggagatcctgatccacggcagagacttcagactgctgagagtgggcttcgaggccggcggcctggagccccaggccttccaggtgaccatggccatcgtgcaggccagagcccagagcaaccaggcccagcagtacagcggcatcaccctgagcaaggccggccagggcagcggcagcagaaagccccccatccccctgatggagaccgccgaggactgggagaccgagagaaagaagcaggccgccagaggctggagagtgagcaccgtgaacgagagattcgacgtggccaccagcctgcccagatacttctgggtgcccaacagaatcctggacagcgaggtgagaagagccttcggccacttccaccagggcagaggccccagactgagctggcaccaccccggcggcagcgacctgctgagatgcggcggcttctacaccgccagcgaccccaacaaggaggacatcagagccgtggagctgatgctgcaggccggccacagcgacgtggtgctggtggacaccatggacgagctgcccagcctggccgacgtgcagctggcccacctgagactgagagccctgtgcctgcccgacagcagcgtggccgaggacaagtggctgagcgccctggagggcaccagatggctggactacgtgagagcctgcctgagaaaggccagcgacatcagcgtgctggtgaccagcagagtgagaagcgtgatcctgcagggcagcggcgtgagccccctgccctag

SEQ ID NO: 22661 - DNA, 2130 bp, Artificial Sequence
  Description of Artificial Sequence: Synthetic coding sequence
atgtggtggggcggcagaggccagagcttcaacatcgccccccagaaggaggagcccgagatgggcagcgtgcaggagaacagaatgcccgagcccagaagcagacagcccagcagctgcctggccagcagatgcctgcccggcgagcagatcctggcctgggcccccggcgtgagaaagggcctggagcccgagctgagcggcaccctgatctgcaccaacttcagagtgaccttccagccctgcggctggcagtggaaccaggacacccccctgaacagcgagtacgacttcgccctggtgaacatcggcagactggaggccgtgagcggcctgagcagagtgcagctgctgagacccggcagcctgcacaagttcatccccgaggagatcctgatccacggcagagacttcagactgctgagagtgggcttcgaggccggcggcctggagccccaggccttccaggtgaccatggccatcgtgcaggccagagcccagagcaaccaggcccagcagtacagcggcatcaccctgagcaaggccggccagggcagcggcagcagaaagccccccatccccctgatggagaccgccgaggactgggagaccgagagaaagaagcaggccgccagaggctggagagtgagcaccgtgaacgagagattcgacgtggccaccagcctgcccagatacttctgggtgcccaacagaatcctggacagcgaggtgagaagagccttcggccacttccaccagggcagaggccccagactgagctggcaccaccccggcggcagcgacctgctgagatgcggcggcttctacaccgccagcgaccccaacaaggaggacatcagagccgtggagctgatgctgcaggccggccacagcgacgtggtgctggtggacaccatggacgagctgcccagcctggccgacgtgcagctggcccacctgagactgagagccctgtgcctgcccgacagcagcgtggccgaggacaagtggctgagcgccctggagggcaccagatggctggactacgtgagagcctgcctgagaaaggccagcgacatcagcgtgctggtgaccagcagagtgagaagcgtgatcctgcaggagagaggcgacagagacctgaacggcctgctgagcagcctggtgcagctgctgagcgcccccgaggccagaaccctgttcggcttccagagcctggtgcagagagagtgggtggccgccggccaccccttcctgaccagactgggcggcaccggcgccagcgaggaggcccccgtgttcctgctgttcctggactgcgtgtggcagctgctgcagcagttccccgccgacttcgagttcagcgagttcttcctgctggccctgcacgacagcgtgagagtgcccgacaccctgaccttcctgagaaacaccccctgggagagaggcaagcagagcggccagctgaacagctacacccaggtgtacacccccggctacagccagccccccgccggcaacagcttcaacctgcagctgagcgtgtgggactgggacctgagatacagcaacgcccagatcctgcagttccagaaccccggctacgaccccgagcactgccccgacagctggctgcccagaccccagcccagcttcatggtgcccggcccccccagcagcgtgtggctgttcagcagaggcgccctgacccccctgaaccagctgtgcccctggagagacagccccagcctgctggccgtgagcagcagatggctgcccagacccgccatcagcagcgagagcctggccgaccaggagtggggcctgcccagccactggggcgcctgccccctgccccccggcctgctgctgcccggctacctgggcccccagatcagactgtggagaagatgctacctgagaggcagacccgaggtgcagatgggcctgagcgcccccaccatcagcggcctgcaggacgagctgagccacctgcaggagctgctgagaaagtggacccccagaatcagccccgaggaccacagcaagaagagagacccccacaccatcctgaaccccaccgagatcgccggcatcctgaagggcagagccgagggcgacctgggctag

SEQ ID NO: 22662 - DNA, 663 bp, Artificial Sequence
  Description of Artificial Sequence: Synthetic coding sequence
atgaacatcagaaacgccagacccgaggacctgatgaacatgcagcactgcaacctgctgtgcctgcccgagaactaccagatgaagtactacttctaccacggcctgagctggccccagctgagctacatcgccgaggacgagaacggcaagatcgtgggctacgtgctggccaagatggaggaggaccccgacgacgtgccccacggccacatcaccagcctggccgtgaagagaagccacagaagactgggcctggcccagaagctgatggaccaggccagcagagccatgatcgagaacttcaacgccaagtacgtgagcctgcacgtgagaaagagaatcagcgaggtggagcccaagtactacgccgacggcgaggacgcctacgccatgaagagagacctgacccagatggccgacgagctgagaagacacctggagctgaaggagaagggcagacacgtggtgctgggcgccatcgagaacaaggtggagagcaagggcaacagcccccccagcagcggcgaggcctgcagagaggagaagggcctggccgccgaggacagcggcggcgacagcaaggacctgagcgaggtgagcgagaccaccgagagcaccgacgtgaaggacagcagcgaggccagcgacagcgccagctag

SEQ ID NO: 22663 - DNA, 708 bp, Artificial Sequence
  Description of Artificial Sequence: Synthetic coding sequence
atgaacatcagaaacgccagacccgaggacctgatgaacatgcagcactgcaacctgctgtgcctgcccgagaactaccagatgaagtactacttctaccacggcctgagctggccccagctgagctacatcgccgaggacgagaacggcaagatcgtgggctacgtgctggccaagatggaggaggaccccgacgacgtgccccacggccacatcaccagcctggccgtgaagagaagccacagaagactgggcctggcccagaagctgatggaccaggccagcagagccatgatcgagaacttcaacgccaagtacgtgagcctgcacgtgagaaagagcaacagagccgccctgcacctgtacagcaacaccctgaacttccagatcagcgaggtggagcccaagtactacgccgacggcgaggacgcctacgccatgaagagagacctgacccagatggccgacgagctgagaagacacctggagctgaaggagaagggcagacacgtggtgctgggcgccatcgagaacaaggtggagagcaagggcaacagcccccccagcagcggcgaggcctgcagagaggagaagggcctggccgccgaggacagcggcggcgacagcaaggacctgagcgaggtgagcgagaccaccgagagcaccgacgtgaaggacagcagcgaggccagcgacagcgccagctag

SEQ ID NO: 22664 - DNA, 714 bp, Artificial Sequence
  Description of Artificial Sequence: Synthetic coding sequence
atgggcagaaagagcagcaaggccaaggagaagaagcagaagagactggaggagagagccgccatggacgccgtgtgcgccaaggtggacgccgccaacagactgggcgaccccctggaggccttccccgtgttcaagaagtacgacagaaacggcctgaacgtgagcatcgagtgcaagagagtgagcggcctggagcccgccaccgtggactgggccttcgacctgaccaagaccaacatgcagaccatgtacgagcagagcgagtggggctggaaggacagagagaagagagaggagatgaccgacgacagagcctggtacctgatcgcctgggagaacagcagcgtgcccgtggccttcagccacttcagattcgacgtggagtgcggcgacgaggtgctgtactgctacgaggtgcagctggagagcaaggtgagaagaaagggcctgggcaagttcctgatccagatcctgcagctgatggccaacagcacccagatgaagaaggtgatgctgaccgtgttcaagcacaaccacggcgcctaccagttcttcagagaggccctgcagttcgagatcgacgacagcagccccagcatgagcggctgctgcggcgaggactgcagctacgagatcctgagcagaagaaccaagttcggcgacagccaccacagccacgccggcggccactgcggcggctgctgccactag

SEQ ID NO: 22665 - DNA, 594 bp, Artificial Sequence
  Description of Artificial Sequence: Synthetic coding sequence
atgcccttcgtgcccaagtggaccctgcccaccggcctgaacgtgagcatcgagtgcaagagagtgagcggcctggagcccgccaccgtggactgggccttcgacctgaccaagaccaacatgcagaccatgtacgagcagagcgagtggggctggaaggacagagagaagagagaggagatgaccgacgacagagcctggtacctgatcgcctgggagaacagcagcgtgcccgtggccttcagccacttcagattcgacgtggagtgcggcgacgaggtgctgtactgctacgaggtgcagctggagagcaaggtgagaagaaagggcctgggcaagttcctgatccagatcctgcagctgatggccaacagcacccagatgaagaaggtgatgctgaccgtgttcaagcacaaccacggcgcctaccagttcttcagagaggccctgcagttcgagatcgacgacagcagccccagcatgagcggctgctgcggcgaggactgcagctacgagatcctgagcagaagaaccaagttcggcgacagccaccacagccacgccggcggccactgcggcggctgctgccactag

SEQ ID NO: 22666 - DNA, 645 bp, Artificial Sequence
  Description of Artificial Sequence: Synthetic coding sequence
atgagcgacctggaggacgacgagaccccccagctgagcgcccacgccctggccgccctgcaggagttctacgccgagcagaagcagcagatcgagcccggcgaggacgacaagtacaacatcggcatcatcgaggagaactggcagctgagccagttctggtacagccaggagaccgccctgcagctggcccaggaggccatcgccgccgtgggcgagggcggcagaatcgcctgcgtgagcgcccccagcgtgtaccagaagctgagagagctgtgcagagagaacttcagcatctacatcttcgagtacgacaagagattcgccatgtacggcgaggagttcatcttctacgactacaacaaccccctggacctgcccgagagaatcgccgcccacagcttcgacatcgtgatcgccgaccccccctacctgagcgaggagtgcctgagaaagaccagcgagaccgtgaagtacctgaccagaggcaagatcctgctgtgcaccggcgccatcatggaggagcaggccgccgagctgctgggcgtgaagatgtgcaccttcgtgcccagacacaccagaaacctggccaacgagttcagatgctacgtgaactacgacagcggcctggactgcggcatctag

SEQ ID NO: 22667 - DNA, 645 bp, Artificial Sequence; identical to SEQ ID NO: 22666
  Description of Artificial Sequence: Synthetic coding sequence

SEQ ID NO: 22668 - DNA, 1110 bp, Artificial Sequence
  Description of Artificial Sequence: Synthetic coding sequence
atgaagctggaggccagctgcggcaccgccaccagcgaggtgcccaagcccgagaagaagaccgccagagacgccgagcccagcagcgagaccagaccccaggaggtggaggccgagcccagaagcggcagcggccccgaggccgaggccgagcccctggacttcgtggtggccaccgagagagagttcgaggaggtgctggccatcagcggcggcatctacggcggcctggactacctgcccagcagataccacagctggctgagagaccccgacagaaccgtggtgctggccaagagaaacggcggcgtgatcgccctggagagcgtgaacgtgatcgacgccggcgagaccgtgctggtggagggcctgagagtggccccctgggagagaggcaagggcgtggccggcctgctgcagagattctgcagccagctggtgaagagacagcaccccggcgtgaaggtggccagactgaccagagacgaccagctgggccccagagagctgaagaagtacagactgatcaccaagcagggcatcctgctggtgagattcaacgccagcgccctgctggccggcctgggcgccagactggccgccctgagaaccagcggcaccttcagccccctgcccaccgaggccgtgagcgaggccggcggcgacgtggccagactgctgctgagccccagcgtgcagagagacgtgctgcccggcggcaccatcatccaggactggcagccctacagacccagcgagagcaacctgagactgctggccgccaagggcctggagtggagagtggacagcagagccagacccagagtgctgaccctgtgcaccagacccttccccatcccccacggcggcgacggcacctggagatacctgaacatcgacgccttcggcagcgacggcgcccaggtgcagagccagctgctgtggcacctgcagagacaggcccccagactggtgggcctgaacgtgatgtgccagctgttcctggagccccagctgtggagccagctggccgacttctgccaggtgggcctgggcctggagctggtgaagggctacaccgagcagtacctgctggaggccgacatctag

SEQ ID NO: 22669 - DNA, 471 bp, Artificial Sequence
  Description of Artificial Sequence: Synthetic coding sequence
atgaagctggaggccagctgcggcaccgccaccagcgaggtgcccaagcccgagaagaagaccgccagagacgccgagcccagcagcgagaccagaccccaggaggtggaggccgagcccagaagcggcagcggccccgaggccgaggccgagcccctggacttcgtggtggccaccgagagagagttcgaggaggtgctggccatcagcggcggcatctacggcggcctggactacctgcccagcagataccacagctggctgagagaccccgacagaaccgtggtgctggccaagagaaacggcggcgtgatcgccctggagagcgtgaacgtgatcgacgccggcgagaccgtgctggtggagggcctgagagtggccccctgggagagaggcaagggcgtggccggcctgctgcagagattctgcagccagctggtgaagagacagcaccccggcgtgaaggtgtag

SEQ ID NO: 22670 - DNA, 1110 bp, Artificial Sequence; identical to SEQ ID NO: 22668
  Description of Artificial Sequence: Synthetic coding sequence

SEQ ID NO: 22671 - DNA, 861 bp, Artificial Sequence
  Description of Artificial Sequence: Synthetic coding sequence
atggagctgatcctgagcaccagccccgccgagctgaccctggaccccgcctgccagcccaagctgcccctggacagcacctgccagcccgagatgaccttcaaccccggccccaccgagctgaccctggaccccgagcaccagcccgaggagacccccgcccccagcctggccgagctgaccctggagcccgtgcacagaagacccgagctgctggacgcctgcgccgacctgatcaacgaccagtggcccagaagcagaaccagcagactgcacagcctgggccagagcagcgacgccttccccctgtgcctgatgctgctgagcccccaccccaccctggaggccgcccccgtggtggtgggccacgccagactgagcagagtgctgaaccagccccagagcctgctggtggagaccgtggtggtggccagagccctgagaggcagaggcttcggcagaagactgatggagggcctggaggtgttcgccagagccagaggcttcagaaagctgcacctgaccacccacgaccaggtgcacttctacacccacctgggctaccagctgggcgagcccgtgcagggcctggtgttcaccagcagaagactgcccgccaccctgctgaacgccttccccaccgcccccagccccagaccccccagaaaggcccccaacctgaccgcccaggccgcccccagaggccccaagggcccccccctgcccccccccccccccctgcccgagtgcctgaccatcagcccccccgtgcccagcggcccccccagcaagagcctgctggagacccagtaccagaacgtgagaggcagacccatcttctggatggagaaggacatctag

SEQ ID NO: 22672 - DNA, 861 bp, Artificial Sequence; identical to SEQ ID NO: 22671
  Description of Artificial Sequence: Synthetic coding sequence

SEQ ID NO: 22673 - DNA, 624 bp, Artificial Sequence
  Description of Artificial Sequence: Synthetic coding sequence
atgagactgaaccagaacaccctgctgctgggcaagaaggtggtgctggtgccctacaccagcgagcacgtgcccagcagataccacgagtggatgaagagcgaggagctgcagagactgaccgccagcgagcccctgaccctggagcaggagtacgccatgcagtgcagctggcaggaggacgccgacaagtgcaccttcatcgtgctggacgccgagaagtggcaggcccagcccggcgccaccgaggagagctgcatggtgggcgacgtgaacctgttcctgaccgacctggaggacctgaccctgggcgagatcgaggtgatgatcgccgagcccagctgcagaggcaagggcctgggcaccgaggccgtgctggccatgctgagctacggcgtgaccaccctgggcctgaccaagttcgaggccaagatcggccagggcaacgagcccagcatcagaatgttccagaagctgcacttcgagcaggtggccaccagcagcgtgttccaggaggtgaccctgagactgaccgtgagcgagagcgagcaccagtggctgctggagcagaccagccacgtggaggagaagccctacagagacggcagcgccgagccctgctag

SEQ ID NO: 22674 - DNA, 4290 bp, Artificial Sequence
  Description of Artificial Sequence: Synthetic coding sequence
atggacagccagttccacatggccggcgaggccagccagagctggctgaaggccaaggagaagcagagaggcaccagctacatggtggccgtgatcgagtgggagatcgagagaagcctgctgagcagcgaggacagagagcagggcgccaccgtgttcctgagagagatccaggacctgcacaagcacatcctggaggactgcgccctgagaatggtggacagactggccgacggctgcctggacgccgacgcccagaacctgctgagcagcctgaagagccacatcaccgacatgcaccccggcgtgctgaagacccacagactgccctggagcagagacctggtgaaccccaagaacaagacccacgcctgctacctgaaggagctgggcgagcagttcgtggtgagagccaaccaccaggtgctgaccagactgagagagctggacaccgccggccaggagctggcctggctgtaccaggagatcagacaccacctgtggcagagcagcgaggtgatccagaccttctgcggcagacaggagctgctggccagactgggccagcagctgagacacgacgacagcaagcagcacacccccctggtgctgttcggcccccccggcatcggcaagaccgccctgatgtgcaagctggccgagcagatgcccagactgctgggccacaagaccgtgaccgtgctgagactgctgggcaccagccagatgagcagcgacgccagaggcctgctgaagagcatctgcttccaggtgtgcctggcctacggcctgcccctgccccccgcccaggtgctggacgcccacaccagagtggtgcagttcttccacaccctgctgcacaccgtgagctgcagaaacttcgagagcctggtgctgctgctggacgccatggacgacctggacagcgtgagacacgccagaagagtgccctggctgcccctgaactgcccccccagagtgcacctgatcctgagcgcctgcagcggcgccctgggcgtgctggacaccctgcagagagtgctgctggaccccgaggcctactgggaggtgaagcccctgagcggcaaccagggccagcagatgatccagctgctgctggccgccgccagaagaaccctgagccccgtgcacaccgacctgctgtgggccagcctgcccgagtgcggcaaccccggcagactgagactggccttcgaggaggccagaaagtgggccagcttcaccgtgcccgtgcccctggccaccaccgccgaggaggccacccaccagctgtgcaccagactggagcagacccacggccagctgctggtggcccacgtgctgggctacatcgtgagcagcagacacggcctgagcgaggccgagctgaaggacgtgctgagcctggacgacgaggtgctgcaggacgtgtacagagactggaccccccccagcaaggagctgctgagattcccccccctgctgtgggtgagactgagaagagacctgggctactacctggccagaagacccgtggacggcttcaccctgctggccatcgcccacagacagctggtggaggtggtgagagagagatacctgagcggcagcgagagagccaagagacacggcgtgctggccgacttcttcagcggcacctggagccagggcaccaagaagctgatcaccctgcccctggtgggcaagcccctgaacctggacagaaaggtggccccccagcccctgtggttcagccacaccgtggccaacctgagaaagctgaaggagctgccctaccacctgctgcacagcggcagactggaggagctgaagcaggaggtgctgggcagcatgagctggatcagctgcagaggcatcagcggcggcatcgaggacctgctggacgacttcgacctgtgcgccccccacctggacagccccgaggtgggcctggtgagagaggccctgcagctgtgcagacccgccgtggagctgagaggcatggagagaagcctgctgtacaccgagctgctggccagactgcacttcttcgccaccagccaccccgccctggtgggccagctgtgccagcaggcccagagctggttccagctgtgcgcccaccccgtgctggtgcccctgggcggcttcctgcagccccccggcggccccctgagagccaccctgagcggctgccacaagggcatcaccgccatggcctggggcgtggaggagaagctgctggtgatcggcacccaggacggcatcatggccgtgtgggacatggaggagcagcacgtgatccacatgctgaccggccacaccggcgaggtgagatgcgtgaagatcttcgccaagggcaccctggccaacagcgccagcaaggactacaccctgcacctgtggaacctgctgagcggccaggagaagttcaccatctgggacggcggcagcaagaaccccgccgagccccagatctggaacctgcacgtggacgaggcccacaaggtggtgtacagcgccagcggcagcaagatcaacgcctggaacctggagaccgccgagcccgtgttccacatcctgggcgacgccagcgacccctggatgtgcatggccgtgctggccagccaggccaccctgctgaccgtgagcagagacggcgtggtgagcctgtggagcagcgccaccggcaagctgcagggcaagcagcacatgagcagcatcaaggaggagacccccacctgcgccgtgagcgtgcagaagcagggcaagctggtgaccggcttcagcaacggcagcatcagcctggtgagcagcaagggcgacagactgctggagaagctgcccgacgccgtgagattcctggtggtgagcgaggacgagagcctgctggccgccggcttcggcagaagcgtgagaatcttcctggccgacagcagaggcttcagaagattcatggccatggacctggagcacgaggacatggtggagaccgccgtgttcggcaccgagaacaacctgatcatcaccggcagcctggacgccctgatccaggtgtggagcctgagcgagcagggcaccctgctggacatcctggagggcgtgggcgcccccgtgagcctgctggccagaggcggcgccctggtggccagcgccagcccccagagcagcagcttcaaggtgtgggacctgagcgacgcccacagaagcagagtgcccgcccccttcctggacagaaccggcctgaccgccgtgagccacaacggcagctacgtgtacttccccaagatcggcgacaagaacaaggtgaccatctgggacctggccgagggcgaggagcaggacagcctggacaccagcagcgagatcagatgcctggaggtggccgagcagagaaagctgctgttcaccggcctggtgagcggcgtggtgctggtgttccccctgaacagcagacaggacgtgatctgcatccccccccccgaggccagaaaggccatcaactgcatgagcctgagcaagtgcgaggacagactggccatcgcctacgacaacatcgtgctggtgctggacatcaccagcggcgacccctgccccgtgatcgacggccccagatacaccttctacacccagctgcccgagaccctgagcagcgtggccatcctgaccgactacagagtggtgtacagcatgaccaacggcgacctgttcctgtacgagtgcgccaccagcaaggccttccccctggagacccacagaagcagagtggcctgcgtggaggtgagccacaaggagcagctggtggtgagcggcagcgaggacgccctgctgtgcctgtgggacctgcaggccagaaagtggaagttcgagatgagctacaccagcagctactgcagaggcgtgcagtgcgcctgcttcagcaaggacgacaagtacgtgtacgtgggcctgaaggacagaagcatcctggtgtggagcgtgctggacggcaccctgctgaccgtgcagttcgtgcacgccgtggtgaacagaatcatccccaccaccagcggcttcatcgcccccaccagacacggctacctgatcagagagaacttccagtgcctgagcgccaaggccagcccccaggaccccctgaagaacttcaagaaggccatgtggatggtgaagagcagacagagagaggagctggtggccgccgccggcgccccccaggacctggagagcgagagcgcccagggcaacgagaccaagagcaacaagtgcagccaggtgtgcctgatcgtgtag

SEQ ID NO: 22675 - DNA, 4299 bp, Artificial Sequence
  Description of Artificial Sequence: Synthetic coding sequence
atgcagagaggcaagccctgcagagccctgcccaccctgaagtgccagaccttctgccagagacacggcctgatgttcgaggtggtggacctgagatggggcatcagaaacatcgaggccaccgaccacctgaccaccgagctgtgcctggaggaggtggacagatgctggaagaccagcatcggccccgccttcgtggccctgatcggcgaccagtacggcccctgcctgatccccagcagaatcgacgagaaggagtgggaggtgctgagagaccacctgaccgccagacccagcgacctggagctggtggccagatacttccagagagacgagaacgccttcccccccacctacgtgctgcaggcccccggcaccggcgaggcctgcgagcccgaggaggccaccctgaccagcgtgctgagaagcggcgcccaggaggccagaagactgggcctgatcacccaggagcagtggcagcactaccacagaagcgtgatcgagtgggagatcgagagaagcctgctgagcagcgaggacagagagcagggcgccaccgtgttcctgagagagatccaggacctgcacaagcacatcctggaggactgcgccctgagaatggtggacagactggccgacggctgcctggacgccgacgcccagaacctgctgagcagcctgaagagccacatcaccgacatgcaccccggcgtgctgaagacccacagactgccctggagcagagacctggtgaaccccaagaacaagacccacgcctgctacctgaaggagctgggcgagcagttcgtggtgagagccaaccaccaggtgctgaccagactgagagagctggacaccgccggccaggagctggcctggctgtaccaggagatcagacaccacctgtggcagagcagcgaggtgatccagaccttctgcggcagacaggagctgctggccagactgggccagcagctgagacacgacgacagcaagcagcacacccccctggtgctgttcggcccccccggcatcggcaagaccgccctgatgtgcaagctggccgagcagatgcccagactgctgggccacaagaccgtgaccgtgctgagactgctgggcaccagccagatgagcagcgacgccagaggcctgctgaagagcatctgcttccaggtgtgcctggcctacggcctgcccctgccccccgcccaggtgctggacgcccacaccagagtggtgcagttcttccacaccctgctgcacaccgtgagctgcagaaacttcgagagcctggtgctgctgctggacgccatggacgacctggacagcgtgagacacgccagaagagtgccctggctgcccctgaactgcccccccagagtgcacctgatcctgagcgcctgcagcggcgccctgggcgtgctggacaccctgcagagagtgctgctggaccccgaggcctactgggaggtgaagcccctgagcggcaaccagggccagcagatgatccagctgctgctggccgccgccagaagaaccctgagccccgtgcacaccgacctgctgtgggccagcctgcccgagtgcggcaaccccggcagactgagactggccttcgaggaggccagaaagtgggccagcttcaccgtgcccgtgcccctggccaccaccgccgaggaggccacccaccagctgtgcaccagactggagcagacccacggccagctgctggtggcccacgtgctgggctacatcgtgagcagcagacacggcctgagcgaggccgagctgaaggacgtgctgagcctggacgacgaggtgctgcaggacgtgtacagagactggaccccccccagcaaggagctgctgagattcccccccctgctgtgggtgagactgagaagagacctgggctactacctggccagaagacccgtggacggcttcaccctgctggccatcgcccacagacagctggtggaggtggtgagagagagatacctgagcggcagcgagagagccaagagacacggcgtgctggccgacttcttcagcggcacctggagccagggcaccaagaagctgatcaccctgcccctggtgggcaagcccctgaacctggacagaaaggtggccccccagcccctgtggttcagccacaccgtggccaacctgagaaagctgaaggagctgccctaccacctgctgcacagcggcagactggaggagctgaagcaggaggtgctgggcagcatgagctggatcagctgcagaggcatcagcggcggcatcgaggacctgctggacgacttcgacctgtgcgccccccacctggacagccccgaggtgggcctggtgagagaggccctgcagctgtgcagacccgccgtggagctgagaggcatggagagaagcctgctgtacaccgagctgctggccagactgcacttcttcgccaccagccaccccgccctggtgggccagctgtgccagcaggcccagagctggttccagctgtgcgcccaccccgtgctggtgcccctgggcggcttcctgcagccccccggcggccccctgagagccaccctgagcggctgccacaagggcatcaccgccatggcctggggcgtggaggagaagctgctggtgatcggcacccaggacggcatcatggccgtgtgggacatggaggagcagcacgtgatccacatgctgaccggccacaccggcgaggtgagatgcgtgaagatcttcgccaagggcaccctggccaacagcgccagcaaggactacaccctgcacctgtggaacctgctgagcggccaggagaagttcaccatctgggacggcggcagcaagaaccccgccgagccccagatctggaacctgcacgtggacgaggcccacaaggtggtgtacagcgccagcggcagcaagatcaacgcctggaacctggagaccgccgagcccgtgttccacatcctgggcgacgccagcgacccctggatgtgcatggccgtgctggccagccaggccaccctgctgaccgtgagcagagacggcgtggtgagcctgtggagcagcgccaccggcaagctgcagggcaagcagcacatgagcagcatcaaggaggagacccccacctgcgccgtgagcgtgcagaagcagggcaagctggtgaccggcttcagcaacggcagcatcagcctggtgagcagcaagggcgacagactgctggagaagctgcccgacgccgtgagattcctggtggtgagcgaggacgagagcctgctggccgccggcttcggcagaagcgtgagaatcttcctggccgacagcagaggcttcagaagattcatggccatggacctggagcacgaggacatggtggagaccgccgtgttcggcaccgagaacaacctgatcatcaccggcagcctggacgccctgatccaggtgtggagcctgagcgagcagggcaccctgctggacatcctggagggcgtgggcgcccccgtgagcctgctggccagaggcggcgccctggtggccagcgccagcccccagagcagcagcttcaaggtgtgggacctgagcgacgcccacagaagcagagtgcccgcccccttcctggacagaaccggcctgaccgccgtgagccacaacggcagctacgtgtacttccccaagatcggcgacaagaacaaggtgaccatctgggacctggccgagggcgaggagcaggacagcctggacaccagcagcgagatcagatgcctggaggtggccgagcagagaaagctgctgttcaccggcctggtgagcggcgtggtgctggtgttccccctgaacagcagacaggacgtgatctgcatccccccccccgaggccagaaaggccatcaactgcatgagcctgagcaagtgcgaggacagactggccatcgcctacgacaacatcgtgctggtgctggacatcaccagcggcgacccctgccccgtgatcgacggccccagatacaccttctacacccagctgcccgagaccctgagcagcgtggccatcctgaccgactacagagtggtgtacagcatgaccaacggcgacctgttcctgtacgagtgcgccaccagcaaggccttccccctggagacccacagaagcagagtggcctgcgtggaggtgagccacaaggagcagctggtggtgagcggcagcgaggacgccctgctgtgcctgtgggacctgcaggccagaaagtggaagttcgagatgagctacaccgccccctgctag

SEQ ID NO: 22676 - DNA, 4290 bp, Artificial Sequence; identical to SEQ ID NO: 22674
  Description of Artificial Sequence: Synthetic coding sequence

SEQ ID NO: 22677 - DNA, 4077 bp, Artificial Sequence
  Description of Artificial Sequence: Synthetic coding sequence
atggtggacagactggccgacggctgcctggacgccgacgcccagaacctgctgagcagcctgaagagccacatcaccgacatgcaccccggcgtgctgaagacccacagactgccctggagcagagacctggtgaaccccaagaacaagacccacgcctgctacctgaaggagctgggcgagcagttcgtggtgagagccaaccaccaggtgctgaccagactgagagagctggacaccgccggccaggagctggcctggctgtaccaggagatcagacaccacctgtggcagagcagcgaggtgatccagaccttctgcggcagacaggagctgctggccagactgggccagcagctgagacacgacgacagcaagcagcacacccccctggtgctgttcggcccccccggcatcggcaagaccgccctgatgtgcaagctggccgagcagatgcccagactgctgggccacaagaccgtgaccgtgctgagactgctgggcaccagccagatgagcagcgacgccagaggcctgctgaagagcatctgcttccaggtgtgcctggcctacggcctgcccctgccccccgcccaggtgctggacgcccacaccagagtggtgcagttcttccacaccctgctgcacaccgtgagctgcagaaacttcgagagcctggtgctgctgctggacgccatggacgacctggacagcgtgagacacgccagaagagtgccctggctgcccctgaactgcccccccagagtgcacctgatcctgagcgcctgcagcggcgccctgggcgtgctggacaccctgcagagagtgctgctggaccccgaggcctactgggaggtgaagcccctgagcggcaaccagggccagcagatgatccagctgctgctggccgccgccagaagaaccctgagccccgtgcacaccgacctgctgtgggccagcctgcccgagtgcggcaaccccggcagactgagactggccttcgaggaggccagaaagtgggccagcttcaccgtgcccgtgcccctggccaccaccgccgaggaggccacccaccagctgtgcaccagactggagcagacccacggccagctgctggtggcccacgtgctgggctacatcgtgagcagcagacacggcctgagcgaggccgagctgaaggacgtgctgagcctggacgacgaggtgctgcaggacgtgtacagagactggaccccccccagcaaggagctgctgagattcccccccctgctgtgggtgagactgagaagagacctgggctactacctggccagaagacccgtggacggcttcaccctgctggccatcgcccacagacagctggtggaggtggtgagagagagatacctgagcggcagcgagagagccaagagacacggcgtgctggccgacttcttcagcggcacctggagccagggcaccaagaagctgatcaccctgcccctggtgggcaagcccctgaacctggacagaaaggtggccccccagcccctgtggttcagccacaccgtggccaacctgagaaagctgaaggagctgccctaccacctgctgcacagcggcagactggaggagctgaagcaggaggtgctgggcagcatgagctggatcagctgcagaggcatcagcggcggcatcgaggacctgctggacgacttcgacctgtgcgccccccacctggacagccccgaggtgggcctggtgagagaggccctgcagctgtgcagacccgccgtggagctgagaggcatggagagaagcctgctgtacaccgagctgctggccagactgcacttcttcgccaccagccaccccgccctggtgggccagctgtgccagcaggcccagagctggttccagctgtgcgcccaccccgtgctggtgcccctgggcggcttcctgcagccccccggcggccccctgagagccaccctgagcggctgccacaagggcatcaccgccatggcctggggcgtggaggagaagctgctggtgatcggcacccaggacggcatcatggccgtgtgggacatggaggagcagcacgtgatccacatgctgaccggccacaccggcgaggtgagatgcgtgaagatcttcgccaagggcaccctggccaacagcgccagcaaggactacaccctgcacctgtggaacctgctgagcggccaggagaagttcaccatctgggacggcggcagcaagaaccccgccgagccccagatctggaacctgcacgtggacgaggcccacaaggtggtgtacagcgccagcggcagcaagatcaacgcctggaacctggagaccgccgagcccgtgttccacatcctgggcgacgccagcgacccctggatgtgcatggccgtgctggccagccaggccaccctgctgaccgtgagcagagacggcgtggtgagcctgtggagcagcgccaccggcaagctgcagggcaagcagcacatgagcagcatcaaggaggagacccccacctgcgccgtgagcgtgcagaagcagggcaagctggtgaccggcttcagcaacggcagcatcagcctggtgagcagcaagggcgacagactgctggagaagctgcccgacgccgtgagattcctggtggtgagcgaggacgagagcctgctggccgccggcttcggcagaagcgtgagaatcttcctggccgacagcagaggcttcagaagattcatggccatggacctggagcacgaggacatggtggagaccgccgtgttcggcaccgagaacaacctgatcatcaccggcagcctggacgccctgatccaggtgtggagcctgagcgagcagggcaccctgctggacatcctggagggcgtgggcgcccccgtgagcctgctggccagaggcggcgccctggtggccagcgccagcccccagagcagcagcttcaaggtgtgggacctgagcgacgcccacagaagcagagtgcccgcccccttcctggacagaaccggcctgaccgccgtgagccacaacggcagctacgtgtacttccccaagatcggcgacaagaacaaggtgaccatctgggacctggccgagggcgaggagcaggacagcctggacaccagcagcgagatcagatgcctggaggtggccgagcagagaaagctgctgttcaccggcctggtgagcggcgtggtgctggtgttccccctgaacagcagacaggacgtgatctgcatccccccccccgaggccagaaaggccatcaactgcatgagcctgagcaagtgcgaggacagactggccatcgcctacgacaacatcgtgctggtgctggacatcaccagcggcgacccctgccccgtgatcgacggccccagatacaccttctacacccagctgcccgagaccctgagcagcgtggccatcctgaccgactacagagtggtgtacagcatgaccaacggcgacctgttcctgtacgagtgcgccaccagcaaggccttccccctggagacccacagaagcagagtggcctgcgtggaggtgagccacaaggagcagctggtggtgagcggcagcgaggacgccctgctgtgcctgtgggacctgcaggccagaaagtggaagttcgagatgagctacaccagcagctactgcagaggcgtgcagtgcgcctgcttcagcaaggacgacaagtacgtgtacgtgggcctgaaggacagaagcatcctggtgtggagcgtgctggacggcaccctgctgaccgtgcagttcgtgcacgccgtggtgaacagaatcatccccaccaccagcggcttcatcgcccccaccagacacggctacctgatcagagagaacttccagtgcctgagcgccaaggccagcccccaggaccccctgaagaacttcaagaaggccatgtggatggtgaagagcagacagagagaggagctggtggccgccgccggcgccccccaggacctggagagcgagagcgcccagggcaacgagaccaagagcaacaagtgcagccaggtgtgcctgatcgtgtag

SEQ ID NO: 22678 - DNA, 4299 bp, Artificial Sequence; identical to SEQ ID NO: 22675
  Description of Artificial Sequence: Synthetic coding sequence

SEQ ID NO: 22679 - DNA, 1182 bp, Artificial Sequence
  Description of Artificial Sequence: Synthetic coding sequence
atggacgagaacgagagcaaccagagcctgatgaccagcagccagtaccccaaggaggccgtgagaaagagacagaacagcgccagaaacagcggcgccagcgacagcagcagattcagcagaaagagcttcaagctggactacagactggaggaggacgtgaccaagagcaagaagggcaaggacggcagattcgtgaacccctggcccacctggaagaaccccagcatccccaacgtgctgagatggctgatcatggagaaggaccacagcagcgtgcccagcagcaaggaggagctggacaaggagctgcccgtgctgaagccctacttcatcaccaaccccgaggaggccggcgtgagagaggccggcctgagagtgacctggctgggccacgccaccgtgatggtggagatggacgagctgatcttcctgaccgaccccatcttcagcagcagagccagccccagccagtacatgggccccaagagattcagaagaagcccctgcaccatcagcgagctgccccccatcgacgccgtgctgatcagccacaaccactacgaccacctggactacaacagcgtgatcgccctgaacgagagattcggcaacgagctgagatggttcgtgcccctgggcctgctggactggatgcagaagtgcggctgcgagaacgtgatcgagctggactggtgggaggagaactgcgtgcccggccacgacaaggtgaccttcgtgttcacccccagccagcactggtgcaagagaaccctgatggacgacaacaaggtgctgtggggcagctggagcgtgctgggcccctggaacagattcttcttcgccggcgacaccggctactgccccgccttcgaggagatcggcaagagattcggccccttcgacctggccgccatccccatcggcgcctacgagcccagatggttcatgaagtaccagcacgtggaccccgaggaggccgtgagaatccacaccgacgtgcagaccaagaagagcatggccatccactggggcaccttcgccctggccaacgagcactacctggagccccccgtgaagctgaacgaggccctggagagatacggcctgaacgccgaggacttcttcgtgctgaagcacggcgagagcagatacctgaacaacgacgacgagaacttctag

SEQ ID NO: 22680 - DNA, 483 bp, Artificial Sequence
  Description of Artificial Sequence: Synthetic coding sequence
atggtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagacccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 22681 - DNA, 498 bp, Artificial Sequence
  Description of Artificial Sequence: Synthetic coding sequence
atgagacagcacagacagttcatggacagaacccactacctgctgaccttcagcagcagcgagaccctgctgagactgctgctgagaatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagacccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 22682 - DNA, 483 bp, Artificial Sequence; identical to SEQ ID NO: 22680
  Description of Artificial Sequence: Synthetic coding sequence

SEQ ID NO: 22683 - DNA, 1122 bp, Artificial Sequence
  Description of Artificial Sequence: Synthetic coding sequence
atggagcccgccgtgagcgagcccatgagagaccaggtggccagaacccacctgaccgaggacacccccaaggtgaacgccgacatcgagaaggtgaaccagaaccaggccaagagatgcaccgtgatcggcggcagcggcttcctgggccagcacatggtggagcagctgctggccagaggctacgccgtgaacgtgttcgacatccagcagggcttcgacaacccccaggtgagattcttcctgggcgacctgtgcagcagacaggacctgtaccccgccctgaagggcgtgaacaccgtgttccactgcgccagccccccccccagcagcaacaacaaggagctgttctacagagtgaactacatcggcaccaagaacgtgatcgagacctgcaaggaggccggcgtgcagaagctgatcctgaccagcagcgccagcgtgatcttcgagggcgtggacatcaagaacggcaccgaggacctgccctacgccatgaagcccatcgactactacaccgagaccaagatcctgcaggagagagccgtgctgggcgccaacgaccccgagaagaacttcctgaccaccgccatcagaccccacggcatcttcggccccagagacccccagctggtgcccatcctgatcgaggccgccagaaacggcaagatgaagttcgtgatcggcaacggcaagaacctggtggacttcaccttcgtggagaacgtggtgcacggccacatcctggccgccgagcagctgagcagagacagcaccctgggcggcaaggccttccacatcaccaacgacgagcccatccccttctggaccttcctgagcagaatcctgaccggcctgaactacgaggcccccaagtaccacatcccctactgggtggcctactacctggccctgctgctgagcctgctggtgatggtgatcagccccgtgatccagctgcagcccaccttcacccccatgagagtggccctggccggcaccttccactactacagctgcgagagagccaagaaggccatgggctaccagcccctggtgaccatggacgacgccatggagagaaccgtgcagagcttcagacacctgagaagagtgaagtag

SEQ ID NO: 22684 - DNA, 1122 bp, Artificial Sequence; identical to SEQ ID NO: 22683
  Description of Artificial Sequence: Synthetic coding sequence

SEQ ID NO: 22685 - DNA, 264 bp, Artificial Sequence
  Description of Artificial Sequence: Synthetic coding sequence
atggccggcgccagcctgggcgccagattctacagacagatcaagagacaccccggcatcatccccatgatcggcctgatctgcctgggcatgggcagcgccgccctgtacctgctgagactggccctgagaagccccgacgtgtgctgggacagaaagaacaaccccgagccctggaacagactgagccccaacgaccagtacaagttcctggccgtgagcaccgactacaagaagctgaagaaggacagacccgacttctag

SEQ ID NO: 22686 - DNA, 264 bp, Artificial Sequence; identical to SEQ ID NO: 22685
  Description of Artificial Sequence: Synthetic coding sequence

SEQ ID NO: 22687 - DNA, 387 bp, Artificial Sequence
  Description of Artificial Sequence: Synthetic coding sequence
atgaccggctacacccccgacgagaagctgagactgcagcagctgagagagctgagaagaagatggctgaaggaccaggagctgagccccagagagcccgtgctgcccccccagaagatgggccccatggagaagttctggaacaagttcctggagaacaagagcccctggagaaagatggtgcacggcgtgtacaagaagagcatcttcgtgttcacccacgtgctggtgcccgtgtggatcatccactactacatgaagtaccacgtgagcgagaagccctacggcatcgtggagaagaagagcagaatcttccccggcgacaccatcctggagaccggcgaggtgatcccccccatgaaggagttccccgaccagcaccactag

SEQ ID NO: 22688 - DNA, 753 bp, Artificial Sequence
  Description of Artificial Sequence: Synthetic coding sequence
atggacatgctgcaggacctggagagcctgcagttcgagtacggcgtgcccgaggaggacagaatctggctgtacctgcagggcagaagcagaggcctgatgatcgaggcctgcgcccacgccaccttcttctgcaagctgctgtacaacctgagagccagcctgaacaagaaccagagcagcagacacctgagcatcggcagcctgaacagcgccacccccgaggagttcaaggtgggcatcatcggcggcggccacctgggcaagcagctggccggcaccctgctgcagctgggccccatccccgccgagagcctgagaatcagcaccagaagacccgagaccctgggcgagctgcagaagctgggcatcaagtgcttctaccacaacgccgacctggtgagctgggccgacgtgatcttcctgtgctgcctgcccagccagctgcccaacatctgcgtggagatctacaccagcctggagaaggccagcatcgtgtacagcttcgtggccgccatccccctgcccagactgaagctgctgctgaaccacaccaacatcctgagaccccagtaccagtacgacgaggacagcgtgagcgtgtggggcgccaacaagggcgtgatcgccgccctgcaggaccccaccatcctgcaggccacctgcccctacagccccgccggccacggcagcacctacttctggcacagcttcgagaactacttccccgtgggccccctgctgagctactag

SEQ ID NO: 22689 - DNA, 1080 bp, Artificial Sequence
  Description of Artificial Sequence: Synthetic coding sequence
atggacatgctgcaggacctggagagcctgcagttcgagtacggcgtgcccgaggaggacagaatctggctgtacctgcagggcagaagcagaggcctgatgatcgaggcctgcgcccacgccaccttcttctgcaagctgctgtacaacctgagagccagcctgaacaagaaccagagcagcagacacctgagcatcggcagcctgaacagcgccacccccgaggagttcaaggtgggcatcatcggcggcggccacctgggcaagcagctggccggcaccctgctgcagctgggccccatccccgccgagagcctgagaatcagcaccagaagacccgagaccctgggcgagctgcagaagctgggcatcaagtgcttctaccacaacgccgacctggtgagctgggccgacgtgatcttcctgtgctgcctgcccagccagctgcccaacatctgcgtggagatctacaccagcctggagaaggccagcatcgtgtacagcttcgtggccgccatccccctgcccagactgaagctgctgctgaaccacaccaacatcctgagaccccagtaccagtacgacgaggacagcgtgagcgtgtggggcgccaacaagggcgtgatcgccgccctgcaggaccccaccatcctgcaggccacctgcccctacagccccgccggcggcatcatcctgaacatcaagtggctggagggcgtgttctacgccgccctgaacatctgcaccgccagaaacatggcccacagccaggtgctgcagctgctgagcgagctgttcctgagcgtgcacttcgaggactgcggcaaggacaccgccagctgccccaagctgcagctgaccgacttcgtgagcaaggcctacggcaagaacctgagccaggagagacccttcccctggttcgacctgaccgccgtgcagctgaaggagacccccttcagccagcacctgagcagcagccccgtgctgcaggaccacctgacccacctgtactgcgccagcttcggcatcagcctgaccaaggagcagcccgtgatcagcaccggcttccccagccagtag

SEQ ID NO: 22690 - DNA, 672 bp, Artificial Sequence
  Description of Artificial Sequence: Synthetic coding sequence
atggacatgctgcaggacctggagagcctgcagttcgagtacggcgtgcccgaggaggacagaatctggctgtacctgcagggcagaagcagaggcctgatgatcgaggcctgcgcccacgccaccttcttctgcaagctgctgtacaacctgagagccagcctgaacaagaaccagagcagcagacacctgagcatcggcagcctgaacagcgccacccccgaggagttcaaggtgggcatcatcggcggcggccacctgggcaagcagctggccggcaccctgctgcagctgggccccatccccgccgagagcctgagaatcagcaccagaagacccgagaccctgggcgagctgcagaagctgggcatcaagtgcttctaccacaacgccgacctggtgagctgggccgacgtgatcttcctgtgctgcctgcccagccagctgcccaacatctgcgtggagatctacaccagcctggagaaggccagcatcgtgtacagcttcgtggccgccatccccctgcccagactgaagctgctgctgaaccacaccaacatcctgagaccccagtaccagtacgacgaggacagcgtgagcgtgtggggcgccaacaagggcgtgatcgccgccctgcaggaccccaccatcctgcaggccacctgcccctag

SEQ ID NO: 22691 - DNA, 699 bp, Artificial Sequence
  Description of Artificial Sequence: Synthetic coding sequence
atggacctgcccatccaggacagccacgacagcagcaccagccccaagggcaagcagcccaccaccgccgagaagagcgccaccaagaaggaggacaaggtgcccgtgaagaagcagaagaccagaaccgtgttcagcagcacccagctgtgcgtgctgaacgacagattccagagacagaagtacctgagcctgcagcagatgcaggagctgagcaacatcctgaacctgagctacaagcaggtgaagacctggttccagaaccagagaatgaagagcaagagatggcagaagaacaactggctgaagaacagcaacggcgtgacccagggctgcctggtgaaccccaccggcaacctgcccatgtggagcaaccagacctggaacaacagcacctggagcaaccagacccagaacatccagagctggagcaaccacagctggaacacccagacctggtgcacccagagctggaacaaccaggcctggaacagccccttctacaactgcggcgaggagagcctgcagagctgcatgcagttccagcccaacagccccgccagcgacctggaggccgccctggaggccgccggcgagggcctgaacgtgatccagcagaccaccagatacttcaacaccccccagaccatggacctgttcctgaactacagcatgaacatgcagcccgaggacgtgtag

SEQ ID NO: 22692 - DNA, 912 bp, Artificial Sequence
  Description of Artificial Sequence: Synthetic coding sequence
atgagcagcaccctgcccgccctgctgtgcgtgggcctgtgcctgagccagagaatcagcgcccagcagcagaccctgcccaagcccttcatctgggccgagccccacttcatggtgcccaaggagaagcaggtgaccatctgctgccagggcaactacggcgccgtggagtaccagctgcacttcgagggcagcctgttcgccgtggacagacccaagccccccgagagaatcaacaaggtgaagttctacatccccgacatgaacagcagaatggccggccagtacagctgcatctacagagtgggcgagctgtggagcgagcccagcaacctgctggacctggtggtgaccgagatgtacgacacccccaccctgagcgtgcaccccggccccgaggtgatcagcggcgagaaggtgaccttctactgcagactggacaccgccaccagcatgttcctgctgctgaaggagggcagaagcagccacgtgcagagaggctacggcaaggtgcaggccgagttccccctgggccccgtgaccaccgcccacagaggcacctacagatgcttcggcagctacaacaaccacgcctggagcttccccagcgagcccgtgaagctgctggtgaccggcgacatcgagaacaccagcctggcccccgaggaccccaccttccccgacacctggggcacctacctgctgaccaccgagaccggcctgcagaaggaccacgccctgtgggaccacaccgcccagaacctgctgagaatgggcctggccttcctggtgctggtggccctggtgtggttcctggtggaggactggctgagcagaaagagaaccagagagagagccagcagagccagcacctgggagggcagaagaagactgaacacccagaccctgtag

SEQ ID NO: 22693 - DNA, 912 bp, Artificial Sequence; identical to SEQ ID NO: 22692
  Description of Artificial Sequence: Synthetic coding sequence

SEQ ID NO: 22694 - DNA, 912 bp, Artificial Sequence; identical to SEQ ID NO: 22692
  Description of Artificial Sequence: Synthetic coding sequence

SEQ ID NO: 22695 - DNA, 912 bp, Artificial Sequence; identical to SEQ ID NO: 22692
  Description of Artificial Sequence: Synthetic coding sequence

SEQ ID NO: 22696 - DNA, 912 bp, Artificial Sequence; identical to SEQ ID NO: 22692
  Description of Artificial Sequence: Synthetic coding sequence

SEQ ID NO: 22697 - DNA, 912 bp, Artificial Sequence; identical to SEQ ID NO: 22692
  Description of Artificial Sequence: Synthetic coding sequence

SEQ ID NO: 22698 - DNA, 912 bp, Artificial Sequence; identical to SEQ ID NO: 22692
  Description of Artificial Sequence: Synthetic coding sequence

SEQ ID NO: 22699 - DNA, 912 bp, Artificial Sequence; identical to SEQ ID NO: 22692
  Description of Artificial Sequence: Synthetic coding sequence

SEQ ID NO: 22700 - DNA, 5730 bp, Artificial Sequence
  Description of Artificial Sequence: Synthetic coding sequence
atggagggcaagagacagctggagaagagagacttcggcaagagactgagcctggacagcagcctggtggagtacatggacagcaacaagtacatcgagcacctgctgacccagctggaggagcagcacagaagcctgtggagagagaagctggccgtggccagactgcagagagaggtggcccagagaaccagcgagggcgccatgcacgagaagctgatccacgagctggaggaggagagacacctgagactgcagagcgagaagagactgcaggaggtgaccctggagagcgagagaaacagaatccagatgagaagcctgcagcagcagttcagcagaatggaggagaccgtgagaaacctgctgcagagccagggcagccccgagcagaagaaggaggagaccgtgaacatcatggtgtaccaggagaagctgagcgaggaggagagaaagcacaaggaggccctggaggacctgcacatggtggtggacgaggacagcagaagcgagagcagcagcaccgacgagggcaaggagaagaccaagctgctgctggagagactgaaggccctggaggccgagaacagcgccctggccctggagaacgagaaccagagagagcagtacgagagatgcctggacgaggtggccaaccaggtggtgcaggccctgctgacccagaaggacctgagagaggagtgcgtgaagctgaagaccagagtgttcgacctggagcagcagaacagaaccctgagcatcctgttccagcagagagtgagacccaccagcgacctgctgctgcagaagctgcacagcagactgctggacctgagcagcggcgacctgctgagcgaggtggagagaaacagaagcctgacccagagcagaaccgacgccgaggtgcacgagcaccagctgaacaccaagagcgccctgaagtgccccggcctgggcgccgtgatccccggccacctgtgccccagaaacagctacagcagcagcagcgagctgagcctgagcagcacctgcagcgagtacagcagcggcagcagctacacctggcacgacggcaagaacctgagaaagagacagagcagccagaactgggacaagagactgagcatcgacagcagcctgcccagcggcttcgccagccccaccaacgagctgccccccaccagaatcaaggagagccacatcctggagggcctgagaaagctgcagaagagaaaggtgctgctggagccccccagcgtgatcaccaagtggggctacaaggactgcatgaacagcaacgagggcatctacagccccggcatcaagagcagcagcctgaaggagtaccccccctgcaagaccgccgacctgggcagcccctgcaaggagccccacaagaccttcgtgtacgacctggacagccacgtggacgccgacgacgaccccagcaccctggccctgctgcaggccgtgcccaaccagagctgcagaccccacggcagcaagctgacccacagcgtgagcgacagcctgttcggctgggagaccaacagaaagcacttcctggagggcaccagcagcgtgtaccccaaggagagacccgagaagctgaccagctgcgccagcagctgccccctggagatgaagctgtgccccagcgtgcagaccccccaggtgcagagagagagaggcccccagggccagggccacggcagaatggccctgaacctgcagctgagcgacaccgacgacaacgagaccttcgacgagctgcacatcgagagcagcgacgagaagagccccagcgacgtgagcctggccgccgacaccgacaagagcgtggagaacctggacgtgctggtgggcttcggcaagagcctgtgcggcagccccgaggaggaggagaagcaggtgcccatccccagcgagaccagacccaagaccttcagcttcatcaagcagcagagagtggtgaagagaaccagcagcgaggagtgcgtgaccgtgatcttcgacgccgaggacggcgagcccatcgagttcagcagccaccagaccggcgtggtgaccgtgaccagaaacgagatcagcatcaacagcacccccgccggccccaaggccgagcacaccgagctgctgccccagggcatcgcctgcctgcagcccagagccgccgccagagactacaccttcttcaagagaagcgaggaggacaccgagaagaacatccccaaggacaacgtggacaacgtgcccagagtgagcaccgagagcttcagcagcagaaccgtgacccagaacccccagcagcagaagctggtgaagcccacccacaacatcagctgccagagcaacagcagaagcagcgcccccatgggcatctaccagaagcagaacctgaccaagatcccccccagaggcaagagcagcccccagaagagcaagctgatggagcccgaggccaccaccctgctgcccagcagcggcctggtgaccctggagaagagccccgccctggcccccggcaagctgagcagattcatgaagaccgagagcagcggccccctgttcgagctgagaagcgacccccacatccccaagcacagcgcccagctgccccacagcagcagaatgcccagcagaagagactgggtgcagtgccccaagagccagacccccggcagcagaagcagacccgccatcgagagcagcgacagcggcgagccccccaccagagacgagcactgcggcagcggccccgaggccggcgtgaagagccccagccccccccccccccccggcagaagcgtgagcctgctggccagacccagctacgactacagccccgcccccagcagcaccaagagcgagaccagagtgcccagcgagaccgccagaacccccttcaagagccccctgctgaagggcatcagcgcccccgtgatcagcagcaaccccgccaccaccgaggtgcagagaaagaagcccagcgtggccttcaagaagcccatcttcacccaccccatgcccagccccgaggccgtgatccagaccagatgccccgcccacgcccccagcagcagcttcaccgtgatggccctgggcccccccaaggtgagccccaagagaggcgtgcccaagaccagccccagacagaccctgggcaccccccagagagacatcggcctgcagacccccagaatcagccccagcacccacgagcccctggagatgaccagcagcaagagcgtgagccccggcagaaagggccagctgaacgacagcgccagcaccccccccaagcccagcttcctgggcgtgaacgagagccccagcagccaggtgagcagcagcagcagcagcagcagccccgccaagagccacaacagcccccacggctgccagagcgcccacgagaagggcctgaagaccagactgcccgtgggcctgaaggtgctgatgaagagcccccagctgctgagaaagagcagcaccgtgcccggcaagcacgagaaggacagcctgaacgaggccagcaagagcagcgtggccgtgaacaagagcaagcccgaggacagcaagaaccccgccagcatggagatcaccgccggcgagagaaacgtgaccctgcccgacagccaggcccagggcagcctggccgacggcctgcccctggagaccgccctgcaggagcccctggagagcagcatccccggcagcgacggcagagacggcgtggacaacagaagcatgagaagaagcctgagcagcagcaagccccacctgaagcccgccctgggcatgaacggcgccaaggccagaagccacagcttcagcacccacagcggcgacaagcccagcaccccccccatcgagggcagcggcaaggtgagaacccagatcatcaccaacaccgccgagagaggcaacagcctgaccagacagaacagcagcaccgagagcagccccaacaaggcccccagcgcccccatgctggagagcctgcccagcgtgggcagacccagcggccaccccagcagcggcaagggcagcctgggcagcagcggcagcttcagcagccagcacggcagccccagcaagctgcccctgagaatcccccccaagagcgagggcctgctgatcccccccggcaaggaggaccagcaggccttcacccagggcgagtgccccagcgccaacgtggccgtgctgggcgagcccggcagcgacagaagaagctgcccccccacccccaccgactgccccgaggccctgcagagccccggcagaacccagcaccccagcaccttcgagaccagcagcaccagcaagctggagaccagcggcagacaccccgacgccagcgccaccgccaccgacgccgtgagcagcgaggcccccctgagccccaccatcgaggagaaggtgatgctgtgcatccaggagaacgtggagaagggccaggtgcagaccaagcccaccagcgtggaggccaagcagaagcccggccccagcttcgccagctggttcggcttcagaaagagcagactgcccgccctgagcagcagaaagatggacatcagcaagaccaaggtggagaagaaggacgccaaggtgctgggcttcggcaacagacagctgaagagcgagagaaagaaggagaagaagaagcccgagctgcagtgcgagaccgagaacgagctgatcaaggacaccaagagcgccgacaaccccgacggcggcctgcagagcaagaacaacagaagaaccccccaggacatctacaaccagctgaagatcgagcccagaaacagacacagccccgtggcctgcagcaccaaggacaccttcatgaccgagctgctgaacagagtggacaagaaggccgccccccagaccgagagcggcagcagcaacgccagctgcagaaacgtgctgaagggcagcagccagggcagctgcctgatcggcagcagcatcagcacccagggcaaccacaagaagaacatgaagatcaaggccgacatggaggtgcccaaggacagcctggtgaaggaggccaacgagaacctgcaggaggacgaggacgacgccgtggccgacagcgtgttccagagccacatcatcgagagcaactgccagatgagaaccctggacagcggcatcggcaccttccccctgcccgacagcggcaacagaagcaccggcagatacctgtgccagcccgacagccccgaggacgccgagcccctgctgcccctgcagagcgccctgagcgccgtgagcagcatgagagcccagaccctggagagagaggtgcccagcagcaccgacggccagagacccgccgacagcgccatcgtgcacagcaccagcgaccccatcatgaccgccagaggcatgagacccctgcagagcagactgcccaagcccgccagcagcggcaaggtgagcagccagaagcagaacgaggccgagcccagaccccagacctgcagcagcttcggctacgccgaggaccccatggccagccagcccctgcccgactggggcagcgaggtggccgccaccggcacccaggacaaggcccccagaatgtgcacctacagcgccagcggcggcagcaacagcgacagcgacctggactacggcgacaacggcttcggcgccggcagaggccagctggtgaaggccctgaagagcgccgcccccgagatcgagaccacctag

SEQ ID NO: 22701 - DNA, 210 bp, Artificial Sequence
  Description of Artificial Sequence: Synthetic coding sequence
atggagggcaagagacagctggagaagagagacttcggcaagagactgagcctggacagcagcctggtggagtacatggacagcaacaagtacatcgagcacctgctgacccagctggaggagcagcacagaagcctgtggagagagaagctggccgtggccagactgcagagagaggtggcccagagaaccagcgagggcgccatgtag

SEQ ID NO: 22702 - DNA, 1773 bp, Artificial Sequence
  Description of Artificial Sequence: Synthetic coding sequence
atggagggcaagagacagctggagaagagagacttcggcaagagactgagcctggacagcagcctggtggagtacatggacagcaacaagtacatcgagcacctgctgacccagctggaggagcagcacagaagcctgtggagagagaagctggccgtggccagactgcagagagaggtggcccagagaaccagcgagggcgccatgcacgagaagctgatccacgagctggaggaggagagacacctgagactgcagagcgagaagagactgcaggaggtgaccctggagagcgagagaaacagaatccagatgagaagcctgcagcagcagttcagcagaatggaggagaccgtgagaaacctgctgcagagccagggcagccccgagcagaagaaggaggagaccgtgaacatcatggtgtaccaggagaagctgagcgaggaggagagaaagcacaaggaggccctggaggacctgcacatggtggtggacgaggacagcagaagcgagagcagcagcaccgacgagggcaaggagaagaccaagctgctgctggagagactgaaggccctggaggccgagaacagcgccctggccctggagaacgagaaccagagagagcagtacgagagatgcctggacgaggtggccaaccaggtggtgcaggccctgctgacccagaaggacctgagagaggagtgcgtgaagctgaagaccagagtgttcgacctggagcagcagaacagaaccctgagcatcctgttccagcagagagtgagacccaccagcgacctgctgctgcagaagctgcacagcagactgctggacctgagcagcggcgacctgctgagcgaggtggagagaaacagaagcctgacccagagcagaaccgacgccgaggtgcacgagcaccagctgaacaccaagagcgccctgaagtgccccggcctgggcgccgtgatccccggccacctgtgccccagaaacagctacagcagcagcagcgagctgagcctgagcagcacctgcagcgagtacagcagcggcagcagctacacctggcacgacggcaagaacctgagaaagagagtgaaggaggccaacgagaacctgcaggaggacgaggacgacgccgtggccgacagcgtgttccagagccacatcatcgagagcaactgccagatgagaaccctggacagcggcatcggcaccttccccctgcccgacagcggcaacagaagcaccggcagatacctgtgccagcccgacagccccgaggacgccgagcccctgctgcccctgcagagcgccctgagcgccgtgagcagcatgagagcccagaccctggagagagaggtgcccagcagcaccgacggccagagacccgccgacagcgccatcgtgcacagcaccagcgaccccatcatgaccgccagaggcatgagacccctgcagagcagactgcccaagcccgccagcagcggcaaggtgagcagccagaagcagaacgaggccgagcccagaccccagacctgcagcagcttcggctacgccgaggaccccatggccagccagcccctgcccgactggggcagcgaggtggccgccaccggcacccaggacaaggcccccagaatgtgcacctacagcgccagcggcggcagcaacagcgacagcgacctggactacggcgacaacggcttcggcgccggcagaggccagctggtgaaggccctgaagagcgccgcccccgagatcgagaccacctag

SEQ ID NO: 22703 - DNA, 1773 bp, Artificial Sequence; identical to SEQ ID NO: 22702
  Description of Artificial Sequence: Synthetic coding sequence

SEQ ID NO: 22704 - DNA, 5730 bp, Artificial Sequence; identical to SEQ ID NO: 22700
  Description of Artificial Sequence: Synthetic coding sequence

SEQ ID NO: 22705 - DNA, 1773 bp, Artificial Sequence
  Description of Artificial Sequence: Synthetic coding sequence
atggagggcaagagacagctggagaagagagacttcggcaagagactgagcctggacagcagcctggtggagtacatggacagcaacaagtacatcgagcacctgctgacccagctggaggagcagcacagaagcctgtggagagagaagctggccgtggccagactgcagagagaggtggcccagagaaccagcgagggcgccatgcacgagaagctgatccacgagctggaggaggagagacacctgagactgcagagcgagaagagactgcaggaggtgaccctggagagcgagagaaacagaatccagatgagaagcctgcagcagcagttcagcagaatggaggagaccgtgagaaacctgctgcagagccagggcagccccgagcagaagaaggaggagaccgtgaacatcatggtgtaccaggagaagctgagcgaggaggagagaaagcacaaggaggccctggaggacctgcacatggtggtggacgaggacagcagaagcgagagcagcagcaccgacgagggcaaggagaagaccaagctgctgctggagagactgaaggccctggaggccgagaacagcgccctggccctggagaacgagaaccagagagagcagtacgagagatgcctggacgaggtggccaaccaggtggtgcaggccctgctgacccagaaggacctgagagaggagtgcgtgaagctgaagaccagagtgttcgacctggagcagcagaacagaaccctgagcatcctgttccagcagagagtgagacccaccagcgacctgctgctgcagaagctgcacagcagactgctggacctgagcagcggcgacctgctgagcgaggtggagagaaacagaagcctgacccagagcagaaccgacgccgaggtgcacgagcaccagctgaacaccaagagcgccctgaagtgccccggcctgggcgccgtgatccccggccacctgtgccccagaaacagctacagcagcagcagcgagctgagcctgagcagcacctgcagcgagtacagcagcggcagcagctacacctggcacgacggcaagaacctgagaaagagagtgaaggaggccaacgagaacctgcaggaggacgaggacgacgccgtggccgacagcgtgttccagagccacatcatcgagagcaactgccagatgagaaccctggacagcggcatcggcaccttccccctgcccgacagcggcaacagaagcaccggcagatacctgtgccagcccgacagccccgaggacgccgagcccctgctgcccctgcagagcgccctgagcgccgtgagcagcatgagagcccagaccctggagagagaggtgcccagcagcaccgacggccagagacccgccgacagcgccatcgtgcacagcaccagcgaccccatcatgaccgccagaggcatgagacccctgcagagcagactgcccaagcccgccagcagcggcaaggtgagcagccagaagcagaacgaggccgagcccagaccccagacctgcagcagcttcggctacgccgaggaccccatggccagccagcccctgcccgactggggcagcgaggtggccgccaccggcacccaggacaaggcccccagaatgtgcacctacagcgccagcggcggcagcaacagcgacagcgacctggactacggcgacaacggcttcggcgccggcagaggccagctggtgaaggccctgaagagcgccgcccccgagatgcccatcacctag

SEQ ID NO: 22706 - DNA, 537 bp, Artificial Sequence
  Description of Artificial Sequence: Synthetic coding sequence
atggacagcaacaagtacatcgagcacctgctgacccagctggaggagcagcacagaagcctgtggagagagaagctggccgtggccagactgcagagagaggtggcccagagaaccagcgagggcgccatgcacgagaagctgatccacgagctggaggaggagagacacctgagactgcagagcgagaagagactgcaggaggtgaccctggagagcgagagaaacagaatccagatgagaagcctgcagcagcagttcagcagaatggaggagaccgtgagaaacctgctgcagagccagggcagccccgagcagaagaaggaggagaccgtgaacatcatggtgtaccaggagaagctgagcgaggaggagagaaagcacaaggaggccctggaggacctgcacatggtggtggacgaggacagcagaagcgagagcagcagcaccgacgagggcaaggagaagaccaagctgctgctggagagactgaaggccctggagagaaacggctggaactggcaccccgtgagctag

SEQ ID NO: 22707 - DNA, 4005 bp, Artificial Sequence
  Description of Artificial Sequence: Synthetic coding sequence
atgagcgaggccatggaccagcccgccggcggccccggcaaccccagacccggcgagggcgacgacggcagcatggagcccggcacctgccaggagctgctgcacagactgagagagctggaggccgagaacagcgccctggcccaggccaacgagaaccagagagagacctacgagagatgcctggacgaggtggccaaccacgtggtgcaggccctgctgaaccagaaggacctgagagaggagtgcatcaagctgaagaagagagtgttcgacctggagagacagaaccagatgctgagcgccctgttccagcagaagctgcagctgaccaccggcagcctgccccagatccccctgacccccctgcagccccccagcgagccccccgccagccccagcctgagcagcaccgagggccccgccgcccccctgcccctgggccactgcgccggccagagagaggtgtgctgggagcagcagctgagacccggcggccccggcccccccgccgcccccccccccgccctggacgccctgagccccttcctgagaaagaaggcccagatcctggaggtgctgagagccctggaggagaccgaccccctgctgctgtgcagccccgccaccccctggagaccccccggccagggccccggcagccccgagcccatcaacggcgagctgtgcggccccccccagcccgagcccagcccctgggccccctgcctgctgctgggccccggcaacctgggcggcctgctgcactgggagagactgctgggcggcctgggcggcgaggaggacaccggcagaccctggggccccagcagaggccccccccaggcccagggcaccagcagcggccccaactgcgcccccggcagcagcagcagcagcagcagcgacgaggccggcgaccccaacgaggcccccagccccgacaccctgctgggcgccctggccagaagacagctgaacctgggccagctgctggaggacaccgagagctacctgcaggccttcctggccggcgccgccggccccctgaacggcgaccaccccggccccggccagagcagcagccccgaccaggcccccccccagctgagcaagagcaagggcctgcccaagagcgcctggggcggcggcacccccgaggcccacagacccggcttcggcgccaccagcgagggccagggccccctgcccttcctgagcatgttcatgggcgccggcgacgcccccctgggcagcagacccggccacccccacagcagcagccaggtgaagagcaagctgcagatcggcccccccagccccggcgaggcccagggccccctgctgcccagccccgccagaggcctgaagttcctgaagctgccccccaccagcgagaagagccccagccccggcggcccccagctgagcccccagctgcccagaaacagcagaatcccctgcagaaacagcggcagcgacggcagccccagccccctgctggccagaagaggcctgggcggcggcgagctgagccccgagggcgcccagggcctgcccaccagccccagcccctgctacaccacccccgacagcacccagctgagacccccccagagcgccctgagcaccaccctgagccccggccccgtggtgagcccctgctacgagaacatcctggacctgagcagaagcaccttcagaggccccagccccgagcccccccccagccccctgcaggtgcccacctacccccagctgaccctggaggtgccccaggcccccgaggtgctgagaagccccggcgtgccccccagcccctgcctgcccgagagctacccctacggcagcccccaggagaagagcctggacaaggccggcagcgagagcccccaccccggcagaagaacccccggcaacagcagcaagaagcccagccagggcagcggcagaagacccggcgaccccggcagcacccccctgagagacagactggccgccctgggcaagctgaagaccggccccgagggcgccctgggcagcgagaagaacggcgtgcccgccagacccggcaccgagaagaccagaggccccggcaagagcggcgagagcgccggcgacatggtgcccagcatccacagacccctggagcagctggaggccaagggcggcatcagaggcgccgtggccctgggcaccaacagcctgaagcagcaggagcccggcctgatgggcgaccccggcgccagagtgtacagcagccacagcatgggcgccagagtggacctggagcccgtgagccccagaagctgcctgaccaaggtggagctggccaagagcagactggccggcgccctgtgcccccaggtgcccagaacccccgccaaggtgcccaccagcgcccccagcctgggcaagcccaacaagagcccccacagcagccccaccaagctgcccagcaagagccccaccaaggtggtgcccagacccggcgcccccctggtgaccaaggagagccccaagcccgacaagggcaagggccccccctgggccgactgcggcagcaccaccgcccagagcacccccctggtgcccggccccaccgaccccagccagggccccgagggcctggccccccacagcgccatcgaggagaaggtgatgaagggcatcgaggagaacgtgctgagactgcagggccaggagagagcccccggcgccgaggtgaagcacagaaacaccagcagcatcgccagctggttcggcctgaagaagagcaagctgcccgccctgaacagaagaaccgaggccaccaagaacaaggagggcgccggcggcggcagccccctgagaagagaggtgaagatggaggccagaaagctggaggccgagagcctgaacatcagcaagctgatggccaaggccgaggacctgagaagagccctggaggaggagaaggcctacctgagcagcagagccagacccagacccggcggccccgcccccggccccaacaccggcctgggccaggtgcagggccagctggccggcatgtaccagggcgccgacaccttcatgcagcagctgctgaacagagtggacggcaaggagctgcccagcaagagctggagagagcccaagcccgagtacggcgacttccagcccgtgagcagcgaccccaagagcccctggcccgcctgcggccccagaaacggcctggtgggccccctgcagggctgcggcaagccccccggcaagcccagcagcgagcccggcagaagagaggagatgcccagcgaggacagcctggccgagcccgtgcccaccagccacttcaccgcctgcggcagcctgaccagaaccctggacagcggcatcggcaccttccccccccccgaccacggcagcagcggcacccccagcaagaacctgcccaagaccaagccccccagactggaccccccccccggcgtgccccccgccagacccccccccctgaccaaggtgcccagaagagcccacaccctggagagagaggtgcccggcatcgaggagctgctggtgagcggcagacaccccagcatgcccgccttccccgccctgctgcccgccgcccccggccacagaggccacgagacctgccccgacgacccctgcgaggaccccggccccaccccccccgtgcagctggccaagaactggaccttccccaacaccagagccgccggcagcagcagcgaccccctgatgtgcccccccagacagctggagggcctgcccagaacccccatggccctgcccgtggacagaaagagaagccaggagcccagcagacccagccccaccccccagggcccccccttcggcggcagcagaacccccagcaccagcgacatggccgaggagggcagagtggccagcggcggcccccccggcctggagaccagcgagagcctgagcgacagcctgtacgacagcctgagcagctgcggcagccagggctag

SEQ ID NO: 22708 - DNA, 3927 bp, Artificial Sequence
  Description of Artificial Sequence: Synthetic coding sequence
atggaccagcccgccggcggccccggcaaccccagacccggcgagggcgacgacggcagcatggagcccggcacctgccaggagctgctgcacagactgagagagctggaggccgagaacagcgccctggcccaggccaacgagaaccagagagagacctacgagagatgcctggacgaggtggccaaccacgtggtgcaggccctgctgaaccagaaggacctgagagaggagtgcatcaagctgaagaagagagtgttcgacctggagagacagaaccagatgctgagcgccctgttccagcagaagctgcagctgaccaccggcagcctgccccagatccccctgacccccctgcagccccccagcgagccccccgccagccccagcctgagcagcaccgagggccccgccgcccccctgcccctgggccactgcgccggccagagagaggtgtgctgggagcagcagctgagacccggcggccccggcccccccgccgcccccccccccgccctggacgccctgagccccttcctgagaaagaaggcccagatcctggaggtgctgagagccctggaggagaccgaccccctgctgctgtgcagccccgccaccccctggagaccccccggccagggccccggcagccccgagcccatcaacggcgagctgtgcggccccccccagcccgagcccagcccctgggccccctgcctgctgctgggccccggcaacctgggcggcctgctgcactgggagagactgctgggcggcctgggcggcgaggaggacaccggcagaccctggggccccagcagaggccccccccaggcccagggcaccagcagcggccccaactgcgcccccggcagcagcagcagcagcagcagcgacgaggccggcgaccccaacgaggcccccagccccgacaccctgctgggcgccctggccagaagacagctgaacctgggccagctgctggaggacaccgagagctacctgcaggccttcctggccggcgccgccggccccctgaacggcgaccaccccggccccggccagagcagcagccccgaccaggcccccccccagctgagcaagagcaagggcctgcccaagagcgcctggggcggcggcacccccgaggcccacagacccggcttcggcgccaccagcgagggccagggccccctgcccttcctgagcatgttcatgggcgccggcgacgcccccctgggcagcagacccggccacccccacagcagcagccaggtgaagagcaagctgcagatcggcccccccagccccggcgaggcccagggccccctgctgcccagccccgccagaggcctgaagttcctgaagctgccccccaccagcgagaagagccccagccccggcggcccccagctgagcccccagctgcccagaaacagcagaatcccctgcagaaacagcggcagcgacggcagccccagccccctgctggccagaagaggcctgggcggcggcgagctgagccccgagggcgcccagggcctgcccaccagccccagcccctgctacaccacccccgacagcacccagctgagacccccccagagcgccctgagcaccaccctgagccccggccccgtggtgagcccctgctacgagaacatcctggacctgagcagaagcaccttcagaggccccagccccgagcccccccccagccccctgcaggtgcccacctacccccagctgaccctggaggtgccccaggcccccgaggtgctgagaagccccggcgtgccccccagcccctgcctgcccgagagctacccctacggcagcccccaggagaagagcctggacaaggccggcagcgagagcccccaccccggcagaagaacccccggcaacagcagcaagaagcccagccagggcagcggcagaagacccggcgaccccggcagcacccccctgagagacagactggccgccctgggcaagctgaagaccggccccgagggcgccctgggcagcgagaagaacggcgtgcccgccagacccggcaccgagaagaccagaggccccggcaagagcggcgagagcgccggcgacatggtgcccagcatccacagacccctggagcagctggaggccaagggcggcatcagaggcgccgtggccctgggcaccaacagcctgaagcagcaggagcccggcctgatgggcgaccccggcgccagagtgtacagcagccacagcatgggcgccagagtggacctggagcccgtgagccccagaagctgcctgaccaaggtgcccaccagcgcccccagcctgggcaagcccaacaagagcccccacagcagccccaccaagctgcccagcaagagccccaccaaggtggtgcccagacccggcgcccccctggtgaccaaggagagccccaagcccgacaagggcaagggccccccctgggccgactgcggcagcaccaccgcccagagcacccccctggtgcccggccccaccgaccccagccagggccccgagggcctggccccccacagcgccatcgaggagaaggtgatgaagggcatcgaggagaacgtgctgagactgcagggccaggagagagcccccggcgccgaggtgaagcacagaaacaccagcagcatcgccagctggttcggcctgaagaagagcaagctgcccgccctgaacagaagaaccgaggccaccaagaacaaggagggcgccggcggcggcagccccctgagaagagaggtgaagatggaggccagaaagctggaggccgagagcctgaacatcagcaagctgatggccaaggccgaggacctgagaagagccctggaggaggagaaggcctacctgagcagcagagccagacccagacccggcggccccgcccccggccccaacaccggcctgggccaggtgcagggccagctggccggcatgtaccagggcgccgacaccttcatgcagcagctgctgaacagagtggacggcaaggagctgcccagcaagagctggagagagcccaagcccgagtacggcgacttccagcccgtgagcagcgaccccaagagcccctggcccgcctgcggccccagaaacggcctggtgggccccctgcagggctgcggcaagccccccggcaagcccagcagcgagcccggcagaagagaggagatgcccagcgaggacagcctggccgagcccgtgcccaccagccacttcaccgcctgcggcagcctgaccagaaccctggacagcggcatcggcaccttccccccccccgaccacggcagcagcggcacccccagcaagaacctgcccaagaccaagccccccagactggaccccccccccggcgtgccccccgccagacccccccccctgaccaaggtgcccagaagagcccacaccctggagagagaggtgcccggcatcgaggagctgctggtgagcggcagacaccccagcatgcccgccttccccgccctgctgcccgccgcccccggccacagaggccacgagacctgccccgacgacccctgcgaggaccccggccccaccccccccgtgcagctggccaagaactggaccttccccaacaccagagccgccggcagcagcagcgaccccctgatgtgcccccccagacagctggagggcctgcccagaacccccatggccctgcccgtggacagaaagagaagccaggagcccagcagacccagccccaccccccagggcccccccttcggcggcagcagaacccccagcaccagcgacatggccgaggagggcagagtggccagcggcggcccccccggcctggagaccagcgagagcctgagcgacagcctgtacgacagcctgagcagctgcggcagccagggctag

SEQ ID NO: 22709 - DNA, 1116 bp, Artificial Sequence
  Description of Artificial Sequence: Synthetic coding sequence
atggccggcctgcaggagctgagattccccgaggagaagcccctgctgagaggccaggacgccaccgagctggagagcagcgacgccttcctgctggccgccgacaccgactggaaggagcacgacatcgagaccccctacggcctgctgcacgtggtgatcagaggcagccccaagggcaacagacccgccatcctgacctaccacgacgtgggcctgaaccacaagctgtgcttcaacaccttcttcaacttcgaggacatgcaggagatcaccaagcacttcgtggtgtgccacgtggacgcccccggccagcaggtgggcgccagccagttcccccagggctaccagttccccagcatggagcagctggccgccatgctgcccagcgtggtgcagcacttcggcttcaagtacgtgatcggcatcggcgtgggcgccggcgcctacgtgctggccaagttcgccctgatcttccccgacctggtggagggcctggtgctggtgaacatcgaccccaacggcaagggctggatcgactgggccgccaccaagctgagcggcctgaccagcaccctgcccgacaccgtgctgagccacctgttcagccaggaggagctggtgaacaacaccgagctggtgcagagctacagacagcagatcggcaacgtggtgaaccaggccaacctgcagctgttctggaacatgtacaacagcagaagagacctggacatcaacagacccggcaccgtgcccaacgccaagaccctgagatgccccgtgatgctggtggtgggcgacaacgcccccgccgaggacggcgtggtggagtgcaacagcaagctggaccccaccaccaccaccttcctgaagatggccgacagcggcggcctgccccaggtgacccagcccggcaagctgaccgaggccttcaagtacttcctgcagggcatgggctacatgcccagcgccagcatgaccagactggccagaagcagaaccgccagcctgaccagcgccagcagcgtggacggcagcagaccccaggcctgcacccacagcgagagcagcgagggcctgggccaggtgaaccacaccatggaggtgagctgctag

SEQ ID NO: 22710 - DNA, 1110 bp, Artificial Sequence
  Description of Artificial Sequence: Synthetic coding sequence
atgcccgagtgctgggacggcgtgggcgagggcaacgccggcgccgtgaagctggccggcctgggcgaccccagatggagccccggccacctgctgagccccggccaccaggagcacgacatcgagaccccctacggcctgctgcacgtggtgatcagaggcagccccaagggcaacagacccgccatcctgacctaccacgacgtgggcctgaaccacaagctgtgcttcaacaccttcttcaacttcgaggacatgcaggagatcaccaagcacttcgtggtgtgccacgtggacgcccccggccagcaggtgggcgccagccagttcccccagggctaccagttccccagcatggagcagctggccgccatgctgcccagcgtggtgcagcacttcggcttcaagtacgtgatcggcatcggcgtgggcgccggcgcctacgtgctggccaagttcgccctgatcttccccgacctggtggagggcctggtgctggtgaacatcgaccccaacggcaagggctggatcgactgggccgccaccaagctgagcggcctgaccagcaccctgcccgacaccgtgctgagccacctgttcagccaggaggagctggtgaacaacaccgagctggtgcagagctacagacagcagatcggcaacgtggtgaaccaggccaacctgcagctgttctggaacatgtacaacagcagaagagacctggacatcaacagacccggcaccgtgcccaacgccaagaccctgagatgccccgtgatgctggtggtgggcgacaacgcccccgccgaggacggcgtggtggagtgcaacagcaagctggaccccaccaccaccaccttcctgaagatggccgacagcggcggcctgccccaggtgacccagcccggcaagctgaccgaggccttcaagtacttcctgcagggcatgggctacatgcccagcgccagcatgaccagactggccagaagcagaaccgccagcctgaccagcgccagcagcgtggacggcagcagaccccaggcctgcacccacagcgagagcagcgagggcctgggccaggtgaaccacaccatggaggtgagctgctag

SEQ ID NO: 22711 - DNA, 1116 bp, Artificial Sequence; identical to SEQ ID NO: 22709
  Description of Artificial Sequence: Synthetic coding sequence

SEQ ID NO: 22712 - DNA, 1176 bp, Artificial Sequence
  Description of Artificial Sequence: Synthetic coding sequence
atgaaggtgctgggccacagactggagctgctgaccggcctgctgctgcacgacgtgaccatggccggcctgcaggagctgagattccccgaggagaagcccctgctgagaggccaggacgccaccgagctggagagcagcgacgccttcctgctggccgccgacaccgactggaaggagcacgacatcgagaccccctacggcctgctgcacgtggtgatcagaggcagccccaagggcaacagacccgccatcctgacctaccacgacgtgggcctgaaccacaagctgtgcttcaacaccttcttcaacttcgaggacatgcaggagatcaccaagcacttcgtggtgtgccacgtggacgcccccggccagcaggtgggcgccagccagttcccccagggctaccagttccccagcatggagcagctggccgccatgctgcccagcgtggtgcagcacttcggcttcaagtacgtgatcggcatcggcgtgggcgccggcgcctacgtgctggccaagttcgccctgatcttccccgacctggtggagggcctggtgctggtgaacatcgaccccaacggcaagggctggatcgactgggccgccaccaagctgagcggcctgaccagcaccctgcccgacaccgtgctgagccacctgttcagccaggaggagctggtgaacaacaccgagctggtgcagagctacagacagcagatcggcaacgtggtgaaccaggccaacctgcagctgttctggaacatgtacaacagcagaagagacctggacatcaacagacccggcaccgtgcccaacgccaagaccctgagatgccccgtgatgctggtggtgggcgacaacgcccccgccgaggacggcgtggtggagtgcaacagcaagctggaccccaccaccaccaccttcctgaagatggccgacagcggcggcctgccccaggtgacccagcccggcaagctgaccgaggccttcaagtacttcctgcagggcatgggctacatgcccagcgccagcatgaccagactggccagaagcagaaccgccagcctgaccagcgccagcagcgtggacggcagcagaccccaggcctgcacccacagcgagagcagcgagggcctgggccaggtgaaccacaccatggaggtgagctgctag

SEQ ID NO: 22713 - DNA, 894 bp, Artificial Sequence
  Description of Artificial Sequence: Synthetic coding sequence
atgcaggagatcaccaagcacttcgtggtgtgccacgtggacgcccccggccagcaggtgggcgccagccagttcccccagggctaccagttccccagcatggagcagctggccgccatgctgcccagcgtggtgcagcacttcggcttcaagtacgtgatcggcatcggcgtgggcgccggcgcctacgtgctggccaagttcgccctgatcttccccgacctggtggagggcctggtgctggtgaacatcgaccccaacggcaagggctggatcgactgggccgccaccaagctgagcggcctgaccagcaccctgcccgacaccgtgctgagccacctgttcagccaggaggagctggtgaacaacaccgagctggtgcagagctacagacagcagatcggcaacgtggtgaaccaggccaacctgcagctgttctggaacatgtacaacagcagaagagacctggacatcaacagacccggcaccgtgcccaacgccaagaccctgagatgccccgtgatgctggtggtgggcgacaacgcccccgccgaggacggcgtggtggagtgcaacagcaagctggaccccaccaccaccaccttcctgaagatggccgacagcggcggcctgccccaggtgacccagcccggcaagctgaccgaggccttcaagtacttcctgcagggcatgggctacatcgcctacctgaaggacagaagactgagcggcggcgccgtgcccagcgccagcatgaccagactggccagaagcagaaccgccagcctgaccagcgccagcagcgtggacggcagcagaccccaggcctgcacccacagcgagagcagcgagggcctgggccaggtgaaccacaccatggaggtgagctgctag

SEQ ID NO: 22714 - DNA, 1020 bp, Artificial Sequence
  Description of Artificial Sequence: Synthetic coding sequence
atgcccgagtgctgggacggcgagcacgacatcgagaccccctacggcctgctgcacgtggtgatcagaggcagccccaagggcaacagacccgccatcctgacctaccacgacgtgggcctgaaccacaagctgtgcttcaacaccttcttcaacttcgaggacatgcaggagatcaccaagcacttcgtggtgtgccacgtggacgcccccggccagcaggtgggcgccagccagttcccccagggctaccagttccccagcatggagcagctggccgccatgctgcccagcgtggtgcagcacttcggcttcaagtacgtgatcggcatcggcgtgggcgccggcgcctacgtgctggccaagttcgccctgatcttccccgacctggtggagggcctggtgctggtgaacatcgaccccaacggcaagggctggatcgactgggccgccaccaagctgagcggcctgaccagcaccctgcccgacaccgtgctgagccacctgttcagccaggaggagctggtgaacaacaccgagctggtgcagagctacagacagcagatcggcaacgtggtgaaccaggccaacctgcagctgttctggaacatgtacaacagcagaagagacctggacatcaacagacccggcaccgtgcccaacgccaagaccctgagatgccccgtgatgctggtggtgggcgacaacgcccccgccgaggacggcgtggtggagtgcaacagcaagctggaccccaccaccaccaccttcctgaagatggccgacagcggcggcctgccccaggtgacccagcccggcaagctgaccgaggccttcaagtacttcctgcagggcatgggctacatgcccagcgccagcatgaccagactggccagaagcagaaccgccagcctgaccagcgccagcagcgtggacggcagcagaccccaggcctgcacccacagcgagagcagcgagggcctgggccaggtgaaccacaccatggaggtgagctgctag

SEQ ID NO: 22715 - DNA, 1059 bp, Artificial Sequence
  Description of Artificial Sequence: Synthetic coding sequence
atgcccgagtgctgggacggcgagcacgacatcgagaccccctacggcctgctgcacgtggtgatcagaggcagccccaagggcaacagacccgccatcctgacctaccacgacgtgggcctgaaccacaagctgtgcttcaacaccttcttcaacttcgaggacatgcaggagatcaccaagcacttcgtggtgtgccacgtggacgcccccggccagcaggtgggcgccagccagttcccccagggctaccagttccccagcatggagcagctggccgccatgctgcccagcgtggtgcagcacttcggcttcaagtacgtgatcggcatcggcgtgggcgccggcgcctacgtgctggccaagttcgccctgatcttccccgacctggtggagggcctggtgctggtgaacatcgaccccaacggcaagggctggatcgactgggccgccaccaagctgagcggcctgaccagcaccctgcccgacaccgtgctgagccacctgttcagccaggaggagctggtgaacaacaccgagctggtgcagagctacagacagcagatcggcaacgtggtgaaccaggccaacctgcagctgttctggaacatgtacaacagcagaagagacctggacatcaacagacccggcaccgtgcccaacgccaagaccctgagatgccccgtgatgctggtggtgggcgacaacgcccccgccgaggacggcgtggtggagtgcaacagcaagctggaccccaccaccaccaccttcctgaagatggccgacagcggcggcctgccccaggtgacccagcccggcaagctgaccgaggccttcaagtacttcctgcagggcatgggctacatcgcctacctgaaggacagaagactgagcggcggcgccgtgcccagcgccagcatgaccagactggccagaagcagaaccgccagcctgaccagcgccagcagcgtggacggcagcagaccccaggcctgcacccacagcgagagcagcgagggcctgggccaggtgaaccacaccatggaggtgagctgctag

SEQ ID NO: 22716 - DNA, 345 bp, Artificial Sequence
  Description of Artificial Sequence: Synthetic coding sequence
atgatcgccagaagaaaccccgagcccctgagattcctgcccgacgaggccagaagcctgcccccccccaagctgaccgaccccagactgctgtacatcggcttcctgggctactgcagcggcctgatcgacaacctgatcagaagaagacccatcgccaccgccggcctgcacagacagctgctgtacatcaccgccttcttcttcgccggctactacctggtgaagagagaggactacctgtacgccgtgagagacagagagatgttcggctacatgaagctgcaccccgaggacttccccgaggaggacgtgtactgctgcggcgccgagagaagaggctag

SEQ ID NO: 22717 - DNA, 732 bp, Artificial Sequence
  Description of Artificial Sequence: Synthetic coding sequence
atggaggacagcttcctgcagagcttcggcagactgagcctgcagccccagcagcagcagcagagacagagaccccccagacccccccccagaggcaccccccccagaagacacagcttcagaaagcacctgtacctgctgagaggcctgcccggcagcggcaagaccaccctggccagacagctgcagcacgacttccccagagccctgatcttcagcaccgacgacttcttcttcagagaggacggcgcctacgagttcaaccccgacttcctggaggaggcccacgagtggaaccagaagagagccagaaaggccatgagaaacggcatcagccccatcatcatcgacaacaccaacctgcacgcctgggagatgaagccctacgccgtgatggccctggagaacaactacgaggtgatcttcagagagcccgacaccagatggaagttcaacgtgcaggagctggccagaagaaacatccacggcgtgagcagagagaagatccacagaatgaaggagagatacgagcacgacgtgaccttccacagcgtgctgcacgccgagaagcccagcagaatgaacagaaaccaggacagaaacaacgccctgcccagcaacaacgccagatactggaacagctacaccgagttccccaacagaagagcccacggcggcttcaccaacgagagcagctaccacagaagaggcggctgccaccacggctactag

SEQ ID NO: 22718 - DNA, 414 bp, Artificial Sequence
  Description of Artificial Sequence: Synthetic coding sequence
atgagaaacggcatcagccccatcatcatcgacaacaccaacctgcacgcctgggagatgaagccctacgccgtgatggccctggagaacaactacgaggtgatcttcagagagcccgacaccagatggaagttcaacgtgcaggagctggccagaagaaacatccacggcgtgagcagagagaagatccacagaatgaaggagagatacgagcacgacgtgaccttccacagcgtgctgcacgccgagaagcccagcagaatgaacagaaaccaggacagaaacaacgccctgcccagcaacaacgccagatactggaacagctacaccgagttccccaacagaagagcccacggcggcttcaccaacgagagcagctaccacagaagaggcggctgccaccacggctactag

SEQ ID NO: 22719 - DNA, 522 bp, Artificial Sequence
  Description of Artificial Sequence: Synthetic coding sequence
atggaggacagcttcctgcagagcttcggcagactgagcctgcagccccagcagcagcagcagagacagagaccccccagacccccccccagaggcaccccccccagaagacacagcttcagaaagcacctgtacctgctgagaggcctgcccggcagcggcaagaccaccctggccagacagctgcagcacgacttccccagagccctgatcttcagcaccgacgacttcttcttcagagaggacggcgcctacgagttcaaccccgacttcctggaggaggcccacgagtggaaccagaagagagccagaaaggccatgagaaacggcatcagccccatcatcatcgacaacaccaacctgcacgcctgggagatgaagccctacgccgtgatggtgttccagaccgagcagaagaacctgttcagactggagatggacatggtggtgttcagacccgagatgaagaagcacagctggtgcctgaagagaaagaacccccccaacgagagaaccgtgtag

SEQ ID NO: 22720 - DNA, 1752 bp, Artificial Sequence
  Description of Artificial Sequence: Synthetic coding sequence
atgagctacggcgagatcgagggcaagttcctgggccccagagaggaggtgaccagcgagcccagatgcaagaagctgaagagcaccaccgagagctacgtgttccacaaccacagcaacgccgacttccacagaatccaggagaagaccggcaacgactgggtgcccgtgaccatcatcgacgtgagaggccacagctacctgcaggagaacaagatcaagaccaccgacctgcacagacccctgcacgacgagatgcccggcaacagacccgacgtgatcgagagcatcgacagccaggtgctgcaggaggccagaccccccctggtgagcgccgacgacgagatctacagcaccagcaaggccttcatcggccccatctacaagccccccgagaagaagaagagaaacgagggcagaaacgaggcccacgtgctgaacggcatcaacgacagaggcggccagaaggagaagcagaagttcaacagcgagaagagcgagatcgacaacgagctgttccagttctacaaggagatcgaggagctggagaaggagaaggacggcttcgagaacagctgcaaggagagcgagcccagccaggagcagttcgtgcccttctacgagggccacaacaacggcctgctgaagcccgacgaggagaagaaggacctgagcaacaaggccatgcccagccactgcgactaccagcagaacctgggcaacgagcccgacaagtacccctgcaacggccaggtgatccccaccttctgcgacaccagcttcaccagcttcagacccgagtggcagagcgtgtaccccttcatcgtgccctacggcccccccctgcccagcctgaactaccacctgaacatccagagattcagcggcccccccaacccccccagcaacatcttccaggcccaggacgacagccagatccagaacggctactacgtgaacaactgccacgtgaactggaactgcatgaccttcgaccagaacaacgagtacaccgactgcagcgagaacagaagcagcgtgcaccccagcggcaacggctgcagcatgcaggacagatacgtgagcaacggcttctgcgaggtgagagagagatgctggaaggaccactgcatggacaagcacaacggcaccgacagattcgtgaaccagcagttccaggaggagaagctgaacaagctgcagaagctgctgatcctgctgagaggcctgcccggcagcggcaagaccaccctgagcagaatcctgctgggccagaacagagacggcatcgtgttcagcaccgacgactacttccaccaccaggacggctacagatacaacgtgaaccagctgggcgacgcccacgactggaaccagaacagagccaagcaggccatcgaccagggcagaagccccgtgatcatcgacaacaccaacatccaggcctgggagatgaagccctacgtggaggtggccatcggcaagggctacagagtggagttccacgagcccgagacctggtggaagttcgaccccgaggagctggagaagagaaacaagcacggcgtgagcagaaagaagatcgcccagatgctggacagatacgagtaccagatgagcatcagcatcgtgatgaacagcgtggagcccagccacaagagcacccagagacccccccccccccagggcagacagagatggggcggcagcctgggcagccacaacagagtgtgcgtgaccaacaaccactag

SEQ ID NO: 22721 - DNA, 2214 bp, Artificial Sequence
  Description of Artificial Sequence: Synthetic coding sequence
atggccctgtgcagcgccctgatgaccatcttcaccatcaagatgggcaccgccaagcaggccatcgaccagggcagaagccccgtgatcatcgacaacaccaacatccaggcctgggagatgaagccctacgtggaggtggccatcggcaagggctacagagtggagttccacgagcccgagacctggtggaagttcgaccccgaggagctggagaagagaaacaagcacggcgtgagcagaaagaagatcgcccagatgctggacagatacgagtaccagatgagcatcagcatcgtgatgaacagcgtggagcccagccacaagagcacccagagacccccccccccccagggcagacagagagagagagtgctgaagaagaccggccacagactgagcaagaccaagcagaagagaaacagaaagagaaacaagaagcagaacagccagaacagaatcatggaggagaacagcctggagttcctgagcgacctgacccccggcgaccaggaccccagccagagcgaggaggaggacatcgagaagaccagaagagagagcgagtaccccttcatcgacggcctgcagaacgaggtgggcgacttcgtgaccggctacaaggagaagagatggaagaacaaggaccccaaggacagcttccagaacgtgatgagcatcgtggagctggacaacacccccaagaactacctgagcaaggagggcgacaacctgttcgtgagcctgctgctgagacccaacgagatcagcgtgacctgccccatcctgacccagaacctgagctgcgtgaccaccgacgactgcagcggcatgaaggtggagaagcacatcagaaacagacacaccatcgccctggacacccaggacctgagcgccgagaccagctgcctgttcatgaagaagagagagatcgtggacaagaacctgagccacgagcccatcctgtgccaccagcacggcatcagaatgagcgacaaggtgctgagagaggagcaggtgtacaccaccaagatcaaccactgggccttcttcaccaccaacctgagcgacgaggacctgcagctgggcagcgacagacagccctacttcggcagctggcccgccggcccccacaagttcatctgcgagcagagacccaagaaggacagagcctgcaagctggccggccccgacagcagaggccagtggatccagatgatcttcaccagcgtggccgccagcgagcccggcaacaaccccgagatcctgaccgacaagctgctgatcggcaacgaggacttcagccccccccccgagaccatggacagcttcatcgagaccaacctgttcagaagctgcctgccccagcccgacatccccaagaacgccctggagagcaccaagaacaagaagagaagaaagaagagaatcttcaacctggtgcccaacttcgacctgctgggccagagcagaatcggcgtgaaggagagagagaagtgcgacctgctgaccaagaaccacggcctgaagatcaccctgggcgaggagaaggacagaatcagcgagagaaacagcgaggaggagaacaagcagaagctgatgaccttcgaccaccaccccctgtggttctacctggacatcatcaaggccacccccctgaacatcgacggccagagatacagccactgcctgagcttcaacagactgagatgcagcgccagcctgtacaagaactacatccccagcttcgtgctgcacaacctgagcagcatctggaagcccagcttcaccaacaagaagctgttcctgaccttcgagagccagaccagagtgggcaacaagctgaacgacgccggcttcatcagccccgagatcctgcacagccaccccgacaccagctgcagcctgggcgtgaccagcgacttccacttcctgaacgagagattcgacagaaagctgaagagatgggaggagcccaaggagctgcccgccgaggacagccaggacctgaccagcaccgactacagaagcctggagctgcccctgagccagggcttcgccttccagctggtgaagctgttcggcagccccggcgtgcccatggagagcctgctgcccgacgactacgtggtgcccctggactggaagaccctgaagatgatctacctgcagtggaagatgagcgtggagaagagacagaagaagatcggctag

SEQ ID NO: 22722 - DNA, 2259 bp, Artificial Sequence
  Description of Artificial Sequence: Synthetic coding sequence
atgagctacggcgagatcgaggagttctgcctggtgagaatcgtgatggccctgtgcagcgccctgatgaccatcttcaccatcaagatgggcaccgccaagcaggccatcgaccagggcagaagccccgtgatcatcgacaacaccaacatccaggcctgggagatgaagccctacgtggaggtggccatcggcaagggctacagagtggagttccacgagcccgagacctggtggaagttcgaccccgaggagctggagaagagaaacaagcacggcgtgagcagaaagaagatcgcccagatgctggacagatacgagtaccagatgagcatcagcatcgtgatgaacagcgtggagcccagccacaagagcacccagagacccccccccccccagggcagacagagagagagagtgctgaagaagaccggccacagactgagcaagaccaagcagaagagaaacagaaagagaaacaagaagcagaacagccagaacagaatcatggaggagaacagcctggagttcctgagcgacctgacccccggcgaccaggaccccagccagagcgaggaggaggacatcgagaagaccagaagagagagcgagtaccccttcatcgacggcctgcagaacgaggtgggcgacttcgtgaccggctacaaggagaagagatggaagaacaaggaccccaaggacagcttccagaacgtgatgagcatcgtggagctggacaacacccccaagaactacctgagcaaggagggcgacaacctgttcgtgagcctgctgctgagacccaacgagatcagcgtgacctgccccatcctgacccagaacctgagctgcgtgaccaccgacgactgcagcggcatgaaggtggagaagcacatcagaaacagacacaccatcgccctggacacccaggacctgagcgccgagaccagctgcctgttcatgaagaagagagagatcgtggacaagaacctgagccacgagcccatcctgtgccaccagcacggcatcagaatgagcgacaaggtgctgagagaggagcaggtgtacaccaccaagatcaaccactgggccttcttcaccaccaacctgagcgacgaggacctgcagctgggcagcgacagacagccctacttcggcagctggcccgccggcccccacaagttcatctgcgagcagagacccaagaaggacagagcctgcaagctggccggccccgacagcagaggccagtggatccagatgatcttcaccagcgtggccgccagcgagcccggcaacaaccccgagatcctgaccgacaagctgctgatcggcaacgaggacttcagccccccccccgagaccatggacagcttcatcgagaccaacctgttcagaagctgcctgccccagcccgacatccccaagaacgccctggagagcaccaagaacaagaagagaagaaagaagagaatcttcaacctggtgcccaacttcgacctgctgggccagagcagaatcggcgtgaaggagagagagaagtgcgacctgctgaccaagaaccacggcctgaagatcaccctgggcgaggagaaggacagaatcagcgagagaaacagcgaggaggagaacaagcagaagctgatgaccttcgaccaccaccccctgtggttctacctggacatcatcaaggccacccccctgaacatcgacggccagagatacagccactgcctgagcttcaacagactgagatgcagcgccagcctgtacaagaactacatccccagcttcgtgctgcacaacctgagcagcatctggaagcccagcttcaccaacaagaagctgttcctgaccttcgagagccagaccagagtgggcaacaagctgaacgacgccggcttcatcagccccgagatcctgcacagccaccccgacaccagctgcagcctgggcgtgaccagcgacttccacttcctgaacgagagattcgacagaaagctgaagagatgggaggagcccaaggagctgcccgccgaggacagccaggacctgaccagcaccgactacagaagcctggagctgcccctgagccagggcttcgccttccagctggtgaagctgttcggcagccccggcgtgcccatggagagcctgctgcccgacgactacgtggtgcccctggactggaagaccctgaagatgatctacctgcagtggaagatgagcgtggagaagagacagaagaagatcggctag

SEQ ID NO: 22723 - DNA, 513 bp, Artificial Sequence
  Description of Artificial Sequence: Synthetic coding sequence
atgctgatcaaggtgaagaccctgaccggcaaggagatcgagatcgacatcgagcccaccgacaaggtggagagaatcaaggagagagtggaggagaaggagggcatccccccccagcagcagagactgatctacagcggcaagcagatcgacggcaccgtgagagacagaagaggccaggacgtgagactgtaccccgaggtgcccgaggtgctgaagagactgcagagcctgggcgtgcccggcgccgccgccagcagaaccagcgagatcgagggcgccaaccagctgctggagctgttcgacctgttcagatacttcgtgcacagagagatctaccccggcagcaagatcacccacttcgagagactgcagcagaagaccggcatccccttcagccagatgatcttcttcgacgacgagagaagaaacatcgtggacgtgagcaagctgggcgtgacctgcatccacatccagaacggcatgaacctgcagaccctgagccagggctag

SEQ ID NO: 22724 - DNA, 339 bp, Artificial Sequence
  Description of Artificial Sequence: Synthetic coding sequence
atgtggaagggcggcagaagccaccccttcctgccctgcagcagcagaagagccggcagcggcggccagctggacagcatcctgccccaccagagccccgcctggggcccctggggctgcaaggacctgagcagcggcgtgcccagcttcctgaccagcagcatcctgtggaagagcgccgtgttcgccgaggacaacggcctgaagatccacctgtgcagctacaagagagacgacctggtgctgttctacgactgcaccagcttcgtgctgaccttcggccccagcccctggttcctgacccagggcttcctgaaccccctggagttcagcgcctag

SEQ ID NO: 22725 - DNA, 2577 bp, Artificial Sequence
  Description of Artificial Sequence: Synthetic coding sequence
atgctgcagaccaaggacctgatctggaccctgttcttcctgggcaccgccgtgagcctgcaggtggacatcgtgcccagccagggcgagatcagcgtgggcgagagcaagttcttcctgtgccaggtggccggcgacgccaaggacaaggacatcagctggttcagccccaacggcgagaagctgacccccaaccagcagagaatcagcgtggtgtggaacgacgacagcagcagcaccctgaccatctacaacgccaacatcgacgacgccggcatctacaagtgcgtggtgaccggcgaggacggcagcgagagcgaggccaccgtgaacgtgaagatcttccagaagctgatgttcaagaacgcccccaccccccaggagttcagagagggcgaggacgccgtgatcgtgtgcgacgtggtgagcagcctgccccccaccatcatctggaagcacaagggcagagacgtgatcctgaagaaggacgtgagattcatcgtgctgagcaacaactacctgcagatcagaggcatcaagaagaccgacgagggcacctacagatgcgagggcagaatcctggccagaggcgagatcaacttcaaggacatccaggtgatcgtgaacgtgccccccaccatccaggccagacagaacatcgtgaacgccaccgccaacctgggccagagcgtgaccctggtgtgcgacgccgagggcttccccgagcccaccatgagctggaccaaggacggcgagcagatcgagcaggaggaggacgacgagaagtacatcttcagcgacgacagcagccagctgaccatcaagaaggtggacaagaacgacgaggccgagtacatctgcatcgccgagaacaaggccggcgagcaggacgccaccatccacctgaaggtgttcgccaagcccaagatcacctacgtggagaaccagaccgccatggagctggaggagcaggtgaccctgacctgcgaggccagcggcgaccccatccccagcatcacctggagaaccagcaccagaaacatcagcagcgaggagaaggccagctggaccagacccgagaagcaggagaccctggacggccacatggtggtgagaagccacgccagagtgagcagcctgaccctgaagagcatccagtacaccgacgccggcgagtacatctgcaccgccagcaacaccatcggccaggacagccagagcatgtacctggaggtgcagtacgcccccaagctgcagggccccgtggccgtgtacacctgggagggcaaccaggtgaacatcacctgcgaggtgttcgcctaccccagcgccaccatcagctggttcagagacggccagctgctgcccagcagcaactacagcaacatcaagatctacaacacccccagcgccagctacctggaggtgacccccgacagcgagaacgacttcggcaactacaactgcaccgccgtgaacagaatcggccaggagagcctggagttcatcctggtgcaggccgacacccccagcagccccagcatcgaccaggtggagccctacagcagcaccgcccaggtgcagttcgacgagcccgaggccaccggcggcgtgcccatcctgaagtacaaggccgagtggagagccgtgggcgaggaggtgtggcacagcaagtggtacgacgccaaggaggccagcatggagggcatcgtgaccatcgtgggcctgaagcccgagaccacctacgccgtgagactggccgccctgaacggcaagggcctgggcgagatcagcgccgccagcgagttcaagacccagcccgtgcagggcgagcccagcgcccccaagctggagggccagatgggcgaggacggcaacagcatcaaggtgaacctgatcaagcaggacgacggcggcagccccatcagacactacctggtgagatacagagccctgagcagcgagtggaagcccgagatcagactgcccagcggcagcgaccacgtgatgctgaagagcctggactggaacgccgagtacgaggtgtacgtggtggccgagaaccagcagggcaagagcaaggccgcccacttcgtgttcagaaccagcgcccagcccaccgccatccccgccaacggcagccccaccagcggcctgagcaccggcgccatcgtgggcatcctgatcgtgatcttcgtgctgctgctggtggtggtggacatcacctgctacttcctgaacaagtgcggcctgttcatgtgcatcgccgtgaacctgtgcggcaaggccggccccggcgccaagggcaaggacatggaggagggcaaggccgccttcagcaaggacgagagcaaggagcccatcgtggaggtgagaaccgaggaggagagaacccccaaccacgacggcggcaagcacaccgagcccaacgagaccacccccctgaccgagcccgagaagggccccgtggaggccaagcccgagtgccaggagaccgagaccaagcccgcccccgccgaggtgaagaccgtgcccaacgacgccacccagaccaaggagaacgagagcaaggcctag

SEQ ID NO: 22726 - DNA, 2181 bp, Artificial Sequence
  Description of Artificial Sequence: Synthetic coding sequence
atgctgcagaccaaggacctgatctggaccctgttcttcctgggcaccgccgtgagcctgcaggtggacatcgtgcccagccagggcgagatcagcgtgggcgagagcaagttcttcctgtgccaggtggccggcgacgccaaggacaaggacatcagctggttcagccccaacggcgagaagctgacccccaaccagcagagaatcagcgtggtgtggaacgacgacagcagcagcaccctgaccatctacaacgccaacatcgacgacgccggcatctacaagtgcgtggtgaccggcgaggacggcagcgagagcgaggccaccgtgaacgtgaagatcttccagaagctgatgttcaagaacgcccccaccccccaggagttcagagagggcgaggacgccgtgatcgtgtgcgacgtggtgagcagcctgccccccaccatcatctggaagcacaagggcagagacgtgatcctgaagaaggacgtgagattcatcgtgctgagcaacaactacctgcagatcagaggcatcaagaagaccgacgagggcacctacagatgcgagggcagaatcctggccagaggcgagatcaacttcaaggacatccaggtgatcgtgaacgtgccccccaccatccaggccagacagaacatcgtgaacgccaccgccaacctgggccagagcgtgaccctggtgtgcgacgccgagggcttccccgagcccaccatgagctggaccaaggacggcgagcagatcgagcaggaggaggacgacgagaagtacatcttcagcgacgacagcagccagctgaccatcaagaaggtggacaagaacgacgaggccgagtacatctgcatcgccgagaacaaggccggcgagcaggacgccaccatccacctgaaggtgttcgccaagcccaagatcacctacgtggagaaccagaccgccatggagctggaggagcaggtgaccctgacctgcgaggccagcggcgaccccatccccagcatcacctggagaaccagcaccagaaacatcagcagcgaggagaagaccctggacggccacatggtggtgagaagccacgccagagtgagcagcctgaccctgaagagcatccagtacaccgacgccggcgagtacatctgcaccgccagcaacaccatcggccaggacagccagagcatgtacctggaggtgcagtacgcccccaagctgcagggccccgtggccgtgtacacctgggagggcaaccaggtgaacatcacctgcgaggtgttcgcctaccccagcgccaccatcagctggttcagagacggccagctgctgcccagcagcaactacagcaacatcaagatctacaacacccccagcgccagctacctggaggtgacccccgacagcgagaacgacttcggcaactacaactgcaccgccgtgaacagaatcggccaggagagcctggagttcatcctggtgcaggccgacacccccagcagccccagcatcgaccaggtggagccctacagcagcaccgcccaggtgcagttcgacgagcccgaggccaccggcggcgtgcccatcctgaagtacaaggccgagtggagagccgtgggcgaggaggtgtggcacagcaagtggtacgacgccaaggaggccagcatggagggcatcgtgaccatcgtgggcctgaagcccgagaccacctacgccgtgagactggccgccctgaacggcaagggcctgggcgagatcagcgccgccagcgagttcaagacccagcccgtgcagggcgagcccagcgcccccaagctggagggccagatgggcgaggacggcaacagcatcaaggtgaacctgatcaagcaggacgacggcggcagccccatcagacactacctggtgagatacagagccctgagcagcgagtggaagcccgagatcagactgcccagcggcagcgaccacgtgatgctgaagagcctggactggaacgccgagtacgaggtgtacgtggtggccgagaaccagcagggcaagagcaaggccgcccacttcgtgttcagaaccagcgcccagcccaccgccatccccgccaccctgggcggcaacagcgccagctacaccttcgtgagcctgctgttcagcgccgtgaccctgctgctgctgtgctag

SEQ ID NO: 22727 - DNA, 2286 bp, Artificial Sequence
  Description of Artificial Sequence: Synthetic coding sequence
atgctgcagaccaaggacctgatctggaccctgttcttcctgggcaccgccgtgagcctgcaggtggacatcgtgcccagccagggcgagatcagcgtgggcgagagcaagttcttcctgtgccaggtggccggcgacgccaaggacaaggacatcagctggttcagccccaacggcgagaagctgacccccaaccagcagagaatcagcgtggtgtggaacgacgacagcagcagcaccctgaccatctacaacgccaacatcgacgacgccggcatctacaagtgcgtggtgaccggcgaggacggcagcgagagcgaggccaccgtgaacgtgaagatcttccagaagctgatgttcaagaacgcccccaccccccaggagttcagagagggcgaggacgccgtgatcgtgtgcgacgtggtgagcagcctgccccccaccatcatctggaagcacaagggcagagacgtgatcctgaagaaggacgtgagattcatcgtgctgagcaacaactacctgcagatcagaggcatcaagaagaccgacgagggcacctacagatgcgagggcagaatcctggccagaggcgagatcaacttcaaggacatccaggtgatcgtgaacgtgccccccaccatccaggccagacagaacatcgtgaacgccaccgccaacctgggccagagcgtgaccctggtgtgcgacgccgagggcttccccgagcccaccatgagctggaccaaggacggcgagcagatcgagcaggaggaggacgacgagaagtacatcttcagcgacgacagcagccagctgaccatcaagaaggtggacaagaacgacgaggccgagtacatctgcatcgccgagaacaaggccggcgagcaggacgccaccatccacctgaaggtgttcgccaagcccaagatcacctacgtggagaaccagaccgccatggagctggaggagcaggtgaccctgacctgcgaggccagcggcgaccccatccccagcatcacctggagaaccagcaccagaaacatcagcagcgaggagaagaccctggacggccacatggtggtgagaagccacgccagagtgagcagcctgaccctgaagagcatccagtacaccgacgccggcgagtacatctgcaccgccagcaacaccatcggccaggacagccagagcatgtacctggaggtgcagtacgcccccaagctgcagggccccgtggccgtgtacacctgggagggcaaccaggtgaacatcacctgcgaggtgttcgcctaccccagcgccaccatcagctggttcagagacggccagctgctgcccagcagcaactacagcaacatcaagatctacaacacccccagcgccagctacctggaggtgacccccgacagcgagaacgacttcggcaactacaactgcaccgccgtgaacagaatcggccaggagagcctggagttcatcctggtgcaggccgacacccccagcagccccagcatcgaccaggtggagccctacagcagcaccgcccaggtgcagttcgacgagcccgaggccaccggcggcgtgcccatcctgaagtacaaggccgagtggagagccgtgggcgaggaggtgtggcacagcaagtggtacgacgccaaggaggccagcatggagggcatcgtgaccatcgtgggcctgaagcccgagaccacctacgccgtgagactggccgccctgaacggcaagggcctgggcgagatcagcgccgccagcgagttcaagacccagcccgtgcacagcccccccccccccgccagcgccagcagcagcacccccgtgcccctgagcccccccgacaccacctggcccctgcccgccctggccaccaccgagcccgccaagggcgagcccagcgcccccaagctggagggccagatgggcgaggacggcaacagcatcaaggtgaacctgatcaagcaggacgacggcggcagccccatcagacactacctggtgagatacagagccctgagcagcgagtggaagcccgagatcagactgcccagcggcagcgaccacgtgatgctgaagagcctggactggaacgccgagtacgaggtgtacgtggtggccgagaaccagcagggcaagagcaaggccgcccacttcgtgttcagaaccagcgcccagcccaccgccatccccgccaccctgggcggcaacagcgccagctacaccttcgtgagcctgctgttcagcgccgtgaccctgctgctgctgtgctag

SEQ ID NO: 22728 - DNA, 1668 bp, Artificial Sequence
  Description of Artificial Sequence: Synthetic coding sequence
atgggcaacaccgtgcacagaaccctgcccgaccccagcccccccgccagactgctggccaccagaccctgctgcggccccggccccgagagaagacccgtgctgggcgaggcccccagattccacgcccaggccaagggcaagaacgtgagactggacggccacagcagaagagccaccagaagaaacagcttctgcaacggcgtgaccttcacccagagacccatcagactgtacgagcaggtgagactgagactggtggccgtgagacccggctggagcggcgccctgagattcggcttcaccgcccacgaccccagcctgatgagcgcccaggacatccccaagtacgcctgccccgacctggtgaccagacccggctactgggccaaggccctgcccgagaacctggccctgagagacaccgtgctggcctactgggccgacagacacggcagagtgttctacagcgtgaacgacggcgagcccgtgctgttccactgcggcgtggccgtgggcggccccctgtgggccctgatcgacgtgtacggcatcaccgacgaggtgcagctgctggagagcgccttcgccgacaccctgacccccgccagactgagccaggccagattcagcgcctgcctgccccccagcagccacgacgccgccaacttcgacaacaacgagctggagaacaaccaggtggtggccaagctgggccacctggccctgggcagagcccccggccccccccccgccgacgccgccgccgccgccatcccctgcggccccagagagagacccagacccgccagcagccccgccctgctggaggccgacctgagattccacgccaccagaggccccgacgtgagcctgagcgccgacagaaaggtggcctgcgcccccagacccgacggcggcagaaccctggtgttcagcgagagacccctgagacccggcgagagcctgttcgtggaggtgggcagacccggcctggccgcccccggcgccctggccttcggcatcaccagctgcgaccccggcgtgctgagacccaacgagctgcccgccgaccccgacgccctgctggacagaaaggagtactgggtggtggccagagccggccccgtgcccagcggcggcgacgccctgagcttcaccctgagacccggcggcgacgtgctgctgggcatcaacggcagacccagaggcagactgctgtgcgtggacaccacccaggccctgtgggccttcttcgccgtgagaggcggcgtggccggccagctgagactgctgggcaccctgcagagcagccccgccaccaccacccccagcggcagcctgagcggcagccaggacgacagcgacagcgacatgaccttcagcgtgaaccagagcagcagcgccagcgagagcagcctggtgaccgcccccagcagccccctgagcccccccgtgagccccgtgttcagcccccccgagcccgccggcatcaagaacggcgagtgcaccgtgtgcttcgacggcgaggtggacaccgtgatctacacctgcggccacatgtgcctgtgccacagctgcggcctgagactgaagagacaggccagagcctgctgccccatctgcagaagacccatcaaggacgtgatcaagatctacagaccctag

SEQ ID NO: 22729 - DNA, 4683 bp, Artificial Sequence
  Description of Artificial Sequence: Synthetic coding sequence
atggccgccggcagcggcggcagcggcggcagcggcggcggccccggccccggccccggcggcggcggcggccccagcggcagcggcagcggccccggcagcaacggcggcctgggcagcggcggcgagctgcaccccagaaccggcagactggtgagcctgagcgcctgcggcagaaccgccagaagacagcagcccggccaggagttcaaccacggcctggtgctgagcagagagcccctgagagacggcagagtgttcaccgtgagaatcgacagaaaggtgaacagctggagcggcagcatcgagatcggcgtgaccgccctggaccccagcgtgctggacttccccagcagcgccaccggcctgaagggcggcagctgggtggtgagcggctgcagcgtgctgagagacggcagaagcgtgctggaggagtacggccaggacctggaccagctgggcgagggcgacagagtgggcgtggagagaaccgtggccggcgagctgagactgtgggtgaacggcagagactgcggcgtggccgccaccggcctgccccccagagtgtgggccgtggtggacctgtacggcaagtgcacccagatcaccgtgctgccccccgagcccggcttcagcccccccacccccatccccaccccccccctggagcccctggcccccaccgaggacagcgccctggccgagcagggcaccagcgccgacgaggccttcatggtgagccccgcccaggccagacccgagaccttccccaacagcctggagagccacaacgacttcgccaacatggagctgagcgaggtggtgagcaacaccatcctgagcgcctacaacggcggcctgctgaacgtgaacctgagcagcccccccgccggcgagggcctgggcagcagcggcgccgccaccagccccatcctgaccagcaacgacgccctgctgttccacgagaagtgcggcaccctgatcaagctgagcaacaacaacaagaccgccgagagaagaagacccctggacgagttcaacaacggcgtggtgatgaccaacagacccctgagagacaacgagatgttcgagatcagaatcgacaagctggtggacaagtggagcggcagcatcgagatcggcgtgaccacccacaaccccaacagcctggagtaccccgccaccatgaccaacctgcagagcggcaccatcatgatgagcggctgcggcatcctgaccaacggcaagggcaccagaagagagtactgcgagttcagcctggacgagctgcaggagggcgaccacatcggcctgaccagaaagagcaacagcgccctgcacttcttcatcaacggcatcgaccagggcgtggccacccccctgaccccccccgtggtgtacggcgtggtggacctgtacggcatggccgtgaaggtgaccatcgtgcacaacaacaaccacagcgacagactgagaagaaacaacgccatcctgagagccctgagccccgagggcgccctgagaagagccgcccccgccgcccaggccgagcccgagagactgctgttccaccccaactgcggccagaaggccgccatcacccacgagggcagaaccgccctgagaccccacgccaccgacgacttcaaccacggcgtggtgctgagcagcagagccctgagagacggcgaggtgttccaggtgagaatcgacaagatggtggacaagtgggccggcagcatcgagatcggcgtgaccacccacaaccccgcctacctgcagctgcccagcaccatgaccaacctgagaagcggcacctggatgatgaccggcaacggcgtgatgcacaacggcaccaccatcctggacgagtacggccacaacctggacagactgaaggccggcgacaccgtgggcgtggtgagaagagaggacggcaccctgcacttcttcgtgaacggcatgacccagggccccgccgcctggaacgtgccccccggcgtgtacgccgtggtggacctgtacggccaggccgcccaggccaccatcgtggacgacgtggaggtggcccccgtgcccgagcccctgcccgagggcaacaaccaggtgagccccagcagccccagcagcggcgccggcggcagcgacctgagattccaccagctgcacggcagcaacgccgtgatcaccaacggcggcagaaccgccctgagacacaactgcagaagcgagttcaacgacgccatcgtgatcagcaacagagccctgagagacggcgagctgttcgagatcgtgatccagaagatggtggacagatggagcggcagcatcgaggccggcgtgaccgccatcagacccgaggacctggagttccccaacaccatgaccgacatcgactacgacacctggatgctgagcggcaccgccatcatgcaggacggcaacaccatgagaaacaactacggctgcgacctggacgccctgggcaccggcgccagaatcggcatgatgagaaccgccaagggcgacctgcactacttcatcaacggccaggaccagggcgccgcctgcagcggcctgccccccgaggtgtacgccgtggtggacctgtacggccagtgcgtgcaggtgagcatcaccaacgccaccggccccatggacaacagcctggccaccagcaacaccgccaccgagaagagcttccccctgcacagccccgtggccggcgtggcccacagattccacagcacctgcggcaagaacgtgaccctggaggaggacggcaccagagccgtgagagccgccggctacgcccacggcctggtgttcagcaccaaggagctgagagccgaggaggtgttcgaggtgaaggtggaggagctggacgagaagtgggccggcagcctgagactgggcctgaccaccctggcccccggcgagatgggccccggcgccggcggcggcggccccggcctgccccccagcctgcccgagctgagaaccaagaccacctggatggtgagcagctgcgaggtgagaagagacggccagctgcagagaatgaactacggcagaaacctggagagactgggcgtgggcagcagagtgggcgtgagaagaggcgccgacgacaccatgcacatcctggtggacggcgaggacatgggccccgccgccaccggcatcgccaagaacgtgtgggccgtgctggacctgtacggccccgtgagaggcgtgagcatcgtgagcagcaccagactggaggagagcgagggcacccagccccccagccccagcagcgacaccggcagcgagggcgaggaggacgacgagggcgaggagcacggcctgggcggccagaacgaggtgggcatcatccccaccaccctggagttcctggagaaccacggcaagaacatcctgctgagcaacggcaacagaaccgccaccagagtggccagctacaaccagggcatcgtggtgatcaaccagcccctggtgccccagctgctggtgcaggtgagaatcgacttcctgaacagacagtggaccagcagcctggtgctgggcgtgatcacctgcgcccccgagagactgaacttccccgccagcgcctgcgccctgaagagagccgcctggctgctgagaggcagaggcgtgttccacaacggcctgaagatctgcgagaagttcggccccaacctggacacctgccccgagggcaccatcctgggcctgagactggacagcagcggcggcctgcacctgcacgtgaacggcgtggaccagggcgtggccgtgcccgacgtgccccagccctgccacgccctggtggacctgtacggccagtgcgagcaggtgaccatcgtgaaccccgagcccggcgccgccagcggcaagagcgccggcacccagggcgacatggagaaggccgacatggtggacggcatcaaggagagcgtgtgctggggccccccccccgccgccagccccctgaagagctgcgagtaccacgccctgtgcagcagattccaggagctgctgctgctgcccgaggactacttcatgcccccccccaagagaagcctgtgctactgcgagagctgcagaaagctgagaggcgacgaggcccacagaagaagaggcgagccccccagagagtacgccctgcccttcggctggtgcagattcaacctgagagtgaaccccagactggaggccggcaccctgaccaagaagtggcacatggcctaccacggcagcaacgtggccgccgtgagaagagtgctggacagaggcgagctgggcgccggcaccgccagcatcctgagctgcagacccctgaagggcgagcccggcgtgggcttcgaggagcccggcgagaactgcgccccccccagagaggagcagcccccccccgtgctgctgagccccagcctgcagtacgccggcgccgagaccctggccagcaaggtgcagttcagagaccccaagagccagagaacccaccaggcccaggtggccttccaggtgtgcgtgagacccggcagctacacccccggcccccccagcgccgccctgggcgagccccccgacccccacttcagccccgccgagctggagtgggtgaccaaggagaagggcgccaccctgctgtgcgccctgctggtgagagtggagtag

SEQ ID NO: 22730 - DNA, 4689 bp, Artificial Sequence
  Description of Artificial Sequence: Synthetic coding sequence
atggccgccggcagcggcggcagcggcggcagcggcggcggccccggccccggccccggcggcggcggcggccccagcggcagcggcagcggccccggcagcaacggcggcctgggcagcggcggcgagctgcaccccagaaccggcagactggtgagcctgagcgcctgcggcagaaccgccagaagacagcagcccggccaggagttcaaccacggcctggtgctgagcagagagcccctgagagacggcagagtgttcaccgtgagaatcgacagaaaggtgaacagctggagcggcagcatcgagatcggcgtgaccgccctggaccccagcgtgctggacttccccagcagcgccaccggcctgaagggcggcagctgggtggtgagcggctgcagcgtgctgagagacggcagaagcgtgctggaggagtacggccaggacctggaccagctgggcgagggcgacagagtgggcgtggagagaaccgtggccggcgagctgagactgtgggtgaacggcagagactgcggcgtggccgccaccggcctgccccccagagtgtgggccgtggtggacctgtacggcaagtgcacccagatcaccgtgctgccccccgagcccggcttcagcccccccacccccatccccaccccccccctggagcccctggcccccaccgaggacagcgccctggccgagcagggcaccagcgccgacgaggccttcatggtgagccccgcccaggccagacccgagaccttccccaacagcctggagagccacaacgacttcgccaacatggagctgagcgaggtggtgagcaacaccatcctgagcgcctacaacggcggcctgctgaacgtgaacctgagcagcccccccgccggcgagggcctgggcagcagcggcgccgccaccagccccatcctgaccagcaacgacgccctgctgttccacgagaagtgcggcaccctgatcaagctgagcaacaacaacaagaccgccgagagaagaagacccctggacgagttcaacaacggcgtggtgatgaccaacagacccctgagagacaacgagatgttcgagatcagaatcgacaagctggtggacaagtggagcggcagcatcgagatcggcgtgaccacccacaaccccaacagcctggagtaccccgccaccatgaccaacctgcagagcggcaccatcatgatgagcggctgcggcatcctgaccaacggcaagggcaccagaagagagtactgcgagttcagcctggacgagctgcaggagggcgaccacatcggcctgaccagaaagagcaacagcgccctgcacttcttcatcaacggcatcgaccagggcgtggccacccccctgaccccccccgtggtgtacggcgtggtggacctgtacggcatggccgtgaaggtgaccatcgtgcacaacaacaaccacagcgacagactgagaagaaacaacgccatcctgagagccctgagccccgagggcgccctgagaagagccgcccccgccgcccaggccgagcccgagagactgctgttccaccccaactgcggccagaaggccgccatcacccacgagggcagaaccgccctgagaccccacgccaccgacgacttcaaccacggcgtggtgctgagcagcagagccctgagagacggcgaggtgttccaggtgagaatcgacaagatggtggacaagtgggccggcagcatcgagatcggcgtgaccacccacaaccccgcctacctgcagctgcccagcaccatgaccaacctgagaagcggcacctggatgatgaccggcaacggcgtgatgcacaacggcaccaccatcctggacgagtacggccacaacctggacagactgaaggccggcgacaccgtgggcgtggtgagaagagaggacggcaccctgcacttcttcgtgaacggcatgacccagggccccgccgcctggaacgtgccccccggcgtgtacgccgtggtggacctgtacggccaggccgcccaggccaccatcgtggacgacgtggaggtggcccccgtgcccgagcccctgcccgagggcaacaaccaggtgagccccagcagccccagcagcggcgccggcggcagcgacctgagattccaccagctgcacggcagcaacgccgtgatcaccaacggcggcagaaccgccctgagacacaactgcagaagcgagttcaacgacgccatcgtgatcagcaacagagccctgagagacggcgagctgttcgagatcgtgatccagaagatggtggacagatggagcggcagcatcgaggccggcgtgaccgccatcagacccgaggacctggagttccccaacaccatgaccgacatcgactacgacacctggatgctgagcggcaccgccatcatgcaggacggcaacaccatgagaaacaactacggctgcgacctggacgccctgggcaccggcgccagaatcggcatgatgagaaccgccaagggcgacctgcactacttcatcaacggccaggaccagggcgccgcctgcagcggcctgccccccggcaaggaggtgtacgccgtggtggacctgtacggccagtgcgtgcaggtgagcatcaccaacgccaccggccccatggacaacagcctggccaccagcaacaccgccaccgagaagagcttccccctgcacagccccgtggccggcgtggcccacagattccacagcacctgcggcaagaacgtgaccctggaggaggacggcaccagagccgtgagagccgccggctacgcccacggcctggtgttcagcaccaaggagctgagagccgaggaggtgttcgaggtgaaggtggaggagctggacgagaagtgggccggcagcctgagactgggcctgaccaccctggcccccggcgagatgggccccggcgccggcggcggcggccccggcctgccccccagcctgcccgagctgagaaccaagaccacctggatggtgagcagctgcgaggtgagaagagacggccagctgcagagaatgaactacggcagaaacctggagagactgggcgtgggcagcagagtgggcgtgagaagaggcgccgacgacaccatgcacatcctggtggacggcgaggacatgggccccgccgccaccggcatcgccaagaacgtgtgggccgtgctggacctgtacggccccgtgagaggcgtgagcatcgtgagcagcaccagactggaggagagcgagggcacccagccccccagccccagcagcgacaccggcagcgagggcgaggaggacgacgagggcgaggagcacggcctgggcggccagaacgaggtgggcatcatccccaccaccctggagttcctggagaaccacggcaagaacatcctgctgagcaacggcaacagaaccgccaccagagtggccagctacaaccagggcatcgtggtgatcaaccagcccctggtgccccagctgctggtgcaggtgagaatcgacttcctgaacagacagtggaccagcagcctggtgctgggcgtgatcacctgcgcccccgagagactgaacttccccgccagcgcctgcgccctgaagagagccgcctggctgctgagaggcagaggcgtgttccacaacggcctgaagatctgcgagaagttcggccccaacctggacacctgccccgagggcaccatcctgggcctgagactggacagcagcggcggcctgcacctgcacgtgaacggcgtggaccagggcgtggccgtgcccgacgtgccccagccctgccacgccctggtggacctgtacggccagtgcgagcaggtgaccatcgtgaaccccgagcccggcgccgccagcggcaagagcgccggcacccagggcgacatggagaaggccgacatggtggacggcatcaaggagagcgtgtgctggggccccccccccgccgccagccccctgaagagctgcgagtaccacgccctgtgcagcagattccaggagctgctgctgctgcccgaggactacttcatgcccccccccaagagaagcctgtgctactgcgagagctgcagaaagctgagaggcgacgaggcccacagaagaagaggcgagccccccagagagtacgccctgcccttcggctggtgcagattcaacctgagagtgaaccccagactggaggccggcaccctgaccaagaagtggcacatggcctaccacggcagcaacgtggccgccgtgagaagagtgctggacagaggcgagctgggcgccggcaccgccagcatcctgagctgcagacccctgaagggcgagcccggcgtgggcttcgaggagcccggcgagaactgcgccccccccagagaggagcagcccccccccgtgctgctgagccccagcctgcagtacgccggcgccgagaccctggccagcaaggtgcagttcagagaccccaagagccagagaacccaccaggcccaggtggccttccaggtgtgcgtgagacccggcagctacacccccggcccccccagcgccgccctgggcgagccccccgacccccacttcagccccgccgagctggagtgggtgaccaaggagaagggcgccaccctgctgtgcgccctgctggtgagagtggagtag

SEQ ID NO: 22731 - DNA, 2760 bp, Artificial Sequence
  Description of Artificial Sequence: Synthetic coding sequence
atggtgaagcagaacaacatcatccccggcgagacccagatcctgctgagattcaccggctgggagagcaaggtgaacgccaagaagcagctgcccgtgggcatcaagtgcgagcccatggaccaggtgcccgacagcaccagcagcgccaccaacgtgagcatggtggtgagcgccggcccctggagcagcgagaaggccgagatgaacatcctggagatcaacgagaagctgagaccccagctggccgagaacaagcagcagttcagaaacctgaaggagagatgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcatccagccccacaagaacatcaagatcaccttcgaggaggacaaggtgaacagcagcctggtggtggacagagagagcagccacgacggctgccaggacgccctgaacatcctgcccgtgcccggccccaccagcagcgccaccaacgtgagcatggtggtgagcgccggccccctgagcagcgagaaggccgagatgaacatcctggagatcaacgagaagctgtgcccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagagactggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcgccgcctgctag

SEQ ID NO: 22732 - DNA, 2373 bp, Artificial Sequence
  Description of Artificial Sequence: Synthetic coding sequence
atgttcagcaacagcaccggcagactgcccggccagcccacccaggagatccagcagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcatccagccccacaagaacatcaagatcaccttcgaggaggacaaggtgaacagcagcctggtggtggacagagagagcagccacgacggctgccaggacgccctgaacatcctgcccgtgcccggccccaccagcagcgccaccaacgtgagcatggtggtgagcgccggccccctgagcagcgagaaggccgagatgaacatcctggagatcaacgagaagctgtgcccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagagactggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcgccgcctgctag

SEQ ID NO: 22733 - DNA, 1101 bp, Artificial Sequence
  Description of Artificial Sequence: Synthetic coding sequence
ctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctgtgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagcgtgctgatggaggtggaggtgcccgaggtgctgcaggacagcctggacagatactacagcacccccagcatgtacttcgagctgcccgacagcttccagcactacagaagcgtgttctacagcttcgaggagcagcacatcagcttcgccctggacatggacaacagattcttcaccctgaccgtgagaagcctgcacctggtgttccagatgggcgtgatcttcccccagtag

SEQ ID NO: 22734 - DNA, 2517 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcagaaacctgaaggagagatgcttcctgacccagctggccggcttcctggccaacagacacaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcatccagccccacaagaacatcaagatcaccttcgaggaggacaaggtgaacagcagcctggtggtggacagagagagcagccacgacggctgccaggacgccctgaacatcctgcccgtgcccggccccaccagcagcgccaccaacgtgagcatggtggtgagcgccggccccctgagcagcgagaaggccgagatgaacatcctggagatcaacgagaagctgtgcccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagcccaagagccacctgagaaagaccaagagcacccagctgagcctggcccaccccctgatgctgaacggcagaatgctgtacaccctgagccagaagatgaaggtgatgatgagaaagagaaagaagaagggccagtgcctgcccggcatctgcagaagcctgaagagaagaaagagccccagaagccccggcatgaaggtgatcagactgagccagttcctgctgaagggccacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcgccgcctgctag

SEQ ID NO: 22735 - DNA, 258 bp, Artificial Sequence
  Description of Artificial Sequence: Synthetic coding sequence
gagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagcccctag

SEQ ID NO: 22736 - DNA, 3570 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggacctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaaccacccctacaacgacagcagcctgagaaaccaccccgacatgtacagcgccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgagggcagccccctggccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22737 - DNA, 3774 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccaacccccagcacagactgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgagggcagccccgtgatgagcccccccaccctgccccccaccaccgtgggcgccaccggcgccgtgagcagcaccgacgccaccgccatcgccgccaccaccgaggccaccaccgtgcccatcatccccaccgtggcccccaccaccatcgccaccaccaccaccgtggccaccaccaccaccaccaccgccgccgccaccaccaccaccgagagcccccccaccaccaccagcggcaccaagatccacgagagcgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22738 - DNA, 3675 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccaacccccagcacagactgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgagggcaaccacaccaagaagaccgtgcccgtgaaggcccaggcccagcccatccagctgaccgacctgtaccccggcatgacctacaccctgagagtgtacagcagagacaacgagggcatcagcagcaccgtgatcaccttcatgaccagcaccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22739 - DNA, 3723 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccagcatccagaacgagctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggacctgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgaggccacccccaccgccgccccccccaccctgccccccaccaccgtgggcgccaccggcgccgtgagcagcaccgacgccaccgccatcgccgccaccaccgaggccaccaccgtgcccatcatccccaccgtggcccccaccaccatcgccaccaccaccaccgtggccaccaccaccaccaccaccgccgccgccaccaccaccaccgagagcccccccaccaccaccagcggcaccaagatccacgagagcgcccccgacgagcagagcatctggaacgtgaccgtgctgcccaacagcaagtgggccaacatcacctggaagcacaacttcggccccggcaccgacttcgtggtggagtacatcgacagcaaccacaccaagaagaccgtgcccgtgaaggcccaggcccagcccatccagctgaccgacctgtaccccggcatgacctacaccctgagagtgtacagcagagacaacgagggcatcagcagcaccgtgatcaccttcatgaccagcaccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22740 - DNA, 3510 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggacctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaaccacccctacaacgacagcagcctgagaaaccaccccgacatgtacagcgccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctgggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgaggcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22741 - DNA, 3216 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccaacccccagcacagactgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggacctgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgagggcagccccgtgatgagctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22742 - DNA, 3807 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccaacccccagcacagactgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgagggcagccccgtgatgagccccgacgagcagagcatctggaacgtgaccgtgctgcccaacagcaagtgggccaacatcacctggaagcacaacttcggccccggcaccgacttcgtggtggagtacatcgacagcaaccacaccaagaagaccgtgcccgtgaaggcccaggcccagcccatccagctgaccgacctgtaccccggcatgacctacaccctgagagtgtacagcagagacaacgagggcatcagcagcaccgtgatcaccttcatgaccagcaccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22743 - DNA, 3999 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggacctgagcatcgagaccaccgtgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctgggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgagggcagatgcatggccgccgcccccggcgtgaagggccccagcgtgggcgccaccggcgccgtgagcagcaccgacgccaccgccatcgccgccaccaccgaggccaccaccgtgcccatcatccccaccgtggcccccaccaccatcgccaccaccaccaccgtggccaccaccaccaccaccaccgccgccgccaccaccaccaccgagagcccccccaccaccaccagcggcaccaagatccacgagagcgcccccgacgagcagagcatctggaacgtgaccgtgctgcccaacagcaagtgggccaacatcacctggaagcacaacttcggccccggcaccgacttcgtggtggagtacatcgacagcaaccacaccaagaagaccgtgcccgtgaaggcccaggcccagcccatccagctgaccgacctgtaccccggcatgacctacaccctgagagtgtacagcagagacaacgagggcatcagcagcaccgtgatcaccttcatgaccagcaccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22744 - DNA, 4044 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccaacccccagcacagactgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgagggcagccccgtgatgagcccccccaccctgccccccaccaccgtgggcgccaccggcgccgtgagcagcaccgacgccaccgccatcgccgccaccaccgaggccaccaccgtgcccatcatccccaccgtggcccccaccaccatcgccaccaccaccaccgtggccaccaccaccaccaccaccgccgccgccaccaccaccaccgagagcccccccaccaccaccagcggcaccaagatccacgagagcgcccccgacgagcagagcatctggaacgtgaccgtgctgcccaacagcaagtgggccaacatcacctggaagcacaacttcggccccggcaccgacttcgtggtggagtacatcgacagcaaccacaccaagaagaccgtgcccgtgaaggcccaggcccagcccatccagctgaccgacctgtaccccggcatgacctacaccctgagagtgtacagcagagacaacgagggcatcagcagcaccgtgatcaccttcatgaccagcaccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22745 - DNA, 3723 bp, Artificial Sequence; identical to SEQ ID NO: 22739
  Description of Artificial Sequence: Synthetic coding sequence

SEQ ID NO: 22746 - DNA, 1860 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccagcatccagaacgagctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctgggcaactgcccctgcagcccctggcactag

SEQ ID NO: 22747 - DNA, 3525 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggacctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaaccacccctacaacgacagcagcctgagaaaccaccccgacatgtacagcgccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctgggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgaggccacccccaccgccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22748 - DNA, 3498 bp, Artificial Sequence
  Description of Artificial Sequence: Synthetic coding sequence
atcgagatccccatggacctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaaccacccctacaacgacagcagcctgagaaaccaccccgacatgtacagcgccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagaatcaccaacgtgagcgaggaggacagcggcgagtacttctgcctggccagcaacaagatgggcagcatcagacacaccatcagcgtgagagtgaaggccgccccctactggctggacgagcccaagaacctgatcctggcccccggcgaggacggcagactggtgtgcagagccaacggcaaccccaagcccaccgtgcagtggatggtgaacggcgagcccctgcagagcgccccccccaaccccaacagagaggtggccggcgacaccatcatcttcagagacacccagatcagcagcagagccgtgtaccagtgcaacaccagcaacgagcacggctacctgctggccaacgccttcgtgagcgtgctggacgtgccccccagaatgctgagccccagaaaccagctgatcagagtgatcctgtacaacagaaccagactggactgccccttcttcggcagccccatccccaccctgagatggttcaagaacggccagggcagcaacctggacggcggcaactaccacgtgtacgagaacggcagcctggagatcaagatgatcagaaaggaggaccagggcatctacacctgcgtggccaccaacatcctgggcaaggccgagaaccaggtgagactggaggtgaaggaccccaccagaatctacagaatgcccgaggaccaggtggccagaagaggcaccaccgtgcagctggagtgcagagtgaagcacgaccccagcctgaagctgaccgtgagctggctgaaggacgacgagcccctgtacatcggcaacagaatgaagaaggaggacgacagcctgaccatcttcggcgtggccgagagagaccagggcagctacacctgcgtggccagcaccgagctggaccaggacctggccaaggcctacctgaccgtgctggccgaccaggccacccccaccaacagactggccgccctgcccaagggcagacccgacagacccagagacctggagctgaccgacctggccgagagaagcgtgagactgacctggatccccggcgacgccaacaacagccccatcaccgactacgtggtgcagttcgaggaggaccagttccagcccggcgtgtggcacgaccacagcaagtaccccggcagcgtgaacagcgccgtgctgagactgagcccctacgtgaactaccagttcagagtgatcgccatcaacgaggtgggcagcagccaccccagcctgcccagcgagagatacagaaccagcggcgccccccccgagagcaaccccggcgacgtgaagggcgagggcaccagaaagaacaacatggagatcacctggacccccatgaacgccaccagcgccttcggccccaacctgagatacatcgtgaagtggagaagaagagagaccagagaggcctggaacaacgtgaccgtgtggggcagcagatacgtggtgggccagacccccgtgtacgtgccctacgagatcagagtgcaggccgagaacgacttcggcaagggccccgagcccgagagcgtgatcggctacagcggcgaggactaccccagagccgcccccaccgaggtgaaggtgagagtgatgaacagcaccgccatcagcctgcagtggaacagagtgtacagcgacaccgtgcagggccagctgagagagtacagagcctactactggagagagagcagcctgctgaagaacctgtgggtgagccagaagagacagcaggccagcttccccggcgacagactgagaggcgtggtgagcagactgttcccctacagcaactacaagctggagatggtggtggtgaacggcagaggcgacggccccagaagcgagaccaaggagttcaccacccccgagggcgtgcccagcgcccccagaagattcagagtgagacagcccaacctggagaccatcaacctggagtgggaccaccccgagcaccccaacggcatcatgatcggctacaccctgaagtacgtggccttcaacggcaccaaggtgggcaagcagatcgtggagaacttcagccccaaccagaccaagttcaccgtgcagagaaccgaccccgtgagcagatacagattcaccctgagcgccagaacccaggtgggcagcggcgaggccgtgaccgaggagagccccgccccccccaacgaggccacccccaccgccgcctacaccaacaaccaggccgacatcgccacccagggctggttcatcggcctgatgtgcgccatcgccctgctggtgctgatcctgctgatcgtgtgcttcatcaagagaagcagaggcggcaagtaccccgtgagagagaagaaggacgtgcccctgggccccgaggaccccaaggaggaggacggcagcttcgactacagcgacgaggacaacaagcccctgcagggcagccagaccagcctggacggcaccatcaagcagcaggagagcgacgacagcctggtggactacggcgagggcggcgagggccagttcaacgaggacggcagcttcatcggccagtacaccgtgaagaaggacaaggaggagaccgagggcaacgagagcagcgaggccaccagccccgtgaacgccatctacagcctggcctag

SEQ ID NO: 22749 - DNA, 909 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccagcatccagaacgagctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagcaacagaatcagactgcaggtgagcaagagccccctgtggcccaaggagaacctggaccccgtggtggtgcaggagggcgcccccctgaccctgcagtgcaaccccccccccggcctgcccagccccgtgatcttctggatgagcagcagcatggagcccatcacccaggacaagagagtgagccagggccacaacggcgacctgtacttcagcaacgtgatgctgcaggacatgcagaccgactacagctgcaacgccagattccacttcacccacaccatccagcagaagaaccccttcaccctgaaggtgctgaccaccagaggcgtggccgagagaacccccagcttcatgtacccccagggcaccgccagcagccagatggtgctgagaggcatggacctgctgctggagtgcatcgccagcggcgtgcccacccccgacatcgcctggtacaagaagggcggcgacctgcccagcgacaaggccaagttcgagaacttcaacaaggccctgagatag

SEQ ID NO: 22750 - DNA, 390 bp, Artificial Sequence
  Description of Artificial Sequence: Synthetic coding sequence
atggccagacagcccccccccccctgggtgcacgccgccttcctgctgtgcctgctgagcctgggcggcgccatcgagatccccatggaccccagcatccagaacgagctgacccagccccccaccatcaccaagcagagcgccaaggaccacatcgtggaccccagagacaacatcctgatcgagtgcgaggccaagggcaaccccgcccccagcttccactggaccagaaacagcagattcttcaacatcgccaaggaccccagagtgagcatgagaagaagaagcggcaccctggtgatcgacttcagaagcggcggcagacccgaggagtacgagggcgagtaccagtgcttcgccagaaacaagttcggcaccgccctgagctag

SEQ ID NO: 22751 - DNA, 3510 bp, Artificial Sequence; identical to SEQ ID NO: 22740
  Description of Artificial Sequence: Synthetic coding sequence

SEQ ID NO: 22752 - DNA, 3525 bp, Artificial Sequence; identical to SEQ ID NO: 22747
  Description of Artificial Sequence: Synthetic coding sequence

SEQ ID NO: 22753 - DNA, 1503 bp, Artificial Sequence
  Description of Artificial Sequence: Synthetic coding sequence
ctgaagttcctggccgtgctgctggccgccggcatgctggccttcctgggcgccgtgatctgcatcatcgccagcgtgcccctggccgccagccccgccagagccctgcccggcggcgccgacaacgccagcgtggccagcggcgccgccgccagccccggcccccagagaagcctgagcgccctgcacggcgccggcggcagcgccggcccccccgccctgcccggcgcccccgccgccagcgcccaccccctgccccccggccccctgttcagcagattcctgtgcacccccctggccgccgcctgccccagcggcgcccagcagggcgacgccgccggcgccgcccccggcgagagagaggagctgctgctgctgcagagcaccgccgagcagctgagacagaccgccctgcagcaggaggccagaatcagagccgaccaggacaccatcagagagctgaccggcaagctgggcagatgcgagagcggcctgcccagaggcctgcagggcgccggccccagaagagacaccatggccgacggcccctgggacagccccgccctgatcctggagctggaggacgccgtgagagccctgagagacagaatcgacagactggagcaggagctgcccgccagagtgaacctgagcgccgcccccgcccccgtgagcgccgtgcccaccggcctgcacagcaagatggaccagctggagggccagctgctggcccaggtgctggccctggagaaggagagagtggccctgagccacagcagcagaagacagagacaggaggtggagaaggagctggacgtgctgcagggcagagtggccgagctggagcacggcagcagcgcctacagcccccccgacgccttcaagatcagcatccccatcagaaacaactacatgtacgccagagtgagaaaggccctgcccgagctgtacgccttcaccgcctgcatgtggctgagaagcagaagcagcggcaccggccagggcacccccttcagctacagcgtgcccggccaggccaacgagatcgtgctgctggaggccggccacgagcccatggagctgctgatcaacgacaaggtggcccagctgcccctgagcctgaaggacaacggctggcaccacatctgcatcgcctggaccaccagagacggcctgtggagcgcctaccaggacggcgagctgcagggcagcggcgagaacctggccgcctggcaccccatcaagccccacggcatcctgatcctgggccaggagcaggacaccctgggcggcagattcgacgccacccaggccttcgtgggcgacatcgcccagttcaacctgtgggaccacgccctgacccccgcccaggtgctgggcatcgccaactgcaccgcccccctgctgggcaacgtgctgccctgggaggacaagctggtggaggccttcggcggcgccaccaaggccgccttcgacgtgtgcaagggcagagccaaggcctag

SEQ ID NO: 22754 - DNA, 2526 bp, Artificial Sequence
  Description of Artificial Sequence: Synthetic coding sequence
atgaacctgctgtacagaaagaccaagctggagtggagacagcacaaggaggaggaggccaagagaagcagcagcaaggaggtggcccccgccggcagcgccggccccgccgccggccagggccccggcgtgagagtgagagacatcgccagcctgagaagaagcctgagaatgggcttcatgaccatgcccgccagccaggagcacaccccccacccctgcagaagcgccatggcccccagaagcctgagctgccacagcgtgggcagcatggacagcgtgggcggcggccccggcggcgccagcggcggcctgaccgaggacagcagcaccagaagaccccccgccaagcccagaagacaccccagcaccaagctgagcatggtgggccccggcagcggcgccgagaccccccccagcaagaaggccggcagccagaagcccacccccgagggcagagagagcagcagaaaggtgcccccccagaagcccagaagaagccccaacacccagctgagcgtgagcttcgacgagagctgcccccccggccccagccccagaggcggcaacctgcccctgcagagactgaccagaggcagcagagtggccggcgaccccgacgtgggcgcccaggaggagcccgtgtacatcgagatggtgggcgacgtgttcagaggcggcggcagaagcggcggcggcctggccggcccccccctgggcggcggcggccccaccccccccgccggcgccgacagcgacagcgaggagagcgaggccatctacgaggagatgaagtaccccctgcccgaggaggccggcgagggcagagccaacggccccccccccctgaccgccaccagccccccccagcagccccacgccctgcccccccacgcccacagaagacccgccagcgccctgcccagcagaagagacggcacccccaccaagaccaccccctgcgagatccccccccccttccccaacctgctgcagcacagaccccccctgctggccttcccccaggccaagagcgccagcagaacccccggcgacggcgtgagcagactgcccgtgctgtgccacagcaaggagcccgccggcagcacccccgccccccaggtgcccgccagagagagagagaccccccccccccccccccccccccccgccgccaacctgctgctgctgggccccagcggcagagccagaagccacagcacccccctgcccccccagggcagcggccagcccagaggcgagagagagctgcccaacagccacagcatgatctgccccaaggccgccggcgcccccgccgccccccccgcccccgccgccctgctgcccggcccccccaaggacaaggccgtgagctacaccatggtgtacagcgccgtgaaggtgaccacccacagcgtgctgcccgccggcccccccctgggcgccggcgagcccaagaccgagaaggagatcagcgtgctgcacggcatgctgtgcaccagcagcagaccccccgtgcccggcaagaccagcccccacggcggcgccatgggcgccgccgccggcgtgctgcaccacagaggctgcctggccagcccccacagcctgcccgaccccaccgtgggccccctgacccccctgtggacctaccccgccaccgccgccggcctgaagagaccccccgcctacgagagcctgaaggccggcggcgtgctgaacaagggctgcggcgtgggcgcccccagccccatggtgaagatccagctgcaggagcagggcaccgacggcggcgccttcgccagcatcagctgcgcccacgtgatcgccagcgccggcacccccgaggaggaggaggaggaggtgggcgccgccaccttcggcgccggctgggccctgcagagaaaggtgctgtacggcggcagaaaggccaaggagctggacaaggtggaggacggcgccagagcctggaacggcagcgccgagggccccggcaaggtggagagagaggacagaggccccggcaccagcggcatccccgtgagaagccagggcgccgagggcctgctggccagaatccaccacggcgacagaggcggcagcagaaccgccctgcccatcccctgccagaccttccccgcctgccacagaaacggcgacttcaccggcggctacagactgggcagaagcgccagcaccagcggcgtgagacaggtggtgctgcacacccccagaccctgcagccagcccagagacgccctgagccagccccaccccgccctgcccctgcccctgcccctgcccccccagcccgccagagagagagacggcaagctgctggaggtgatcgagagaaagagatgcgtgtgcaaggagatcaaggccagacacagacccgacagaggcctgtgcaagcaggagagcatgcccatcctgcccagctggagaagaggccccgagcccagaaagagcggcacccccccctgcagaagacagcacaccgtgctgtgggacaccgccatctag

SEQ ID NO: 22755 - DNA, 2529 bp, Artificial Sequence
  Description of Artificial Sequence: Synthetic coding sequence
atgaacctgctgtacagaaagaccaagctggagtggagacagcacaaggaggaggaggccaagagaagcagcagcaaggaggtggcccccgccggcagcgccggccccgccgccggccagggccccggcgtgagagtgagagacatcgccagcctgagaagaagcctgagaatgggcttcatgaccatgcccgccagccaggagcacaccccccacccctgcagaagcgccatggcccccagaagcctgagctgccacagcgtgggcagcatggacagcgtgggcggcggccccggcggcgccagcggcggcctgaccgaggacagcagcaccagaagaccccccgccaagcccagaagacaccccagcaccaagctgagcatggtgggccccggcagcggcgccgagaccccccccagcaagaaggccggcagccagaagcccacccccgagggcagagagagcagcagaaaggtgcccccccagaagcccagaagaagccccaacacccagctgagcgtgagcttcgacgagagctgcccccccggccccagccccagaggcggcaacctgcccctgcagagactgaccagaggcagcagagtggccggcgaccccgacgtgggcgcccaggaggagcccgtgtacatcgagatggtgggcgacgtgttcagaggcggcggcagaagcggcggcggcctggccggcccccccctgggcggcggcggccccaccccccccgccggcgccgacagcgacagcgaggagagcgaggccatctacgaggagatgaagtaccccctgcccgaggaggccggcgagggcagagccaacggccccccccccctgaccgccaccagccccccccagcagccccacgccctgcccccccacgcccacagaagacccgccagcgccctgcccagcagaagagacggcacccccaccaagaccaccccctgcgagatccccccccccttccccaacctgctgcagcacagaccccccctgctggccttcccccaggccaagagcgccagcagaacccccggcgacggcgtgagcagactgcccgtgctgtgccacagcaaggagcccgccggcagcacccccgccccccaggtgcccgccagagagagagagaccccccccccccccccccccccccccgccgccaacctgctgctgctgggccccagcggcagagccagaagccacagcacccccctgcccccccagggcagcggccagcccagaggcgagagagagctgcccaacagccacagcatgatctgccccaaggccgccggcgcccccgccgccccccccgcccccgccgccctgctgcccggcccccccaaggacaaggccgtgagctacaccatggtgtacagcgccgtgaaggtgaccacccacagcgtgctgcccgccggcccccccctgggcgccggcgagcccaagaccgagaaggagatcagcgtgctgcacggcatgctgtgcaccagcagcagaccccccgtgcccggcaagaccagcccccacggcggcgccatgggcgccgccgccggcgtgctgcaccacagaggctgcctggccagcccccacagcctgcccgaccccaccgtgggccccctgacccccctgtggacctaccccgccaccgccgccggcctgaagagaccccccgcctacgagagcctgaaggccggcggcgtgctgaacaagggctgcggcgtgggcgcccccagccccatggtgaagatccagctgcaggagcagggcaccgacggcggcgccttcgccagcatcagctgcgcccacgtgatcgccagcgccggcacccccgaggaggaggaggaggaggtgggcgccgccaccttcggcgccggctgggccctgcagagaaaggtgctgtacggcggcagaaaggccaaggagctggacaccgaggtggaggacggcgccagagcctggaacggcagcgccgagggccccggcaaggtggagagagaggacagaggccccggcaccagcggcatccccgtgagaagccagggcgccgagggcctgctggccagaatccaccacggcgacagaggcggcagcagaaccgccctgcccatcccctgccagaccttccccgcctgccacagaaacggcgacttcaccggcggctacagactgggcagaagcgccagcaccagcggcgtgagacaggtggtgctgcacacccccagaccctgcagccagcccagagacgccctgagccagccccaccccgccctgcccctgcccctgcccctgcccccccagcccgccagagagagagacggcaagctgctggaggtgatcgagagaaagagatgcgtgtgcaaggagatcaaggccagacacagacccgacagaggcctgtgcaagcaggagagcatgcccatcctgcccagctggagaagaggccccgagcccagaaagagcggcacccccccctgcagaagacagcacaccgtgctgtgggacaccgccatctag

SEQ ID NO: 22756 - DNA, 2358 bp, Artificial Sequence
  Description of Artificial Sequence: Synthetic coding sequence
atgggcttcatgaccatgcccgccagccaggagcacaccccccacccctgcagaagcgccatggcccccagaagcctgagctgccacagcgtgggcagcatggacagcgtgggcggcggccccggcggcgccagcggcggcctgaccgaggacagcagcaccagaagaccccccgccaagcccagaagacaccccagcaccaagctgagcatggtgggccccggcagcggcgccgagaccccccccagcaagaaggccggcagccagaagcccacccccgagggcagagagagcagcagaaaggtgcccccccagaagcccagaagaagccccaacacccagctgagcgtgagcttcgacgagagctgcccccccggccccagccccagaggcggcaacctgcccctgcagagactgaccagaggcagcagagtggccggcgaccccgacgtgggcgcccaggaggagcccgtgtacatcgagatggtgggcgacgtgttcagaggcggcggcagaagcggcggcggcctggccggcccccccctgggcggcggcggccccaccccccccgccggcgccgacagcgacagcgaggagagcgaggccatctacgaggagatgaagtaccccctgcccgaggaggccggcgagggcagagccaacggccccccccccctgaccgccaccagccccccccagcagccccacgccctgcccccccacgcccacagaagacccgccagcgccctgcccagcagaagagacggcacccccaccaagaccaccccctgcgagatccccccccccttccccaacctgctgcagcacagaccccccctgctggccttcccccaggccaagagcgccagcagaacccccggcgacggcgtgagcagactgcccgtgctgtgccacagcaaggagcccgccggcagcacccccgccccccaggtgcccgccagagagagagagaccccccccccccccccccccccccccgccgccaacctgctgctgctgggccccagcggcagagccagaagccacagcacccccctgcccccccagggcagcggccagcccagaggcgagagagagctgcccaacagccacagcatgatctgccccaaggccgccggcgcccccgccgccccccccgcccccgccgccctgctgcccggcccccccaaggacaaggccgtgagctacaccatggtgtacagcgccgtgaaggtgaccacccacagcgtgctgcccgccggcccccccctgggcgccggcgagcccaagaccgagaaggagatcagcgtgctgcacggcatgctgtgcaccagcagcagaccccccgtgcccggcaagaccagcccccacggcggcgccatgggcgccgccgccggcgtgctgcaccacagaggctgcctggccagcccccacagcctgcccgaccccaccgtgggccccctgacccccctgtggacctaccccgccaccgccgccggcctgaagagaccccccgcctacgagagcctgaaggccggcggcgtgctgaacaagggctgcggcgtgggcgcccccagccccatggtgaagatccagctgcaggagcagggcaccgacggcggcgccttcgccagcatcagctgcgcccacgtgatcgccagcgccggcacccccgaggaggaggaggaggaggtgggcgccgccaccttcggcgccggctgggccctgcagagaaaggtgctgtacggcggcagaaaggccaaggagctggacaccgaggtggaggacggcgccagagcctggaacggcagcgccgagggccccggcaaggtggagagagaggacagaggccccggcaccagcggcatccccgtgagaagccagggcgccgagggcctgctggccagaatccaccacggcgacagaggcggcagcagaaccgccctgcccatcccctgccagaccttccccgcctgccacagaaacggcgacttcaccggcggctacagactgggcagaagcgccagcaccagcggcgtgagacaggtggtgctgcacacccccagaccctgcagccagcccagagacgccctgagccagccccaccccgccctgcccctgcccctgcccctgcccccccagcccgccagagagagagacggcaagctgctggaggtgatcgagagaaagagatgcgtgtgcaaggagatcaaggccagacacagacccgacagaggcctgtgcaagcaggagagcatgcccatcctgcccagctggagaagaggccccgagcccagaaagagcggcacccccccctgcagaagacagcacaccgtgctgtgggacaccgccatctag

SEQ ID NO: 22757 - DNA, 1962 bp, Artificial Sequence
  Description of Artificial Sequence: Synthetic coding sequence
atgatcagcagcaagatgatgagcagcaaccccgaggaggaccccctggacaccttcctgcagtacatcgaggacatgggcatgaaggcctacgacggcctggtgatccagaacgccagcgacatcgccagagagaacgacagactgagaaacgagaccaacctggcctacctgaaggagaagaacgagaagagaagaagacaggaggaggccatcaagagaatcggcggcgaggtgggcagaggccacgagggcagctacgtgggcaagcacttcagaatgggcttcatgaccatgcccgccccccaggacagactgccccacccctgcagcagcggcttcagcgtgagaagccagagcctgcacagcgtgggcggcaccgacgacgacagcagctgcggcagcagaagacagcccccccccaagcccaagagagaccccagcaccaagctgagcaccagcagcgagaccgtgagcagcaccgccgccagcaagagcggcaagacccccgagagaaccgaggccagcgccaagcccagaccccacagcgacgagtacagcaagaagatccccccccccaagcccaagagaaaccccaacacccagctgagcaccagcttcgacgagacctacatcaagaagcacggccccagaagaaccagcctgcccagagacagcagcctgagccagatgggcagccccgccggcgaccccgaggaggaggagcccgtgtacatcgagatggtgggcaacatcctgagagacttcagaaaggaggacgacgaccagagcgaggccgtgtacgaggagatgaagtaccccatcttcgacgacctgggccaggacgccaagtgcgacttcgaccaccacagctgcagcagccagtgcgccacccccaccgtgcccgacctggacttcgccaaggccagcgtgccctgcccccccaagggcctgctgtgcgacatccccccccccttccccaacctgctgagccacagaccccccctgctggtgttcccccccgcccccgtgcactgcagccccaacagcgacgagagccccctgacccccctggaggtgaccaagctgcccgtgctggagaacgtgagctacatgaagcagcccgccggcgccagccccagcaccctgcccagccacgtgcccggccacgccaagctggagaaggagcaggccgccgccctgggccccgccagcgccacccccgccctgagcagcagcccccccccccccagcaccctgtacagaacccagagcccccacggctaccccaagagccacagcaccagccccagccccgtgagcatgggcagaagcctgacccccctgagcctgaagagaccccccccctacgacgccgtgcacagcggcagcctgagcagaagcagccccagcgtgccccacagcacccccagacccgtgagccaggacggcgccaagatggtgaacgccgccgtgaacacctacggcgccgcccccggcggcagcagaagcagaacccccaccagccccctggaggagctgaccagcctgttcagcagcggcagaagcctgctgagaaagagcagcagcggcagaagaagcaaggagcccgccgagaagagcaccgaggagctgaaggtgagaagccacagcaccgagcccctgcccaagctggacaacaaggagagaggccaccacggcgccagcagcagcagagagcccgtgaaggcccaggagtgggacggcacccccggcacccccgtggtgaccagcagactgggcagatgcagcgtgagccccaccctgctggccggcaaccacagcagcgagcccaaggtgagctgcaagctgggcagaagcgccagcaccagcggcgtgcccccccccagcgtgacccccctgagacagagcagcgacctgcagcagagccaggtgcccagcagcctggccaacagagactag

SEQ ID NO: 22758 - DNA, 435 bp, Artificial Sequence
  Description of Artificial Sequence: Synthetic coding sequence
atgatcagcagcaagatgatgagcagcaaccccgaggaggaccccctggacaccttcctgcagtacatcgaggacatgggcatgaaggcctacgacggcctggtgatccagaacgccagcgacatcgccagagagaacgacagactgagaaacgagaccaacctggcctacctgaaggagaagaacgagaagagaagaagacaggaggaggccatcaagagaatcaacagaggcaccgagagccccaagccccagcacggcgccatcaccaaggtgggccagcagggcaagagacccccctggggcgtgttcctgcagagagcctgccagagcagcggcatgggctggaacaccagagacacctgcggccaccagagcaccagaaagatgctgtgcgagccccacctggtgagcggcaagccccagttcagatag

SEQ ID NO: 22759 - DNA, 498 bp, Artificial Sequence
  Description of Artificial Sequence: Synthetic coding sequence
ctggcctggagacccggcgagagaggcgcccccgccagcagacccagactggccctgctgctgctgctgctgctgctgcccctgcccagcggcgcctggtacaagcacgtggccagccccagataccacaccgtgggcagagccgccggcctgctgatgggcctgagaagaagcccctacctgtggagaagagccctgagagccgccgccggccccctggccagagacaccctgagccccgagcccgccgccagagaggcccccctgctgctgcccagctgggtgcaggagctgtgggagaccagaagaagaagcagccaggccggcatccccgtgagagcccccagaagccccagagcccccgagcccgccctggagcccgagagcctggacttcagcggcgccggccagagactgagaagagacgtgagcagacccgccgtggaccccgccgccaacagactgggcctgccctgcctggcccccggccccttctag

SEQ ID NO: 22760 - DNA, 1260 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggacaaggccagcgtgaaggcccaggtgaccagcctgctgggcgagctgcaggagagccagagcagactggaggccgccaccaaggagtgccaggccctggagggcagagccagagccgccagcgagcaggccagacagctggagagcgagagagaggccctgcagcagcagcacagcgtgcaggtggaccagctgagaatgcagggccagagcgtggaggccgccctgagaatggagagacaggccgccagcgaggagaagagaaagctggcccagctgcaggtggcctaccaccagctgttccaggagtacgacaaccacatcaagagcagcgtggtgggcagcgagagaaagagaggcatgcagctggaggacctgaagcagcagctgcagcaggccgaggaggccctggtggccaagcaggaggtgatcgacaagctgaaggaggaggccgagcagcacaagatcgtgatggagaccgtgcccgtgctgaaggcccaggccgacatctacaaggccgacttccaggccgagagacaggccagagagaagctggccgagaagaaggagctgctgcaggagcagctggagcagctgcagagagagtacagcaagctgaaggccagctgccaggagagcgccagaatcgaggacatgagaaagagacacgtggaggtgagccaggcccccctgccccccgcccccgcctacctgagcagccccctggccctgcccagccagagaagaagcccccccgaggagccccccgacttctgctgccccaagtgccagtaccaggcccccgacatggacaccctgcagatccacgtgatggagtgcatcgagtag

SEQ ID NO: 22761 - DNA, 1209 bp, Artificial Sequence
  Description of Artificial Sequence: Synthetic coding sequence
atgccccccgtgagcagaagcagctacagcgaggacatcgtgggcagcagaagaagaagaagaagcagcagcggcagcccccccagcccccagagcagatgcagcagctgggacggctgcagcagaagccacagcagaggcagagagggcctgagacccccctggagcgagctggacgtgggcgccctgtaccccttcagcagaagcggcagcagaggcagactgcccagattcagaaactacgccttcgccagcagctggagcaccagctacagcggctacagataccacagacactgctacgccgaggagagacagagcgccgaggactacgagaaggaggagagccacagacagagaagactgaaggagagagagagaatcggcgagctgggcgcccccgaggtgtggggccccagccccaagttcccccagctggacagcgacgagcacacccccgtggaggacgaggaggaggtgacccaccagaagagcagcagcagcgacagcaacagcgaggagcacagaaagaagaagaccagcagaagcagaaacaagaagaagagaaagaacaagagcagcaagagaaagcacagaaagtacagcgacagcgacagcaacagcgagagcgacaccaacagcgacagcgacgacgacaagaagagagtgaaggccaagaagaagaagaagaagaagaagcacaagaccaagaagaagaagaacaagaagaccaagaaggagagcagcgacagcagctgcaaggacagcgaggaggacctgagcgaggccacctggatggagcagcccaacgtggccgacaccatggacctgatcggccccgaggcccccatcatccacaccagccaggacgagaagcccctgaagtacggccacgccctgctgcccggcgagggcgccgccatggccgagtacgtgaaggccggcaagagaatccccagaagaggcgagatcggcctgaccagcgaggagatcggcagcttcgagtgcagcggctacgtgatgagcggcagcagacacagaagaatggaggccgtgagactgagaaaggagaaccagatctacagcgccgacgagaagagagccctggccagcttcaaccaggaggagagaagaaagagagagagcaagatcctggccagcttcagagagatggtgcacaagaagaccaaggagaaggacgacaagtag

SEQ ID NO: 22762 - DNA, 576 bp, Artificial Sequence
  Description of Artificial Sequence: Synthetic coding sequence
atgggcaagagctgcaaggtggtggtgtgcggccaggccagcgtgggcaagaccagcatcctggagcagctgctgtacggcaaccacgtggtgggcagcgagatgatcgagacccaggaggacatctacgtgggcagcatcgagaccgacagaggcgtgagagagcaggtgagattctacgacaccagaggcctgagagacggcgccgagctgcccagacactgcttcagctgcaccgacggctacgtgctggtgtacagcaccgacagcagagagagcttccagagagtggagctgctgaagaaggagatcgacaagagcaaggacaagaaggaggtgaccatcgtggtgctgggcaacaagtgcgacctgcaggagcagagaagagtggaccccgacgtggcccagcactgggccaagagcgagaaggtgaagctgtgggaggtgagcgtggccgacagaagaagcctgctggagcccttcgtgtacctggccagcaagatgacccagccccagagcaagagcgccttccccctgagcagaaagaacaagggcagcggcagcctggacggctag

SEQ ID NO: 22763 - DNA, 2181 bp, Artificial Sequence
  Description of Artificial Sequence: Synthetic coding sequence
atggccgcccccggcggcagaggcagaagcctgagcggcctgctgcccgcccagaccagcctggagtacgccctgctggacgccgtgacccagcaggagaaggacagcctggtgtaccagtacctgcagaaggtggacggctgggagcaggacctgagcgtgcccgagttccccgagggcctggagtggctgaacaccgaggagcccatcagcgtgtacaaggacctgtgcggcaagatcgtggtgctggacttcttcacctactgctgcatcaactgcatccacctgctgcccgacctgcacgccctggagcacacctacagcgacaaggacggcctgctgatcatcggcgtgcacagcgccaagttccccaacgagaaggtgctggacaacatcaagagcgccgtgctgagatacaacatcacccaccccatggtgaacgacgccgacgccagcctgtggcaggagctggaggtgagctgctggcccaccctggtgatcctgggccccagaggcaacatgctgttcagcctgatcggcgagggccacaaggacaagctgttcctgtacaccagcatcgccctgaagtactacaaggacagaggccagatcagagacaacaagatcggcatcaagctgtacaaggacagcctgccccccagccccctgctgttccccggcaaggtgaccgtggaccaggtgaccgacagactggtgatcgccgacaccggccaccacagaatcctggtggtgtggaagaacggccagatccagtacagcatcggcggccccaaccccggcagaaaggacggcatcttcagcgagagcaccttcaacagcccccagggcgtggccatcatgaacaacatcatctacgtggccgacaccgagaaccacctgatcagaaagatcgacctggaggccgagaaggtgagcaccgtggccggcatcggcatccagggcaccgacaaggagggcggcgccaagggcgagcagcagcccatcagcagcccctgggacgtggtgttcggcaccagcggcagcgaggtgcagagaggcgacatcctgtggatcgccatggccggcacccaccagatctgggccctgctgctggacagcggcaagctgcccaagaagaacgagctgaccaagggcacctgcctgagattcgccggcagcggcaacgaggagaacagaaacaacgcctacccccacaaggccggcttcgcccagcccagcggcctgagcctggccagcgaggacccctggagctgcctgttcgtggccgacagcgagagcagcaccgtgagaaccgtgagcctgaaggacggcgccgtgaagcacctggtgggcggcgagagagaccccatgaacctgttcgccttcggcgacgtggacggcgtgggcatcaacgccaagctgcagcaccccctgggcgtgacctgggacaagaagagaaacctgctgtacgtggccgacagctacaaccacaagatcaaggtggtggaccccaagaccaagaactgcaccaccctggccggcaccggcgacaccaacaacgtgaccagcagcagcttcaccgagagcaccttcaacgagcccggcggcctgtgcatcggcgagaacggcgagctgctgtacgtggccgacaccaacaaccaccagatcaaggtgatggacctggagaccaagatggtgagcgtgctgcccatcttcagaagcgagaacgccgtggtggacggccccttcctggtggagaagcagaagaccctgcccaagctgcccaagagcgcccccagcatcagactgagccccgtgaccgcctgcgccggccagaccctgcagttcaagctgagactggacctgcccagcggcagcaagctgaccgagggcgtgagcagctgctggttcctgaccgccgagggcaacgagtggctgctgcagggccagatcgccgccggcgacatcgagaacatcagcagccagcccaccatcagcctgcagatccccgacgactgcctgagcctggaggccatcgtgagcgtgagcgtgttcctgtactactgcagcgccgacagcagcgcctgcatgatgaaggccatcctgttcagccagcccctgcagatcaccgacacccagcagggctgcatcgcccccgtggagctgagatacgtgttctag

SEQ ID NO: 22764 - DNA, 372 bp, Artificial Sequence
  Description of Artificial Sequence: Synthetic coding sequence
atgctgggcctggagggcccctgctgggtgggccccggccccgacggcggcctggccgtgagcgaggagttcggcgacgtgagactgttcggcagcgccagacagcccctgggcagcctgggcggctggaccggccacaccttcggctgccccgccggcatctgcagcaacagcgagggcaacgtgatcgtggccgacgagcagagaagacaggtgaccctgttccccagagccggcccccccatctgcctggtgagcgagggcctgggccagcccctgggcgtggcctgcgccccccagggccagctgctggtggccgacgccaaggacaacagcatcaaggtgtaccagggcctgaaggagctggcctag

SEQ ID NO: 22765 - DNA, 372 bp, Artificial Sequence; identical to SEQ ID NO: 22764
  Description of Artificial Sequence: Synthetic coding sequence

SEQ ID NO: 22766 - DNA, 4821 bp, Artificial Sequence
  Description of Artificial Sequence: Synthetic coding sequence
atggtggtgttcatcaacgccaagatcaagagcctgatcaagctgttcaagaagaagaccgtgagcaacctggacgaggagagcagatggaccgtgcactacaccgccccctggcaccagcaggagaacgtgttcctgcccaccaccagacccccctgcgtggaggacctgcacagacaggccaagctgaacctgaagagcgtgctgagagagtgcgacaagctgagacacgacggctacagaagcagccagtactacagccagggccccaccttcgccgccaacgccagccccttctgcgacgactaccaggacgaggacgaggagaccgaccagaagtgcagcctgagcagcagcgaggaggagagattcatcagcatcagaagacccaagacccccgccagcagcgacttcagcgacctgaacacccagaccaactggaccaagagcctgcccctgcccacccccgaggagaagatgagacagcaggcccagaccgtgcaggccgacgtggtgcccatcaacatcaccggcgagaacttcgacagacaggccagcctgagaagaagcctgatctacaccgacaccctggtgagaagacccaagaaggtgaagagaagaaagaccatcaccggcgtgcccgacaacatccagaaggagctggccagcggcaccggccaggacgacgccgacggccacagcgtgtacacccccgaccactacagcaccctgggcagattcaacagctgcagaagcgccggccagagaagcgagaccagagacagcagctgccagaccgaggacgtgaaggtggtgccccccagcatgagaagaatcagagcccagaagggccagggcatcgccgcccagatgggccacttcagcggcagcagcggcaacatgagcgtgctgagcgacagcgccggcatcgtgttccccagcagactggacagcgacgccggcttccacagcctgcccagaagcggcgccagagccaacatccagagcctggagcccagactgggcgccctgggccccgccggcgacatgaacggcaccttcctgtaccagagaggccacccccaggccgacgagaacctgggccacctgggcggcgccagcggcaccggcaccctgctgagacccaagagccaggagctgagacacttcgagagcgagaacatcatgagccccgcctgcgtggtgagcccccacgccacctacagcaccagcatcatccccaacgccaccctgagcagcagcagcgaggtgatcgccatccccaccgcccagagcgccggccagagagagagcaagagcagcggcagcagccacgccagaatcaagagcagagaccacctgatcagcagacacgccgtgaagggcgacccccagagccccggcagacactggaacgagggccacgccaccatcctgagccaggacctggacccccacagccccggcgagcccgccctgctgagcctgtgcgacagcgccgtgcccctgaacgcccccgccaacagagagaacggcagccaggccatgccctacaactgcagaaacaacctggccttccccgcccacccccaggacgtggacggcaagagcgagagcagctacagcggcggcggcggccacagcagcagcgagccctgggagtacaagagcagcggcaacggcagagccagccccctgaagccccacctggccacccccggctacagcacccccaccagcaacatgagcagctgcagcctggaccagaccagcaacaaggaggacgccggcagcctgtacagcgaggaccacgacggctactgcgccagcgtgcacaccgacagcggccacggcagcggcaacctgtgcaacagcagcgacggcttcggcaaccccagacacagcgtgatcaacgtgttcgtgggcagagcccagaagaaccagggcgacagaagcaactaccaggacaagagcctgagcagaaacatcagcctgaagaaggccaagaagccccccctgccccccagcagaaccgacagcctgagaagaatccccaagaagagcagccagtgcaacggccaggtgctgaacgagagcctgatcgccaccctgcagcacagcctgcagctgagcctgcccggcaagagcggcagcagccccagccagagcccctgcagcgacctggaggagccctggctgcccagaagcagaagccagagcaccgtgagcgccggcagcagcatgaccagcgccaccacccccaacgtgtacagcctgtgcggcgccacccccagccagagcgacaccagcagcgtgaagagcgagtacaccgacccctggggctactacatcgactacaccggcatgcaggaggaccccggcaaccccgccggcggctgcagcaccagcagcggcgtgcccaccggcaacggccccgtgagacacgtgcaggagggcagcagagccaccatgccccaggtgcccggcggcagcgtgaagcccaagatcatgagccccgagaagagccacagagtgatcagccccagcagcggctacagcagccagagcaacacccccaccgccctgacccccgtgcccgtgttcctgaagagcgtgagccccgccaacggcaagggcaagcccaagcccaaggtgcccgagagaaagagcagcctgatcagcagcgtgagcatcagcagcagcagcaccagcctgagcagcagcaccagcaccgagggcagcggcaccatgaagaagctggaccccgccgtgggcagcccccccgcccccccccccccccccgtgcccagcccccccttcccctgccccgccgacagaagccccttcctgcccccccccccccccgtgaccgactgcagccagggcagccccctgccccacagccccgtgttccccccccccccccccgaggccctgatccccttctgcagcccccccgactggtgcctgagcccccccagacccgccctgagccccatcctgcccgacagccccgtgagcctgcccctgcccccccccctgctgcccagcagcgagcccccccccgccccccccctggaccccaagttcatgaaggacaccagaccccccttcaccaacagcggccagcccgagagcagcagaggcagcctgagaccccccagcaccaaggaggagaccagcagaccccccatgcccctgatcaccaccgaggccctgcagatggtgcagctgagacccgtgagaaagaacagcggcgccgaggccgcccagctgagcgagagaaccgcccaggagcagagaacccccgtggccccccagtaccacctgaagcccagcgccttcctgaagagcagaaacagcaccaacgagatggagagcgagagccagcccgccagcgtgaccagcagcctgcccacccccgccaagagcagcagccagggcgaccacggcagcgccgccgagagaggcggccccgtgagcagaagccccggcgcccccagcgccggcgaggccgaggccagacccagccccagcaccacccccctgcccgacagcagccccagcagaaagcccccccccatcagcaagaagcccaagctgttcctggtggtgccccccccccagaaggacttcgccgtggagcccgccgagaacgtgagcgaggccctgagagccgtgcccagccccaccaccggcgaggagggcagcgtgcacagcagagaggccaaggagagcagcgccgcccaggccggcagccacgccacccaccccggcaccagcgtgctggagggcggcgccgccggcagcatgagccccagcagagtggaggccaacgtgcccatggtgcagcccgacgtgagccccgcccccaagcaggaggagcccgccgagaacagcgccgacaccggcggcgacggcgagagctgcctgagccagcaggacggcgccgccggcgtgcccgagaccaacgccgccggcagcagcagcgaggcctgcgacttcctgaaggaggacggcaacgacgaggtgatgacccccagcagacccagaaccaccgaggacctgttcgccgccatccacagaagcaagagaaaggtgctgggcagaagagacagcgacgacgaccacagcagaaaccacagccccagcccccccgtgacccccaccggcgccgcccccagcctggccagccccaagcaggtgggcagcatccagagaagcatcagaaagagcagcaccagcagcgacaacttcaaggccctgctgctgaagaagggcagcagaagcgacaccagcgccagaatgagcgccgccgagatgctgaagaacaccgaccccagattccagagaagcagaagcgagcccagccccgacgcccccgagagccccagcagctgcagccccagcaagaacagaagagcccaggaggagtgggccaagaacgagggcctgatgcccagaagcctgagcttcagcggccccagatacggcagaagcagaaccccccccagcgccgccagcagcagatacagcatgagaaacagaatccagagcagccccatgaccgtgatcagcgagggcgagggcgaggccgtggagcccgtggacagcatcgccagaggcgccctgggcgccgccgagggctgcagcctggacggcctggccagagaggagatggacgagggcggcctgctgtgcggcgagggccccgccgccagcctgcagccccaggcccccggccccgtggacggcaccgccagcgccgagggcagagagcccagcccccagtgcggcggcagcctgagcgaggagagctag

SEQ ID NO: 22767 - DNA, 4833 bp, Artificial Sequence
  Description of Artificial Sequence: Synthetic coding sequence
atgaagaaggagggcagcagcggcagcttcagactgcagcccaacaccggcagcctgagcagagccgtgagctggatcaacttcagcagcctgagcagacagaccaagagactgttcagaagcgacggcgagctgagcgtgtgcggccagcaggtggaggtggacgacgagaactggatctacagagcccagcccagaaaggccgtgagcaacctggacgaggagagcagatggaccgtgcactacaccgccccctggcaccagcaggagaacgtgttcctgcccaccaccagacccccctgcgtggaggacctgcacagacaggccaagctgaacctgaagagcgtgctgagagagtgcgacaagctgagacacgacggctacagaagcagccagtactacagccagggccccaccttcgccgccaacgccagccccttctgcgacgactaccaggacgaggacgaggagaccgaccagaagtgcagcctgagcagcagcgaggaggagagattcatcagcatcagaagacccaagacccccgccagcagcgacttcagcgacctgaacacccagaccaactggaccaagagcctgcccctgcccacccccgaggagaagatgagacagcaggcccagaccgtgcaggccgacgtggtgcccatcaacatcaccgccagcggcaccggccaggacgacgccgacggccacagcgtgtacacccccgaccactacagcaccctgggcagattcaacagctgcagaagcgccggccagagaagcgagaccagagacagcagctgccagaccgaggacgtgaaggtggtgccccccagcatgagaagaatcagagcccagaagggccagggcatcgccgcccagatgggccacttcagcggcagcagcggcaacatgagcgtgctgagcgacagcgccggcatcgtgttccccagcagactggacagcgacgccggcttccacagcctgcccagaagcggcgccagagccaacatccagagcctggagcccagactgggcgccctgggccccgccggcgacatgaacggcaccttcctgtaccagagaggccacccccaggccgacgagaacctgggccacctgggcggcgccagcggcaccggcaccctgctgagacccaagagccaggagctgagacacttcgagagcgagaacatcatgagccccgcctgcgtggtgagcccccacgccacctacagcaccagcatcatccccaacgccaccctgagcagcagcagcgaggtgatcgccatccccaccgcccagagcgccggccagagagagagcaagagcagcggcagcagccacgccagaatcaagagcagagaccacctgatcagcagacacgccgtgaagggcgacccccagagccccggcagacactggaacgagggccacgccaccatcctgagccaggacctggacccccacagccccggcgagcccgccctgctgagcctgtgcgacagcgccgtgcccctgaacgcccccgccaacagagagaacggcagccaggccatgccctacaactgcagaaacaacctggccttccccgcccacccccaggacgtggacggcaagagcgagagcagctacagcggcggcggcggccacagcagcagcgagccctgggagtacaagagcagcggcaacggcagagccagccccctgaagccccacctggccacccccggctacagcacccccaccagcaacatgagcagctgcagcctggaccagaccagcaacaaggaggacgccggcagcctgtacagcgaggaccacgacggctactgcgccagcgtgcacaccgacagcggccacggcagcggcaacctgtgcaacagcagcgacggcttcggcaaccccagacacagcgtgatcaacgtgttcgtgggcagagcccagaagaaccagggcgacagaagcaactaccaggacaagagcctgagcagaaacatcagcctgaagaaggccaagaagccccccctgccccccagcagaaccgacagcctgagaagaatccccaagaagagcagccagtgcaacggccaggtgctgaacgagagcctgatcgccaccctgcagcacagcctgcagctgagcctgcccggcaagagcggcagcagccccagccagagcccctgcagcgacctggaggagccctggctgcccagaagcagaagccagagcaccgtgagcgccggcagcagcatgaccagcgccaccacccccaacgtgtacagcctgtgcggcgccacccccagccagagcgacaccagcagcgtgaagagcgagtacaccgacccctggggctactacatcgactacaccggcatgcaggaggaccccggcaaccccgccggcggctgcagcaccagcagcggcgtgcccaccggcaacggccccgtgagacacgtgcaggagggcagcagagccaccatgccccaggtgcccggcggcagcgtgaagcccaagatcatgagccccgagaagagccacagagtgatcagccccagcagcggctacagcagccagagcaacacccccaccgccctgacccccgtgcccgtgttcctgaagagcgtgagccccgccaacggcaagggcaagcccaagcccaaggtgcccgagagaaagagcagcctgatcagcagcgtgagcatcagcagcagcagcaccagcctgagcagcagcaccagcaccgagggcagcggcaccatgaagaagctggaccccgccgtgggcagcccccccgcccccccccccccccccgtgcccagcccccccttcccctgccccgccgacagaagccccttcctgcccccccccccccccgtgaccgactgcagccagggcagccccctgccccacagccccgtgttccccccccccccccccgaggccctgatccccttctgcagcccccccgactggtgcctgagcccccccagacccgccctgagccccatcctgcccgacagccccgtgagcctgcccctgcccccccccctgctgcccagcagcgagcccccccccgccccccccctggaccccaagttcatgaaggacaccagaccccccttcaccaacagcggccagcccgagagcagcagaggcagcctgagaccccccagcaccaaggaggagaccagcagaccccccatgcccctgatcaccaccgaggccctgcagatggtgcagctgagacccgtgagaaagaacagcggcgccgaggccgcccagctgagcgagagaaccgcccaggagcagagaacccccgtggccccccagtaccacctgaagcccagcgccttcctgaagagcagaaacagcaccaacgagatggagagcgagagccagcccgccagcgtgaccagcagcctgcccacccccgccaagagcagcagccagggcgaccacggcagcgccgccgagagaggcggccccgtgagcagaagccccggcgcccccagcgccggcgaggccgaggccagacccagccccagcaccacccccctgcccgacagcagccccagcagaaagcccccccccatcagcaagaagcccaagctgttcctggtggtgccccccccccagaaggacttcgccgtggagcccgccgagaacgtgagcgaggccctgagagccgtgcccagccccaccaccggcgaggagggcagcgtgcacagcagagaggccaaggagagcagcgccgcccaggccggcagccacgccacccaccccggcaccagcgtgctggagggcggcgccgccggcagcatgagccccagcagagtggaggccaacgtgcccatggtgcagcccgacgtgagccccgcccccaagcaggaggagcccgccgagaacagcgccgacaccggcggcgacggcgagagctgcctgagccagcaggacggcgccgccggcgtgcccgagaccaacgccgccggcagcagcagcgaggcctgcgacttcctgaaggaggacggcaacgacgaggtgatgacccccagcagacccagaaccaccgaggacctgttcgccgccatccacagaagcaagagaaaggtgctgggcagaagagacagcgacgacgaccacagcagaaaccacagccccagcccccccgtgacccccaccggcgccgcccccagcctggccagccccaagcaggtgggcagcatccagagaagcatcagaaagagcagcaccagcagcgacaacttcaaggccctgctgctgaagaagggcagcagaagcgacaccagcgccagaatgagcgccgccgagatgctgaagaacaccgaccccagattccagagaagcagaagcgagcccagccccgacgcccccgagagccccagcagctgcagccccagcaagaacagaagagcccaggaggagtgggccaagaacgagggcctgatgcccagaagcctgagcttcagcggccccagatacggcagaagcagaaccccccccagcgccgccagcagcagatacagcatgagaaacagaatccagagcagccccatgaccgtgatcagcgagggcgagggcgaggccgtggagcccgtggacagcatcgccagaggcgccctgggcgccgccgagggctgcagcctggacggcctggccagagaggagatggacgagggcggcctgctgtgcggcgagggccccgccgccagcctgcagccccaggcccccggccccgtggacggcaccgccagcgccgagggcagagagcccagcccccagtgcggcggcagcctgagcgaggagagctag

SEQ ID NO: 22768 - DNA, 2130 bp, Artificial Sequence
  Description of Artificial Sequence: Synthetic coding sequence
atggagagcatgggcatggtgtacagcgtgcccagcagctgcaacggccccaccgagagcaccttcagcaccagctggaagggcgacgccttcacctacatgacccccagcgccaccagccagagcaaccaggtgaacgagaacggcaagaaccccagctgcggcaacagctgggtgagcctgaacaaggtgccccccctggtgcccaaggaggccgccaccctgctggtggccagagacaaccccgccggctgcagcggcagcgccggctaccccgagagactgatccagcagagacacatgcccgagagacccagcaagatcggcctgctgaccagcggcaccagcagactggagaccggccccggcggcgccagcagattcagagagagaagcctgagcgtgcccaccgacagcggcaccaccgacgtggactacgacgaggagcagaaggccaacgaggcctgcgccctgcccttcgccagcaccagcagcgagggcagcaacagcgccgacaacatcgccagcctgagcgcccagcaggaggcccagcacagaagacagagaagcaagagcatcagcctgagaaaggccaagaagaagcccagcccccccaccagaagcgtgagcctggtgaaggacgagcccggcctgctgcccgagggcggcagcgccctgcccaaggaccagagacccaagagcctgtgcctgagcctggagcaccagggccaccacagcagccaccccgacgcccagggccaccccgccatccccaaccacaaggaccccgagagcacccagttcagccaccactggtacctgaccgactggaagagcggcgacacctaccagagcctgagcagcagcagcaccgccaccggcaccaccgtgatcgagtgcacccaggtgcagggcagcagcgagagcctggccagccccagcaccagcagagccaccacccccagccagctgagcatcgaggtggaggccagagagatcagcagccccggcagaccccccggcctgatgagccccagcagcggctacagcagccagagcgagacccccacccccaccgtgagcatgagcctgaccctgggccacctgcccccccccagcagcagcgtgagagtgagacccgtggtgcccgagagaaagagcagcctgccccccaccagccccatggagaagttccccaagagcagactgagcttcgacctgcccctgaccagcagccccaacctggacctgagcggcatgagcatcagcatcagaagcaagaccaaggtgagcagacaccacagcgagaccaacttcggcgtgaagctggcccagaagaccaaccccaaccagcccatcatgcccatggtgacccagagcgacctgagaagcgtgagactgagaagcgtgagcaagagcgagcccgaggacgacatcgagagccccgagtacgccgaggagcccagagccgaggaggtgttcaccctgcccgagagaaagaccaagccccccgtggccgagaagccccccgtggccagaagaccccccagcctggtgcacaagccccccagcgtgcccgaggagtacgccctgaccagccccaccctggccatgccccccagaagcagcatccagcacgccagacccctgccccaggacagctacaccgtggtgagaaagcccaagcccagcagcttccccgacggcagaagccccggcgagagcaccgcccccagcagcctggtgttcacccccttcgccagcagcagcgacgccttcttcagcggcacccagcagcccccccagggcagcgtggaggacgagggccccaaggtgagagtgctgcccgagagaatcagcctgcagagccaggaggaggccgagaagaagaagggcaagatccccccccccgtgcccaagaagcccagcgtgctgtacctgcccctgaccagccccaccgcccagatggaggcctacgtggccgagcccagactgcccctgagccccatcatcaccctggaggaggacaccaagtgccccgccaccggcgacgacctgcagagcctgggccagagagtgaccagcaccccccaggccgacagcgagagagaggccagccccctgggctag

SEQ ID NO: 22769 - DNA, 2130 bp, Artificial Sequence; identical to SEQ ID NO: 22768
  Description of Artificial Sequence: Synthetic coding sequence

SEQ ID NO: 22770 - DNA, 3678 bp, Artificial Sequence
  Description of Artificial Sequence: Synthetic coding sequence
atgcccttctacagaagaaccgtggtgccccagagactgtgccccagaaaccccccccagcagctggccgagctgagagacgtgagccacctggccgccctgagcctgctgagacagctggccgacctgtgcggccacagcctggccctgctggaggacctggagggccacctgctggccctgggcagaagaaccgacagcctgtacagaagaaccgtgagactgagaagaagactgccctgcagactgctgggccccgaggaggacgaggaggagctggccgccgccaacagcggcagagagaacgccaccgccaccgcccacagcagaagcagctggagacagcccgtgaacgtgttcctgagcagcggcagaccccccagcgtggaggagctgctgagagaggcccagctgaacctgcagagcctgctgcaggaggagtacgaggagcagtacagcgaggccagactggtgggccagaccttcagaagcagcgacgaggccaccaagcccacccccaaccccagaccccagagcgccagaagactggagttcatcctgatgcccaccaagagacagctgagcgaggacgagaccaccacccagggcgtgagagcccccgaggccagcctgagcctgagcaccaccgccgacaagcagaccgcctggaacagcctgttccccctgcccatcctggaggagaagagatggccccagctgtgcagcacccagagcgacatcgtgcccatcaacatcagcggccagcagttcgacaagcacgccagcctgagacacagcctgttcaacaccgagaccgccgtgaaccccaagagcaccctgagaagaagaagaaccatcatcggcttcagcaacttcagccagagagaccagggccacagcaacagccccgccggcagcgtggcccacagcaccaccagcgacatcagacccagccacagcgtgcccgagggcgtgcacggcagagtggccgtgggccaggacgccagattccccagcctgaccagccccgtgctgagaacccccagcagcgagcccgacgagccccaccaggccagaagcggccccaacccccccggcatggagagcatgggcatggtgtacagcgtgcccagcagctgcaacggccccaccgagagcaccttcagcaccagctggaagggcgacgccttcacctacatgacccccagcgccaccagccagagcaaccaggtgaacgagaacggcaagaaccccagctgcggcaacagctgggtgagcctgaacaaggtgccccccctggtgcccaaggaggccgccaccctgctggtggccagagacaaccccgccggctgcagcggcagcgccggctaccccgagagactgatccagcagagacacatgcccgagagacccagcaagatcggcctgctgaccagcggcaccagcagactggagaccggccccggcggcgccagcagattcagagagagaagcctgagcgtgcccaccgacagcggcaccaccgacgtggactacgacgaggagcagaaggccaacgaggcctgcgccctgcccttcgccagcaccagcagcgagggcagcaacagcgccgacaacatcgccagcctgagcgcccagcaggaggcccagcacagaagacagagaagcaagagcatcagcctgagaaaggccaagaagaagcccagcccccccaccagaagcgtgagcctggtgaaggacgagcccggcctgctgcccgagggcggcagcgccctgcccaaggaccagagacccaagagcctgtgcctgagcctggagcaccagggccaccacagcagccaccccgacgcccagggccaccccgccatccccaaccacaaggaccccgagagcacccagttcagccaccactggtacctgaccgactggaagagcggcgacacctaccagagcctgagcagcagcagcaccgccaccggcaccaccgtgatcgagtgcacccaggtgcagggcagcagcgagagcctggccagccccagcaccagcagagccaccacccccagccagctgagcatcgaggtggaggccagagagatcagcagccccggcagaccccccggcctgatgagccccagcagcggctacagcagccagagcgagacccccacccccaccgtgagcatgagcctgaccctgggccacctgcccccccccagcagcagcgtgagagtgagacccgtggtgcccgagagaaagagcagcctgccccccaccagccccatggagaagttccccaagagcagactgagcttcgacctgcccctgaccagcagccccaacctggacctgagcggcatgagcatcagcatcagaagcaagaccaaggtgagcagacaccacagcgagaccaacttcggcgtgaagctggcccagaagaccaaccccaaccagcccatcatgcccatggtgacccagagcgacctgagaagcgtgagactgagaagcgtgagcaagagcgagcccgaggacgacatcgagagccccgagtacgccgaggagcccagagccgaggaggtgttcaccctgcccgagagaaagaccaagccccccgtggccgagaagccccccgtggccagaagaccccccagcctggtgcacaagccccccagcgtgcccgaggagtacgccctgaccagccccaccctggccatgccccccagaagcagcatccagcacgccagacccctgccccaggacagctacaccgtggtgagaaagcccaagcccagcagcttccccgacggcagaagccccggcgagagcaccgcccccagcagcctggtgttcacccccttcgccagcagcagcgacgccttcttcagcggcacccagcagcccccccagggcagcgtggaggacgagggccccaaggtgagagtgctgcccgagagaatcagcctgcagagccaggaggaggccgagaagaagaagggcaagatccccccccccgtgcccaagaagcccagcgtgctgtacctgcccctgaccagccccaccgcccagatggaggcctacgtggccgagcccagactgcccctgagccccatcatcaccctggaggaggacaccaagtgccccgccaccggcgacgacctgcagagcctgggccagagagtgaccagcaccccccaggccgacagcgagagagaggccagccccctgggcagcagcgtggagcccggcaccgaggagaagagcctgatcagcgacaagaccgccgagtggatcgccgaggacgacgacgacgtgttcgtggccagcagaaccaccgaggacctgttcaccgtgatccacagaagcaagagaaagctgctgggctggaaggagcccggcgaggccttcgtgggcggcagaaccagcagccacagccccatcaagaacaccgccgagagccccatcagcgagagcaccgccaccgccggcagcggcagcagcgccaacctggacgccggcagaaacgacgacttcaaggccctgctgcagaagaagggcagcaaggccacccccagaagcagacccagcgccgccgagctgctgaagaccaccaaccccctggccagaagaatcatcgcccagttcagcaaggactacgagaccaccgacaaccccagcacctag

SEQ ID NO: 22771 - DNA, 2139 bp, Artificial Sequence
  Description of Artificial Sequence: Synthetic coding sequence
atgcccgaccaggacaagaaggtgaagaccaccgagaagagcaccgacaagcagcaggagatcaccatcagagactacagcgacctgaagagactgagatgcctgctgaacgtgcagagcagcaagcagcagctgcccgccatcaacttcgacagcgcccagaacagcatgaccaagagcgagcccgccatcagagccggcggccacagagccagaggccagtggcacgagagcaccgaggccgtggagctggagaacttcagcatcaactacaagaacgagagaaacttcagcaagcacccccagagaaagctgttccaggagatcttcaccgccctggtgaagaacagactgatcagcagagagtgggtgaacagagcccccagcatccacttcctgagagtgctgatctgcctgagactgctgatgagagacccctgctaccaggagatcctgcacagcctgggcggcatcgagaacctggcccagtacatggagatcgtggccaacgagtacctgggctacggcgaggagcagcacaccgtggacaagctggtgaacatgacctacatcttccagaagctggccgccgtgaaggaccagagagagtgggtgaccaccagcggcgcccacaagaccctggtgaacctgctgggcgccagagacaccaacgtgctgctgggcagcctgctggccctggccagcctggccgagagccaggagtgcagagagaagatcagcgagctgaacatcgtggagaacctgctgatgatcctgcacgagtacgacctgctgagcaagagactgaccgccgagctgctgagactgctgtgcgccgagccccaggtgaaggagcaggtgaagctgtacgagggcatccccgtgctgctgagcctgctgcacagcgaccacctgaagctgctgtggagcatcgtgtggatcctggtgcaggtgtgcgaggaccccgagaccagcgtggagatcagaatctggggcggcatcaagcagctgctgcacatcctgcagggcgacagaaacttcgtgagcgaccacagcagcatcggcagcctgagcagcgccaacgccgccggcagaatccagcagctgcacctgagcgaggacctgagccccagagagatccaggagaacaccttcagcctgcaggccgcctgctgcgccgccctgaccgagctggtgctgaacgacaccaacgcccaccaggtggtgcaggagaacggcgtgtacaccatcgccaagctgatcctgcccaacaagcagaagaacgccgccaagagcaacctgctgcagtgctacgccttcagagccctgagattcctgttcagcatggagagaaacagacccctgttcaagagactgttccccaccgacctgttcgagatcttcatcgacatcggccactacgtgagagacatcagcgcctacgaggagctggtgagcaagctgaacctgctggtggaggacgagctgaagcagatcgccgagaacatcgagagcatcaaccagaacaaggcccccctgaagtacatcggcaactacgccatcctggaccacctgggcagcggcgccttcggctgcgtgtacaaggtgagaaagcacagcggccagaacctgctggccatgaaggaggtgaacctgcacaaccccgccttcggcaaggacaagaaggacagagacagcagcgtgagaaacatcgtgagcgagctgaccatcatcaaggagcagctgtaccaccccaacatcgtgagatactacaagaccttcctggagaacgacagactgtacatcgtgatggagctgatcgagggcgcccccctgggcgagcacttcagcagcctgaaggagaagcaccaccacttcaccgaggagagactgtggaagatcttcatccagctgtgcctggccctgagatacctgcacaaggagaagagaatcgtgcacagagacctgacccccaacaacatcatgctgggcgacaaggacaaggtgaccgtgaccgacttcggcctggccaagcagaagcaggagaacagcaagctgaccagcgtggtgggcaccatcctgtacagctgcgtgcagcacctgtacctgagaagccccgcccccgccctggccacctag

SEQ ID NO: 22772 - DNA, 1215 bp, Artificial Sequence
  Description of Artificial Sequence: Synthetic coding sequence
atggagctgatcgagggcgcccccctgggcgagcacttcagcagcctgaaggagaagcaccaccacttcaccgaggagagactgtggaagatcttcatccagctgtgcctggccctgagatacctgcacaaggagaagagaatcgtgcacagagacctgacccccaacaacatcatgctgggcgacaaggacaaggtgaccgtgaccgacttcggcctggccaagcagaagcaggagaacagcaagctgaccagcgtggtgggcaccatcctgtacagctgccccgaggtgctgaagagcgagccctacggcgagaaggccgacgtgtgggccgtgggctgcatcctgtaccagatggccaccctgagcccccccttctacagcaccaacatgctgagcctggccaccaagatcgtggaggccgtgtacgagcccgtgcccgagggcatctacagcgagaaggtgaccgacaccatcagcagatgcctgacccccgacgccgaggccagacccgacatcgtggaggtgagcagcatgatcagcgacgtgatgatgaagtacctggacaacctgagcaccagccagctgagcctggagaagaagctggagagagagagaagaagaacccagagatacttcatggaggccaacagaaacaccgtgacctgccaccacgagctggccgtgctgagccacgagaccttcgagaaggccagcctgagcagcagcagcagcggcgccgccagcctgaagagcgagctgagcgagagcgccgacctgccccccgagggcttccaggccagctacggcaaggacgaggacagagcctgcgacgagatcctgagcgacgacaacttcaacctggagaacgccgagaaggacacctacagcgaggtggacgacgagctggacatcagcgacaacagcagcagcagcagcagcagccccctgaaggagagcaccttcaacatcctgaagagaagcttcagcgccagcggcggcgagagacagagccagaccagagacttcaccggcggcaccggcagcagacccagacccgccctgctgcccctggacctgctgctgaaggtgcccccccacatgctgagagcccacatcaaggagatcgaggccgagctggtgaccggctggcagagccacagcctgcccgccgtgatcctgagaaacctgaaggaccacggcagcacctactag

SEQ ID NO: 22773 - DNA, 1284 bp, Artificial Sequence
  Description of Artificial Sequence: Synthetic coding sequence
atggtgcccgtgcagcccgccgagccccccgaggtgctgaagagcgagccctacggcgagaaggccgacgtgtgggccgtgggctgcatcctgtaccagatggccaccctgagcccccccttctacagcaccaacatgctgagcctggccaccaagatcgtggaggccgtgtacgagcccgtgcccgagggcatctacagcgagaaggtgaccgacaccatcagcagatgcctgacccccgacgccgaggccagacccgacatcgtggaggtgagcagcatgatcagcgacgtgatgatgaagtacctggacaacctgagcaccagccagctgagcctggagaagaagctggagagagagagaagaagaacccagagatacttcatggaggccaacagaaacaccgtgacctgccaccacgagctggccgtgctgagccacgagaccttcgagaaggccagcctgagcagcagcagcagcggcgccgccagcctgaagagcgagctgagcgagagcgccgacctgccccccgagggcttccaggccagctacggcaaggacgaggacagagcctgcgacgagatcctgagcgacgacaacttcaacctggagaacgccgagaaggacacctacagcgaggtggacgacgagctggacatcagcgacaacagcagcagcagcagcagcagccccctgaaggagagcaccttcaacatcctgaagagaagcttcagcgccagcggcggcgagagacagagccagaccagagacttcaccggcggcaccggcagcagacccagacccgccagcgccggcatcgccgtgagccagagaaaggtgagacagatcagcgaccccatccagcagatcctgatccagctgcacaagatcatctacatcacccagctgccccccgccctgcaccacaacctgaagagaagagtgatcgagagattcaagaagagcctgttcagccagcagagcaacccctgcaacctgaagagcgagatcaagaagctgagccagggcagccccgagcccatcgagcccaacttcttcaccgccgactaccacctgctgcacagaagcagcggcggcaacagcctgagccccaacgaccccaccggcctgcccaccagcatcgagctggaggagggcatcacctacgagcagatgcagaccgtgatcgaggaggtgctggaggagagcggctactacaacttcaccagcaacagataccacagctacccctggggcaccaagaaccaccccaccaagagatag

SEQ ID NO: 22774 - DNA, 1425 bp, Artificial Sequence
  Description of Artificial Sequence: Synthetic coding sequence
atggtgcccgtgcagcccgccgagccccccgaggtgctgaagagcgagccctacggcgagaaggccgacgtgtgggccgtgggctgcatcctgtaccagatggccaccctgagcccccccttctacagcaccaacatgctgagcctggccaccaagatcgtggaggccgtgtacgagcccgtgcccgagggcatctacagcgagaaggtgaccgacaccatcagcagatgcctgacccccgacgccgaggccagacccgacatcgtggaggtgagcagcatgatcagcgacgtgatgatgaagtacctggacaacctgagcaccagccagctgagcctggagaagaagctggagagagagagaagaagaacccagagatacttcatggaggccaacagaaacaccgtgacctgccaccacgagctggccgtgctgagccacgagaccttcgagaaggccagcctgagcagcagcagcagcggcgccgccagcctgaagagcgagctgagcgagagcgccgacctgccccccgagggcttccaggccagctacggcaaggacgaggacagagcctgcgacgagatcctgagcgacgacaacttcaacctggagaacgccgagaaggacacctacagcgaggtggacgacgagctggacatcagcgacaacagcagcagcagcagcagcagccccctgaaggagagcaccttcaacatcctgaagagaagcttcagcgccagcggcggcgagagacagagccagaccagagacttcaccggcggcaccggcagcagacccagacccgccctgctgcccctggacctgctgctgaaggtgcccccccacatgctgagagcccacatcaaggagatcgaggccgagctggtgaccggctggcagagccacagcctgcccgccgtgatcctgagaaacctgaaggaccacgccagcgccggcatcgccgtgagccagagaaaggtgagacagatcagcgaccccatccagcagatcctgatccagctgcacaagatcatctacatcacccagctgccccccgccctgcaccacaacctgaagagaagagtgatcgagagattcaagaagagcctgttcagccagcagagcaacccctgcaacctgaagagcgagatcaagaagctgagccagggcagccccgagcccatcgagcccaacttcttcaccgccgactaccacctgctgcacagaagcagcggcggcaacagcctgagccccaacgaccccaccggcctgcccaccagcatcgagctggaggagggcatcacctacgagcagatgcagaccgtgatcgaggaggtgctggaggagagcggctactacaacttcaccagcaacagataccacagctacccctggggcaccaagaaccaccccaccaagagatag

SEQ ID NO: 22775 - DNA, 2178 bp, Artificial Sequence
  Description of Artificial Sequence: Synthetic coding sequence
atgcccgaccaggacaagaaggtgaagaccaccgagaagagcaccgacaagcagcaggagatcaccatcagagactacagcgacctgaagagactgagatgcctgctgaacgtgcagagcagcaagcagcagctgcccgccatcaacttcgacagcgcccagaacagcatgaccaagagcgagcccgccatcagagccggcggccacagagccagaggccagtggcacgagagcaccgaggccgtggagctggagaacttcagcatcaactacaagaacgagagaaacttcagcaagcacccccagagaaagctgttccaggagatcttcaccgccctggtgaagaacagactgatcagcagagagtgggtgaacagagcccccagcatccacttcctgagagtgctgatctgcctgagactgctgatgagagacccctgctaccaggagatcctgcacagcctgggcggcatcgagaacctggcccagtacatggagatcgtggccaacgagtacctgggctacggcgaggagcagcacaccgtggacaagctggtgaacatgacctacatcttccagaagctggccgccgtgaaggaccagagagagtgggtgaccaccagcggcgcccacaagaccctggtgaacctgctgggcgccagagacaccaacgtgctgctgggcagcctgctggccctggccagcctggccgagagccaggagtgcagagagaagatcagcgagctgaacatcgtggagaacctgctgatgatcctgcacgagtacgacctgctgagcaagagactgaccgccgagctgctgagactgctgtgcgccgagccccaggtgaaggagcaggtgaagctgtacgagggcatccccgtgctgctgagcctgctgcacagcgaccacctgaagctgctgtggagcatcgtgtggatcctggtgcaggtgtgcgaggaccccgagaccagcgtggagatcagaatctggggcggcatcaagcagctgctgcacatcctgcagggcgacagaaacttcgtgagcgaccacagcagcatcggcagcctgagcagcgccaacgccgccggcagaatccagcagctgcacctgagcgaggacctgagccccagagagatccaggagaacaccttcagcctgcaggccgcctgctgcgccgccctgaccgagctggtgctgaacgacaccaacgcccaccaggtggtgcaggagaacggcgtgtacaccatcgccaagctgatcctgcccaacaagcagaagaacgccgccaagagcaacctgctgcagtgctacgccttcagagccctgagattcctgttcagcatggagagaaacagacccctgttcaagagactgttccccaccgacctgttcgagatcttcatcgacatcggccactacgtgagagacatcagcgcctacgaggagctggtgagcaagctgaacctgctggtggaggacgagctgaagcagatcgccgagaacatcgagagcatcaaccagaacaaggcccccctgaagtacatcggcaactacgccatcctggaccacctgggcagcggcgccttcggctgcgtgtacaaggtgagaaagcacagcggccagaacctgctggccatgaaggaggtgaacctgcacaaccccgccttcggcaaggacaagaaggacagagacagcagcgtgagaaacatcgtgagcgagctgaccatcatcaaggagcagctgtaccaccccaacatcgtgagatactacaagaccttcctggagaacgacagactgtacatcgtgatggagctgatcgagggcgcccccctgggcgagcacttcagcagcctgaaggagaagcaccaccacttcaccgaggagagactgtggaagatcttcatccagctgtgcctggccctgagatacctgcacaaggagaagagaatcgtgcacagagacctgacccccaacaacatcatgctgggcgacaaggacaaggtgaccgtgagctgcctgaagtgcgccgcccccctgcccagcctgagctgcagctgcagcggccacatcaagagagccggcagcagcttcgccttctgctaccactggaagctgcccgacgccagccaggaggccaacgccatcatggtgcccgtgcagcccgccgagccctag

SEQ ID NO: 22776 - DNA, 291 bp, Artificial Sequence
  Description of Artificial Sequence: Synthetic coding sequence
atgcccgaccaggacaagaaggtgaagaccaccgagaagagcaccgacaagcagcaggagatcaccatcagagactacagcgacctgaagagactgagatgcctgctgaacgtgcagagcagcaagcagcagctgcccgccatcaacttcgacagcgcccagaacagcatgaccaagagcgagcccgccatcagagccggcggccacagagccagaggccagtggcacgagagcaccgaggccgtggagctggagaacttcagcatcaactacaagaacgagagaaactag

SEQ ID NO: 22777 - DNA, 402 bp, Artificial Sequence
  Description of Artificial Sequence: Synthetic coding sequence
atgcccgaccaggacaagaaggtgaagaccaccgagaagagcaccgacaagcagcaggagatcaccatcagagactacagcgacctgaagagactgagatgcctgctgaacgtgcagagcagcaagcagcagctgcccgccatcaacttcgacagcgcccagaacagcatgaccaagagcgagcccgccatcagagccggcggccacagagccagaggccagtggcacgagagcaccgaggccgtggagctggagaacttcagcatcaactacaagaacgagagaaacttcagcaagcacccccagagaaagctgttccaggagatcttcaccgccctggtgaagaacagactgatcagcagagagtgggtgaacagagcccccagcatccacttcctgtag

SEQ ID NO: 22778 - DNA, 2127 bp, Artificial Sequence
  Description of Artificial Sequence: Synthetic coding sequence
atggacaagtacgacgtgatcaaggccatcggccagggcgccttcggcaaggcctacctggccaagggcaagagcgacagcaagcactgcgtgatcaaggagatcaacttcgagaagatgcccatccaggagaaggaggccagcaagaaggaggtgatcctgctggagaagatgaagcaccccaacatcgtggccttcttcaacagcttccaggagaacggcagactgttcatcgtgatggagtactgcgacggcggcgacctgatgaagagaatcaacagacagagaggcgtgctgttcagcgaggaccagatcctgggctggttcgtgcagatcagcctgggcctgaagcacatccacgacagaaagatcctgcacagagacatcaaggcccagaacatcttcctgagcaagaacggcatggtggccaagctgggcgacttcggcatcgccagagtgctgaacaacagcatggagctggccagaacctgcatcggcaccccctactacctgagccccgagatctgccagaacaagccctacaacaacaagaccgacatctggagcctgggctgcgtgctgtacgagctgtgcaccctgaagcaccccttcgagggcaacaacctgcagcagctggtgctgaagatctgccaggcccacttcgcccccatcagccccggcttcagcagagagctgcacagcctgatcagccagctgttccaggtgagccccagagacagacccagcatcaacagcatcctgaagagacccttcctggagaacctgatccccaagtacctgacccccgaggtgatccaggaggagttcagccacatgctgatctgcagagccggcgcccccgccagcagacacgccggcaaggtggtgcagaagtgcaagatccagaaggtgagattccagggcaagtgcccccccagaagcagaatcagcgtgcccatcaagagaaacgccatcctgcacagaaacgagtggagaccccccgccggcgcccagaaggccagaagcatcaagatgatcgagagacccaagatcgccgccgtgtgcggccactacgactactactacgcccagctggacatgctgagaagaagagcccacaagcccagctaccaccccatcccccaggagaacaccggcgtggaggactacggccaggagaccagacacggccccagccccagccagtggcccgccgagtacctgcagagaaagttcgaggcccagcagtacaagctgaaggtggagaagcagctgggcctgagacccagcagcgccgagcccaactacaaccagagacaggagctgagaagcaacggcgaggagcccagattccaggagctgcccttcagaaagaacgagatgaaggagcaggagtactggaagcagctggaggagatcagacagcagtaccacaacgacatgaaggagatcagaaagaagatgggcagagagcccgaggagaacagcaagatcagccacaagacctacctggtgaagaagagcaacctgcccgtgcaccaggacgccagcgagggcgaggcccccgtgcagatggagttcagaagctgctgccccggctggagcgccatggccagaagctggctgaccgccaccagcgccagccaggacatcgagaaggacctgaagcagatgagactgcagaacaccaaggagagcaagaaccccgagcagaagtacaaggccaagaagggcgtgaagttcgagatcaacctggacaagtgcatcagcgacgagaacatcctgcaggaggaggaggccatggacatccccaacgagaccctgaccttcgaggacggcatgaagttcaaggagtacgagtgcgtgaaggagcacggcgactacaccgacaaggccttcgagaagctgcactgccccgaggccggcttcagcacccagaccgtggccgccgtgggcaacagaagacagtgggacggcggcgccccccagaccctgctgcagatgatggccgtggccgacatcaccagcacctgccccaccggccccgacagcgagagcgtgctgagcgtgagcagacaggagggcaagaccaaggacccctacagccccgtgctgatcctgatgtag

SEQ ID NO: 22779 - DNA, 429 bp, Artificial Sequence
  Description of Artificial Sequence: Synthetic coding sequence
atgaacatcaacccctgcctggtgctgtgcgagtgcagcctgagcatcagcctggacgccgaccccctggtgagccccttcgccaccggcccctgccccggcgcccccagagaggtggtggccatgcagagcgacgtgggccagggcttccccatgcagagcaactggagagcccccgtgcacgcctgcaccagcggcgccgtgagaaagggctggcccggctgcggcagaagaagacacaagatgggcggcggccccgtgagctgggagcagagacagaaggaggtggaggccgcccagggcagcgaggagagaggccccggcagcctggccgtgagcctgctgagcctggccgtgggcatccacagaatcagccccatcctgggcttccacatctgctgcatgcaggtgctgatggtgctgaagtag

SEQ ID NO: 22780 - DNA, 744 bp, Artificial Sequence
  Description of Artificial Sequence: Synthetic coding sequence
atgctggtgctgagaagcggcctgaccaaggccctggccagcagaaccctggccccccaggtgtgcagcagcttcgccaccggccccagacagtacgacggcaccttctacgagttcagaacctactacctgaagcccagcaacatgaacgccttcatggagaacctgaagaagaacatccacctgagaaccagctacagcgagctggtgggcttctggagcgtggagttcggcggcagaaccaacaaggtgttccacatctggaagtacgacaacttcgcccacagagccgaggtgagaaaggccctggccaactgcaaggagtggcaggagcagagcatcatccccaacctggccagaatcgacaagcaggagaccgagatcacctacctgatcccctggagcaagctggagaagccccccaaggagggcgtgtacgagctggccgtgttccagatgaagcccggcggccccgccctgtggggcgacgccttcgagagagccatcaacgcccacgtgaacctgggctacaccaaggtggtgggcgtgttccacaccgagtacggcgagctgaacagagtgcacgtgctgtggtggaacgagagcgccgacagcagagccgccggcagacacaagagccacgaggaccccagagtggtggccgccgtgagagagagcgtgaactacctggtgagccagcagaacatgctgctgatccccgccagcttcagccccctgaagtag

SEQ ID NO: 22781 - DNA, 1632 bp, Artificial Sequence
  Description of Artificial Sequence: Synthetic coding sequence
atgagagacaacaccagccccatcagcgtgatcctggtgagcagcggcagcagaggcaacaagctgctgttcagataccccttccagagaagccaggagcaccccgccagccagaccagcaagcccagaagcagatacgccgccagcaacaccggcgaccacgccgacgagcaggacggcgacagcagattcagcgacgtgatcctggccaccatcctggccaccaagagcgagatgtgcggccagaagttcgagctgaagatcgacaacgtgagattcgtgggccaccccaccctgctgcagcacgccctgggccaggccaacgccgaccccagcgtgatcaactgcctgcacaacctgagcagaagaatcgccaccgtgctgcagcacgaggagagaagatgccagtacctgaccagagaggccaagctgatcctggccctgcaggacgaggtgagcgccatggccgacggcaacgagggcccccagagccccttccaccacatcctgcccaagtgcaagctggccagagacctgaaggaggcctacgacagcctgtgcaccagcggcgtggtgagactgcacatcaacagctggctggaggtgagcttctgcctgccccacaagatccactacgccgccagcagcctgatcccccccgaggccatcgagagaagcctgaaggccatcagaccctaccacgccctgctgctgctgagcgacgagaagagcctgctgggcgagctgcccatcgactgcagccccgccctggtgagagtgatcaagaccaccagcgccgtgaagaacctgcagcagctggcccaggacgccgacctggccctgctgcaggtgttccagctggccgcccacctggtgtactggggcaaggccatcatcatctaccccctgtgcgagaacaacgtgtacatgctgagccccaacgccagcgtgtgcctgtacagccccctggccgagcagttcagccaccagttccccagccacgacctgcccagcgtgctggccaagttcagcctgcccgtgagcctgagcgagttcagaaaccccctggcccccgccgtgcaggagacccagctgatccagatggtggtgtggatgctgcagagaagactgctgatccagctgcacacctacgtgtgcctgatggccagccccagcgaggaggagcccagacccagagaggacgacgtgcccttcaccgccagagtgggcggcagaagcctgagcacccccaacgccctgagcttcggcagccccaccagcagcgacgacatgaccctgaccagccccagcatggacaacagcagcgccgagctgctgcccagcggcgacagccccctgaaccagagaatgaccgagaacctgctggccagcagcgagcacgagagagccgccatcctgagcgtgcccgccgcccagaaccccgaggacctgagaatgttcgccagactgctgcactacttcagaggcagacaccacctggaggagatcatgtacaacgagaacaccagaagaagccagctgctgatgctgttcgacaagttcagaagcgtgctggtggtgaccacccacgaggaccccgtgatcgccgtgttccaggccctgctgccctag

SEQ ID NO: 22782 - DNA, 1170 bp, Artificial Sequence
  Description of Artificial Sequence: Synthetic coding sequence
atggccgacggcaacgagggcccccagagccccttccaccacatcctgcccaagtgcaagctggccagagacctgaaggaggcctacgacagcctgtgcaccagcggcgtggtgagactgcacatcaacagctggctggaggtgagcttctgcctgccccacaagatccactacgccgccagcagcctgatcccccccgaggccatcgagagaagcctgaaggccatcagaccctaccacgccctgctgctgctgagcgacgagaagagcctgctgggcgagctgcccatcgactgcagccccgccctggtgagagtgatcaagaccaccagcgccgtgaagaacctgcagcagctggcccaggacgccgacctggccctgctgcaggtgttccagctggccgcccacctggtgtactggggcaaggccatcatcatctaccccctgtgcgagaacaacgtgtacatgctgagccccaacgccagcgtgtgcctgtacagccccctggccgagcagttcagccaccagttccccagccacgacctgcccagcgtgctggccaagttcagcctgcccgtgagcctgagcgagttcagaaaccccctggcccccgccgtgcaggagacccagctgatccagatggtggtgtggatgctgcagagaagactgctgatccagctgcacacctacgtgtgcctgatggccagccccagcgaggaggagcccagacccagagaggacgacgtgcccttcaccgccagagtgggcggcagaagcctgagcacccccaacgccctgagcttcggcagccccaccagcagcgacgacatgaccctgaccagccccagcatggacaacagcagcgccgagctgctgcccagcggcgacagccccctgaaccagagaatgaccgagaacctgggccagctgagcgagcacgagagagccgccatcctgagcgtgcccgccgcccagaaccccgaggacctgagaatgttcgccagactgctgcactacttcagaggcagacaccacctggaggagatcatgtacaacgagaacaccagaagaagccagctgctgatgctgttcgacaagttcagaagcgtgctggtggtgaccacccacgaggaccccgtgatcgccgtgttccaggccctgctgccctag

SEQ ID NO: 22783 - DNA, 1707 bp, Artificial Sequence
  Description of Artificial Sequence: Synthetic coding sequence
atgagagacaacaccagccccatcagcgtgatcctggtgagcagcggcagcagaggcaacaagctgctgttcagataccccttccagagaagccaggagcaccccgccagccagaccagcaagcccagaagcagatacgccgccagcaacaccggcgaccacgccgacgagcaggacggcgacagcagattcagcgacgtgatcctggccaccatcctggccaccaagagcgagatgtgcggccagaagttcgagctgaagatcgacaacgtgagattcgtgggccaccccaccctgctgcagcacgccctgggccagatcagcaagaccgaccccagccccaagagagaggcccccaccatgatcctgttcaacgtggtgttcgccctgagagccaacgccgaccccagcgtgatcaactgcctgcacaacctgagcagaagaatcgccaccgtgctgcagcacgaggagagaagatgccagtacctgaccagagaggccaagctgatcctggccctgcaggacgaggtgagcgccatggccgacggcaacgagggcccccagagccccttccaccacatcctgcccaagtgcaagctggccagagacctgaaggaggcctacgacagcctgtgcaccagcggcgtggtgagactgcacatcaacagctggctggaggtgagcttctgcctgccccacaagatccactacgccgccagcagcctgatcccccccgaggccatcgagagaagcctgaaggccatcagaccctaccacgccctgctgctgctgagcgacgagaagagcctgctgggcgagctgcccatcgactgcagccccgccctggtgagagtgatcaagaccaccagcgccgtgaagaacctgcagcagctggcccaggacgccgacctggccctgctgcaggtgttccagctggccgcccacctggtgtactggggcaaggccatcatcatctaccccctgtgcgagaacaacgtgtacatgctgagccccaacgccagcgtgtgcctgtacagccccctggccgagcagttcagccaccagttccccagccacgacctgcccagcgtgctggccaagttcagcctgcccgtgagcctgagcgagttcagaaaccccctggcccccgccgtgcaggagacccagctgatccagatggtggtgtggatgctgcagagaagactgctgatccagctgcacacctacgtgtgcctgatggccagccccagcgaggaggagcccagacccagagaggacgacgtgcccttcaccgccagagtgggcggcagaagcctgagcacccccaacgccctgagcttcggcagccccaccagcagcgacgacatgaccctgaccagccccagcatggacaacagcagcgccgagctgctgcccagcggcgacagccccctgaaccagagaatgaccgagaacctgctggccagcagcgagcacgagagagccgccatcctgagcgtgcccgccgcccagaaccccgaggacctgagaatgttcgccagactgctgcactacttcagaggcagacaccacctggaggagatcatgtacaacgagaacaccagaagaagccagctgctgatgctgttcgacaagttcagaagcgtgctggtggtgaccacccacgaggaccccgtgatcgccgtgttccaggccctgctgccctag

SEQ ID NO: 22784 - DNA, 210 bp, Artificial Sequence
  Description of Artificial Sequence: Synthetic coding sequence
atgagagacaacaccagccccatcagcgtgatcctggtgagcagcggcagcagaggcaacaagctgctgttcagataccccttccagagaagccaggagcaccccgccagccagaccagcaagcccagaagcagatacgccgccagcaacaccggcgaccacgccgacgagcaggacggcgacagcagacccacccagaccagacagtag

SEQ ID NO: 22785 - DNA, 999 bp, Artificial Sequence
  Description of Artificial Sequence: Synthetic coding sequence
atgctggcctggcaggacggcggcgccaaggccgcccccagccaccacaagatcagcttcagcgtgctggacatcctggacccccagaagttcaccagagccgccctgcccgccgtgagacccgcccccagagaggccagaaagagcctggccgaggtggaggccggcaaggacgccagcagcagagaccccgtgagacagctggagacccccggccagggcttcgccgccagcctgctgaccagacaggcccacccccaccacagcagcgacgccagagacgccgccggccccggcgccggccaggccagccccctggagggcagcgaggccgaggaggaggaggacgccgaggaccccagaagacccagactgagagagagagccgccagactgctgcccggcctggccagaagccccgacgcccccgccggcgccctggccagcggcgagccctgcgaggacggcggcggcggccccgtgagaagcccccccggcagccccggcagccccagacccagaagaagaagactggagcccaactgcgccaagcccagaagagccagaaccgccttcacctacgagcagctggtggccctggagaacaagttcagagccaccagatacctgagcgtgtgcgagagactgaacctggccctgagcctgagcctgaccgagacccaggtgaagatctggttccagaacagaagaaccaagtggaagaagcagaaccccggcgccgacggcgccgcccaggtgggcggcggcgccccccagcccggcgccgccggcggcggcggcggcggcggcagcggcggcagccccggcccccccggcaccggcgccctgcacttccagaccttccccagctacagcgccgccaacgtgctgttccccagcgccgccagcttccccctgaccgccgccgcccccggcagccccttcgcccccttcctgggccccagctacctgacccccttctacgcccccagactgtag

SEQ ID NO: 22786 - DNA, 933 bp, Artificial Sequence
  Description of Artificial Sequence: Synthetic coding sequence
atgctggcctggcaggacggcggcgccaaggccgcccccagccaccacaagatcagcttcagcgtgctggacatcctggacccccagaagttcaccagagccgccctgcccgccgtgagacccgcccccagagaggccagaaagagcctggccgaggtggaggccggcaaggacgccagcagcagagaccccgtgagacagctggagacccccgacgccgccggccccggcgccggccaggccagccccctggagggcagcgaggccgaggaggaggaggacgccgaggaccccagaagacccagactgagagagagagccgccagactgctgcccggcctggccagaagccccgacgcccccgccggcgccctggccagcggcgagccctgcgaggacggcggcggcggccccgtgagaagcccccccggcagccccggcagccccagacccagaagaagaagactggagcccaactgcgccaagcccagaagagccagaaccgccttcacctacgagcagctggtggccctggagaacaagttcagagccaccagatacctgagcgtgtgcgagagactgaacctggccctgagcctgagcctgaccgagacccaggtgaagatctggttccagaacagaagaaccaagtggaagaagcagaaccccggcgccgacggcgccgcccaggtgggcggcggcgccccccagcccggcgccgccggcggcggcggcggcggcggcagcggcggcagccccggcccccccggcaccggcgccctgcacttccagaccttccccagctacagcgccgccaacgtgctgttccccagcgccgccagcttccccctgaccgccgccgcccccggcagccccttcgcccccttcctgggccccagctacctgacccccttctacgcccccagactgtag

SEQ ID NO: 22787 - DNA, 114 bp, Artificial Sequence
  Description of Artificial Sequence: Synthetic coding sequence
gaggagtggatcacctacagcaacagctgctactacatcggcaaggagagaagaacctgggaggagagagtgtgctggcccgtgctgagaagaaccctgatctgcttcctgtag

SEQ ID NO: 22788 - DNA, 3123 bp, Artificial Sequence
  Description of Artificial Sequence: Synthetic coding sequence
atggtgagcagcgcccagatgggcttcaacctgcaggccctgctggagcagctgagccaggacgagctgagcaagttcaagtacctgatcaccaccttcagcctggcccacgagctgcagaagatcccccacaaggaggtggacaaggccgacggcaagcagctggtggagatcctgaccacccactgcgacagctactgggtggagatggccagcctgcaggtgttcgagaagatgcacagaatggacctgagcgagagagccaaggacgaggtgagagaggccgccctgaagagcttcaacaagagaaagcccctgagcctgggcatcaccagaaaggagagaccccccctggacgtggacgagatgctggagagattcaagaccgaggcccaggacaaggacaacagatgcagatacatcctgaagaccaagttcagagagatgtggaagagctggcccggcgacagcaaggaggtgcaggtgatggccgagagatacaagatgctgatccccttcagcaaccccagagtgctgcccggccccttcagctacaccgtggtgctgtacggccccgccggcctgggcaagaccaccctggcccagaagctgatgctggactgggccgaggacaacctgatccacaagttcaagtacgccttctacctgagctgcagagagctgagcagactgggcccctgcagcttcgccgagctggtgttcagagactggcccgagctgcaggacgacatcccccacatcctggcccaggccagaaagatcctgttcgtgatcgacggcttcgacgagctgggcgccgcccccggcgccctgatcgaggacatctgcggcgactgggagaagaagaagcccgtgcccgtgctgctgggcagcctgctgaacagagtgatgctgcccaaggccgccctgctggtgaccaccagacccagagccctgagagacctgagaatcctggccgaggagcccatctacatcagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagaccagcgtgctgcacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacaccctggagaaggaggaggaggaggacagagacggccacacctgggacatcggcgacgtgcagaagctgctgagcggcgtggagagactgagaaaccccgacctgatccaggccggctactacagcttcggcctggccaacgagaagagagccaaggagctggaggccaccttcggctgcagaatgagccccgacatcaagcaggagctgctgagatgcgacatcagctgcaagggcggccacagcaccgtgaccgacctgcaggagctgctgggctgcctgtacgagagccaggaggaggagctggtgaaggaggtgatggcccagttcaaggagatcagcctgcacctgaacgccgtggacgtggtgcccagcagcttctgcgtgaagcactgcagaaacctgcagaagatgagcctgcaggtgatcaaggagaacctgcccgagaacgtgaccgccagcgagagcgacgccgaggtggagagaagccaggacgaccagcacatgctgcccttctggaccgacctgtgcagcatcttcggcagcaacaaggacctgatgggcctggccatcaacgacagcttcctgagcgccagcctggtgagaatcctgtgcgagcagatcgccagcgacacctgccacctgcagagagtggtgttcaagaacatcagccccgccgacgcccacagaaacctgtgcctggccctgagaggccacaagaccgtgacctacctgaccctgcagggcaacgaccaggacgacatgttccccgccctgtgcgaggtgctgagacaccccgagtgcaacctgagatacctgggcctggtgagctgcagcgccaccacccagcagtgggccgacctgagcctggccctggaggtgaaccagagcctgacctgcgtgaacctgagcgacaacgagctgctggacgagggcgccaagctgctgtacaccaccctgagacaccccaagtgcttcctgcagagactgagcctggagaactgccacctgaccgaggccaactgcaaggacctggccgccgtgctggtggtgagcagagagctgacccacctgtgcctggccaagaaccccatcggcaacaccggcgtgaagttcctgtgcgagggcctgagataccccgagtgcaagctgcagaccctggtgctgtggaactgcgacatcaccagcgacggctgctgcgacctgaccaagctgctgcaggagaagagcagcctgctgtgcctggacctgggcctgaaccacatcggcgtgaagggcatgaagttcctgtgcgaggccctgagaaagcccctgtgcaacctgagatgcctgtggctgtggggctgcagcatcccccccttcagctgcgaggacctgtgcagcgccctgagctgcaaccagagcctggtgaccctggacctgggccagaaccccctgggcagcagcggcgtgaagatgctgttcgagaccctgacctgcagcagcggcaccctgagaaccctgagactgaagatcgacgacttcaacgacgagctgaacaagctgctggaggagatcgaggagaagaacccccagctgatcatcgacaccgagaagcaccacccctgggccgagagacccagcagccacgacttcatgatctag

SEQ ID NO: 22789 - DNA, 3189 bp, Artificial Sequence
  Description of Artificial Sequence: Synthetic coding sequence
atggtgagcagcgcccagatgggcttcaacctgcaggccctgctggagcagctgagccaggacgagctgagcaagttcaagtacctgatcaccaccttcagcctggcccacgagctgcagaagatcccccacaaggaggtggacaaggccgacggcaagcagctggtggagatcctgaccacccactgcgacagctactgggtggagatggccagcctgcaggtgttcgagaagatgcacagaatggacctgagcgagagagccaaggacgaggtgagagaggccgccctgaagagcttcaacaagagaaagcccctgagcctgggcatcaccagaaaggagagaccccccctggacgtggacgagatgctggagagattcaagaccgaggcccaggccttcaccgagaccaagggcaacgtgatctgcctgggcaaggaggtgttcaagggcaagaagcccgacaaggacaacagatgcagatacatcctgaagaccaagttcagagagatgtggaagagctggcccggcgacagcaaggaggtgcaggtgatggccgagagatacaagatgctgatccccttcagcaaccccagagtgctgcccggccccttcagctacaccgtggtgctgtacggccccgccggcctgggcaagaccaccctggcccagaagctgatgctggactgggccgaggacaacctgatccacaagttcaagtacgccttctacctgagctgcagagagctgagcagactgggcccctgcagcttcgccgagctggtgttcagagactggcccgagctgcaggacgacatcccccacatcctggcccaggccagaaagatcctgttcgtgatcgacggcttcgacgagctgggcgccgcccccggcgccctgatcgaggacatctgcggcgactgggagaagaagaagcccgtgcccgtgctgctgggcagcctgctgaacagagtgatgctgcccaaggccgccctgctggtgaccaccagacccagagccctgagagacctgagaatcctggccgaggagcccatctacatcagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagaccagcgtgctgcacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacaccctggagaaggaggaggaggaggacagagacggccacacctgggacatcggcgacgtgcagaagctgctgagcggcgtggagagactgagaaaccccgacctgatccaggccggctactacagcttcggcctggccaacgagaagagagccaaggagctggaggccaccttcggctgcagaatgagccccgacatcaagcaggagctgctgagatgcgacatcagctgcaagggcggccacagcaccgtgaccgacctgcaggagctgctgggctgcctgtacgagagccaggaggaggagctggtgaaggaggtgatggcccagttcaaggagatcagcctgcacctgaacgccgtggacgtggtgcccagcagcttctgcgtgaagcactgcagaaacctgcagaagatgagcctgcaggtgatcaaggagaacctgcccgagaacgtgaccgccagcgagagcgacgccgaggtggagagaagccaggacgaccagcacatgctgcccttctggaccgacctgtgcagcatcttcggcagcaacaaggacctgatgggcctggccatcaacgacagcttcctgagcgccagcctggtgagaatcctgtgcgagcagatcgccagcgacacctgccacctgcagagagtggtgttcaagaacatcagccccgccgacgcccacagaaacctgtgcctggccctgagaggccacaagaccgtgacctacctgaccctgcagggcaacgaccaggacgacatgttccccgccctgtgcgaggtgctgagacaccccgagtgcaacctgagatacctgggcctggtgagctgcagcgccaccacccagcagtgggccgacctgagcctggccctggaggtgaaccagagcctgacctgcgtgaacctgagcgacaacgagctgctggacgagggcgccaagctgctgtacaccaccctgagacaccccaagtgcttcctgcagagactgagcctggagaactgccacctgaccgaggccaactgcaaggacctggccgccgtgctggtggtgagcagagagctgacccacctgtgcctggccaagaaccccatcggcaacaccggcgtgaagttcctgtgcgagggcctgagataccccgagtgcaagctgcagaccctggtgctgtggaactgcgacatcaccagcgacggctgctgcgacctgaccaagctgctgcaggagaagagcagcctgctgtgcctggacctgggcctgaaccacatcggcgtgaagggcatgaagttcctgtgcgaggccctgagaaagcccctgtgcaacctgagatgcctgtggctgtggggctgcagcatcccccccttcagctgcgaggacctgtgcagcgccctgagctgcaaccagagcctggtgaccctggacctgggccagaaccccctgggcagcagcggcgtgaagatgctgttcgagaccctgacctgcagcagcggcaccctgagaaccctgagactgaagatcgacgacttcaacgacgagctgaacaagctgctggaggagatcgaggagaagaacccccagctgatcatcgacaccgagaagcaccacccctgggccgagagacccagcagccacgacttcatgatctag

SEQ ID NO: 22790 - DNA, 3189 bp, Artificial Sequence; identical to SEQ ID NO: 22789
  Description of Artificial Sequence: Synthetic coding sequence

SEQ ID NO: 22791 - DNA, 3189 bp, Artificial Sequence; identical to SEQ ID NO: 22789
  Description of Artificial Sequence: Synthetic coding sequence

SEQ ID NO: 22792 - DNA, 3189 bp, Artificial Sequence; identical to SEQ ID NO: 22789
  Description of Artificial Sequence: Synthetic coding sequence

SEQ ID NO: 22793 - DNA, 3189 bp, Artificial Sequence; identical to SEQ ID NO: 22789
  Description of Artificial Sequence: Synthetic coding sequence

SEQ ID NO: 22794 - DNA, 3123 bp, Artificial Sequence; identical to SEQ ID NO: 22788
  Description of Artificial Sequence: Synthetic coding sequence

SEQ ID NO: 22795 - DNA, 3189 bp, Artificial Sequence; identical to SEQ ID NO: 22789
  Description of Artificial Sequence: Synthetic coding sequence

SEQ ID NO: 22796 - DNA, 3189 bp, Artificial Sequence; identical to SEQ ID NO: 22789
  Description of Artificial Sequence: Synthetic coding sequence

SEQ ID NO: 22797 - DNA, 3189 bp, Artificial Sequence; identical to SEQ ID NO: 22789
  Description of Artificial Sequence: Synthetic coding sequence

SEQ ID NO: 22798 - DNA, 3189 bp, Artificial Sequence; identical to SEQ ID NO: 22789
  Description of Artificial Sequence: Synthetic coding sequence

SEQ ID NO: 22799 - DNA, 3123 bp, Artificial Sequence; identical to SEQ ID NO: 22788
  Description of Artificial Sequence: Synthetic coding sequence

SEQ ID NO: 22800 - DNA, 3123 bp, Artificial Sequence; identical to SEQ ID NO: 22788
  Description of Artificial Sequence: Synthetic coding sequence

SEQ ID NO: 22801 - DNA, 3189 bp, Artificial Sequence; identical to SEQ ID NO: 22789
  Description of Artificial Sequence: Synthetic coding sequence

SEQ ID NO: 22802 - DNA, 3123 bp, Artificial Sequence; identical to SEQ ID NO: 22788
  Description of Artificial Sequence: Synthetic coding sequence

SEQ ID NO: 22803 - DNA, 3189 bp, Artificial Sequence; identical to SEQ ID NO: 22789
  Description of Artificial Sequence: Synthetic coding sequence

SEQ ID NO: 22804 - DNA, 3189 bp, Artificial Sequence; identical to SEQ ID NO: 22789
  Description of Artificial Sequence: Synthetic coding sequence

SEQ ID NO: 22805 - DNA, 3189 bp, Artificial Sequence; identical to SEQ ID NO: 22789
  Description of Artificial Sequence: Synthetic coding sequence

SEQ ID NO: 22806 - DNA, 3123 bp, Artificial Sequence; identical to SEQ ID NO: 22788
  Description of Artificial Sequence: Synthetic coding sequence

SEQ ID NO: 22807 - DNA, 3123 bp, Artificial Sequence; identical to SEQ ID NO: 22788
  Description of Artificial Sequence: Synthetic coding sequence

SEQ ID NO: 22808 - DNA, 3189 bp, Artificial Sequence; identical to SEQ ID NO: 22789
  Description of Artificial Sequence: Synthetic coding sequence

SEQ ID NO: 22809 - DNA, 2943 bp, Artificial Sequence
  Description of Artificial Sequence: Synthetic coding sequence
atgaccagcccccagctggagtggaccctgcagaccctgctggagcagctgaacgaggacgagctgaagagcttcaagagcctgctgtgggccttccccctggaggacgtgctgcagaagaccccctggagcgaggtggaggaggccgacggcaagaagctggccgagatcctggtgaacaccagcagcgagaactggatcagaaacgccaccgtgaacatcctggaggagatgaacctgaccgagctgtgcaagatggccaaggccgagatgatggaggacggccaggtgcaggagatcgacaaccccgagctgggcgacgccgaggaggacagcgagctggccaagcccggcgagaaggagggctggagaaacagcatggagaagcagagcctggtgtggaagaacaccttctggcagggcgacatcgacaacttccacgacgacgtgaccctgagaaaccagagattcatccccttcctgaaccccagaacccccagaaagctgaccccctacaccgtggtgctgcacggccccgccggcgtgggcaagaccaccctggccaagaagtgcatgctggactggaccgactgcaacctgagccccaccctgagatacgccttctacctgagctgcaaggagctgagcagaatgggcccctgcagcttcgccgagctgatcagcaaggactggcccgagctgcaggacgacatccccagcatcctggcccaggcccagagaatcctgttcgtggtggacggcctggacgagctgaaggtgccccccggcgccctgatccaggacatctgcggcgactgggagaagaagaagcccgtgcccgtgctgctgggcagcctgctgaagagaaagatgctgcccagagccgccctgctggtgaccaccagacccagagccctgagagacctgcagctgctggcccagcagcccatctacgtgagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagatgagcgtgttccacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacgccctggagaaggaggagggcgaggacagagacggccacgcctgggacatcggcgacgtgcagaagctgctgagcggcgaggagagactgaagaaccccgacctgatccaggtgggccacttcctgttcggcctggccaacgagaagagagccaaggagctggaggccaccttcggctgcagaatgagccccgacatcaagcaggagctgctgcagtgcaaggcccacctgcacgccaacaagcccctgagcgtgaccgacctgaaggaggtgctgggctgcctgtacgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtgttcctggagaactacatggacttcgagctggacatcgagttcgagagatgcacctacctgaccatccccaactgggccagacaggacctgagaagcctgagactgtggaccgacttctgcagcctgttcagcagcaacagcaacctgaagttcctggaggtgaagcagagcttcctgagcgacagcagcgtgagaatcctgtgcgaccacgtgaccagaagcacctgccacctgcagaaggtggagatcaagaacgtgacccccgacaccgcctacagagacttctgcctggccttcatcggcaagaagaccctgacccacctgaccctggccggccacatcgagtgggagagaaccatgatgctgatgctgtgcgacctgctgagaaaccacaagtgcaacctgcagtacctgagactgggcggccactgcgccacccccgagcagtgggccgagttcttctacgtgctgaaggccaaccagagcctgaagcacctgagactgagcgccaacgtgctgctggacgagggcgccatgctgctgtacaagaccatgaccagacccaagcacttcctgcagatgctgagcctggagaactgcagactgaccgaggccagctgcaaggacctggccgccgtgctggtggtgagcaagaagctgacccacctgtgcctggccaagaaccccatcggcgacaccggcgtgaagttcctgtgcgagggcctgagctaccccgactgcaagctgcagaccctggtgctgcagcagtgcagcatcaccaagctgggctgcagatacctgagcgaggccctgcaggaggcctgcagcctgaccaacctggacctgagcatcaaccagatcgccagaggcctgtggatcctgtgccaggccctggagaaccccaactgcaacctgaagcacctgagactgaagacctacgagaccaacctggagatcaagaagctgctggaggaggtgaaggagaagaaccccaagctgaccatcgactgcaacgccagcggcgccaccgcccccccctgctgcgacttcttctgctag

SEQ ID NO: 22810 - DNA, 3030 bp, Artificial Sequence
  Description of Artificial Sequence: Synthetic coding sequence
atgaccagcccccagctggagtggaccctgcagaccctgctggagcagctgaacgaggacgagctgaagagcttcaagagcctgctgtgggccttccccctggaggacgtgctgcagaagaccccctggagcgaggtggaggaggccgacggcaagaagctggccgagatcctggtgaacaccagcagcgagaactggatcagaaacgccaccgtgaacatcctggaggagatgaacctgaccgagctgtgcaagatggccaaggccgagatgatggaggacggccaggtgcaggagatcgacaaccccgagctgggcgacgccgaggaggacagcgagctggccaagcccggcgagaaggagggctggagaaacagcatggagaagcagagcctggtgtggaagaacaccttctggcagggcgacatcgacaacttccacgacgacgtgaccctgagaaaccagagattcatccccttcctgaaccccagaacccccagaaagctgaccccctacaccgtggtgctgcacggccccgccggcgtgggcaagaccaccctggccaagaagtgcatgctggactggaccgactgcaacctgagccccaccctgagatacgccttctacctgagctgcaaggagctgagcagaatgggcccctgcagcttcgccgagctgatcagcaaggactggcccgagctgcaggacgacatccccagcatcctggcccaggcccagagaatcctgttcgtggtggacggcctggacgagctgaaggtgccccccggcgccctgatccaggacatctgcggcgactgggagaagaagaagcccgtgcccgtgctgctgggcagcctgctgaagagaaagatgctgcccagagccgccctgctggtgaccaccagacccagagccctgagagacctgcagctgctggcccagcagcccatctacgtgagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagatgagcgtgttccacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacgccctggagaaggaggagggcgaggacagagacggccacgcctgggacatcggcgacgtgcagaagctgctgagcggcgaggagagactgaagaaccccgacctgatccaggtgggccacttcctgttcggcctggccaacgagaagagagccaaggagctggaggccaccttcggctgcagaatgagccccgacatcaagcaggagctgctgcagtgcaaggcccacctgcacgccaacaagcccctgagcgtgaccgacctgaaggaggtgctgggctgcctgtacgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtgttcctggagaactacatggacttcgagctggacatcgagttcgagagcagcaacagcaacctgaagttcctggaggtgaagcagagcttcctgagcgacagcagcgtgagaatcctgtgcgaccacgtgaccagaagcacctgccacctgcagaaggtggagatcaagaacgtgacccccgacaccgcctacagagacttctgcctggccttcatcggcaagaagaccctgacccacctgaccctggccggccacatcgagtgggagagaaccatgatgctgatgctgtgcgacctgctgagaaaccacaagtgcaacctgcagtacctgagactgggcggccactgcgccacccccgagcagtgggccgagttcttctacgtgctgaaggccaaccagagcctgaagcacctgagactgagcgccaacgtgctgctggacgagggcgccatgctgctgtacaagaccatgaccagacccaagcacttcctgcagatgctgagcctggagaactgcagactgaccgaggccagctgcaaggacctggccgccgtgctggtggtgagcaagaagctgacccacctgtgcctggccaagaaccccatcggcgacaccggcgtgaagttcctgtgcgagggcctgagctaccccgactgcaagctgcagaccctggtgctgcagcagtgcagcatcaccaagctgggctgcagatacctgagcgaggccctgcaggaggcctgcagcctgaccaacctggacctgagcatcaaccagatcgccagaggcctgtggatcctgtgccaggccctggagaaccccaactgcaacctgaagcacctgagactgtggagctgcagcctgatgcccttctactgccagcacctgggcagcgccctgctgagcaaccagaagctggagaccctggacctgggccagaaccacctgtggaagagcggcatcatcaagctgttcggcgtgctgagacagagaaccggcagcctgaagatcctgagactgaagacctacgagaccaacctggagatcaagaagctgctggaggaggtgaaggagaagaaccccaagctgaccatcgactgcaacgccagcggcgccaccgcccccccctgctgcgacttcttctgctag

SEQ ID NO: 22811 - DNA, 3198 bp, Artificial Sequence
  Description of Artificial Sequence: Synthetic coding sequence
atgagcagaaagcacagactggaggccagacccgacctgagagagttcttcagcctgaacctgagaagccacaccagaagcaccatgaccagcccccagctggagtggaccctgcagaccctgctggagcagctgaacgaggacgagctgaagagcttcaagagcctgctgtgggccttccccctggaggacgtgctgcagaagaccccctggagcgaggtggaggaggccgacggcaagaagctggccgagatcctggtgaacaccagcagcgagaactggatcagaaacgccaccgtgaacatcctggaggagatgaacctgaccgagctgtgcaagatggccaaggccgagatgatggaggacggccaggtgcaggagatcgacaaccccgagctgggcgacgccgaggaggacagcgagctggccaagcccggcgagaaggagggctggagaaacagcatggagaagcagagcctggtgtggaagaacaccttctggcagggcgacatcgacaacttccacgacgacgtgaccctgagaaaccagagattcatccccttcctgaaccccagaacccccagaaagctgaccccctacaccgtggtgctgcacggccccgccggcgtgggcaagaccaccctggccaagaagtgcatgctggactggaccgactgcaacctgagccccaccctgagatacgccttctacctgagctgcaaggagctgagcagaatgggcccctgcagcttcgccgagctgatcagcaaggactggcccgagctgcaggacgacatccccagcatcctggcccaggcccagagaatcctgttcgtggtggacggcctggacgagctgaaggtgccccccggcgccctgatccaggacatctgcggcgactgggagaagaagaagcccgtgcccgtgctgctgggcagcctgctgaagagaaagatgctgcccagagccgccctgctggtgaccaccagacccagagccctgagagacctgcagctgctggcccagcagcccatctacgtgagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagatgagcgtgttccacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacgccctggagaaggaggagggcgaggacagagacggccacgcctgggacatcggcgacgtgcagaagctgctgagcggcgaggagagactgaagaaccccgacctgatccaggtgggccacttcctgttcggcctggccaacgagaagagagccaaggagctggaggccaccttcggctgcagaatgagccccgacatcaagcaggagctgctgcagtgcaaggcccacctgcacgccaacaagcccctgagcgtgaccgacctgaaggaggtgctgggctgcctgtacgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtgttcctggagaactacatggacttcgagctggacatcgagttcgagagatgcacctacctgaccatccccaactgggccagacaggacctgagaagcctgagactgtggaccgacttctgcagcctgttcagcagcaacagcaacctgaagttcctggaggtgaagcagagcttcctgagcgacagcagcgtgagaatcctgtgcgaccacgtgaccagaagcacctgccacctgcagaaggtggagatcaagaacgtgacccccgacaccgcctacagagacttctgcctggccttcatcggcaagaagaccctgacccacctgaccctggccggccacatcgagtgggagagaaccatgatgctgatgctgtgcgacctgctgagaaaccacaagtgcaacctgcagtacctgagactgggcggccactgcgccacccccgagcagtgggccgagttcttctacgtgctgaaggccaaccagagcctgaagcacctgagactgagcgccaacgtgctgctggacgagggcgccatgctgctgtacaagaccatgaccagacccaagcacttcctgcagatgctgagcctggagaactgcagactgaccgaggccagctgcaaggacctggccgccgtgctggtggtgagcaagaagctgacccacctgtgcctggccaagaaccccatcggcgacaccggcgtgaagttcctgtgcgagggcctgagctaccccgactgcaagctgcagaccctggtgctgcagcagtgcagcatcaccaagctgggctgcagatacctgagcgaggccctgcaggaggcctgcagcctgaccaacctggacctgagcatcaaccagatcgccagaggcctgtggatcctgtgccaggccctggagaaccccaactgcaacctgaagcacctgagactgtggagctgcagcctgatgcccttctactgccagcacctgggcagcgccctgctgagcaaccagaagctggagaccctggacctgggccagaaccacctgtggaagagcggcatcatcaagctgttcggcgtgctgagacagagaaccggcagcctgaagatcctgagactgaagacctacgagaccaacctggagatcaagaagctgctggaggaggtgaaggagaagaaccccaagctgaccatcgactgcaacgccagcggcgccaccgcccccccctgctgcgacttcttctgctag

SEQ ID NO: 22812 - DNA, 3030 bp, Artificial Sequence; identical to SEQ ID NO: 22810
  Description of Artificial Sequence: Synthetic coding sequence

SEQ ID NO: 22813 - DNA, 3198 bp, Artificial Sequence; identical to SEQ ID NO: 22811
  Description of Artificial Sequence: Synthetic coding sequence

SEQ ID NO: 22814 - DNA, 3030 bp, Artificial Sequence; identical to SEQ ID NO: 22810
  Description of Artificial Sequence: Synthetic coding sequence

SEQ ID NO: 22815 - DNA, 3198 bp, Artificial Sequence; identical to SEQ ID NO: 22811
  Description of Artificial Sequence: Synthetic coding sequence

SEQ ID NO: 22816 - DNA, 2943 bp, Artificial Sequence; identical to SEQ ID NO: 22809
  Description of Artificial Sequence: Synthetic coding sequence

SEQ ID NO: 22817 - DNA, 3030 bp, Artificial Sequence; identical to SEQ ID NO: 22810
  Description of Artificial Sequence: Synthetic coding sequence

SEQ ID NO: 22818 - DNA, 2943 bp, Artificial Sequence; identical to SEQ ID NO: 22809
  Description of Artificial Sequence: Synthetic coding sequence

SEQ ID NO: 22819 - DNA, 2943 bp, Artificial Sequence; identical to SEQ ID NO: 22809
  Description of Artificial Sequence: Synthetic coding sequence

SEQ ID NO: 22820 - DNA, 2943 bp, Artificial Sequence; identical to SEQ ID NO: 22809
  Description of Artificial Sequence: Synthetic coding sequence

SEQ ID NO: 22821 - DNA, 3198 bp, Artificial Sequence; identical to SEQ ID NO: 22811
  Description of Artificial Sequence: Synthetic coding sequence

SEQ ID NO: 22822 - DNA, 3198 bp, Artificial Sequence; identical to SEQ ID NO: 22811
  Description of Artificial Sequence: Synthetic coding sequence

SEQ ID NO: 22823 - DNA, 2943 bp, Artificial Sequence; identical to SEQ ID NO: 22809
  Description of Artificial Sequence: Synthetic coding sequence

SEQ ID NO: 22824 - DNA, 3030 bp, Artificial Sequence; identical to SEQ ID NO: 22810
  Description of Artificial Sequence: Synthetic coding sequence

SEQ ID NO: 22825 - DNA, 3030 bp, Artificial Sequence; identical to SEQ ID NO: 22810
  Description of Artificial Sequence: Synthetic coding sequence

SEQ ID NO: 22826 - DNA, 3198 bp, Artificial Sequence; identical to SEQ ID NO: 22811
  Description of Artificial Sequence: Synthetic coding sequence

SEQ ID NO: 22827 - DNA, 3114 bp, Artificial Sequence
  Description of Artificial Sequence: Synthetic coding sequence
atgaccagcccccagctggagtggaccctgcagaccctgctggagcagctgaacgaggacgagctgaagagcttcaagagcctgctgtgggccttccccctggaggacgtgctgcagaagaccccctggagcgaggtggaggaggccgacggcaagaagctggccgagatcctggtgaacaccagcagcgagaactggatcagaaacgccaccgtgaacatcctggaggagatgaacctgaccgagctgtgcaagatggccaaggccgagatgatggaggacggccaggtgcaggagatcgacaaccccgagctgggcgacgccgaggaggacagcgagctggccaagcccggcgagaaggagggctggagaaacagcatggagaagcagagcctggtgtggaagaacaccttctggcagggcgacatcgacaacttccacgacgacgtgaccctgagaaaccagagattcatccccttcctgaaccccagaacccccagaaagctgaccccctacaccgtggtgctgcacggccccgccggcgtgggcaagaccaccctggccaagaagtgcatgctggactggaccgactgcaacctgagccccaccctgagatacgccttctacctgagctgcaaggagctgagcagaatgggcccctgcagcttcgccgagctgatcagcaaggactggcccgagctgcaggacgacatccccagcatcctggcccaggcccagagaatcctgttcgtggtggacggcctggacgagctgaaggtgccccccggcgccctgatccaggacatctgcggcgactgggagaagaagaagcccgtgcccgtgctgctgggcagcctgctgaagagaaagatgctgcccagagccgccctgctggtgaccaccagacccagagccctgagagacctgcagctgctggcccagcagcccatctacgtgagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagatgagcgtgttccacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacgccctggagaaggaggagggcgaggacagagacggccacgcctgggacatcggcgacgtgcagaagctgctgagcggcgaggagagactgaagaaccccgacctgatccaggtgggccacttcctgttcggcctggccaacgagaagagagccaaggagctggaggccaccttcggctgcagaatgagccccgacatcaagcaggagctgctgcagtgcaaggcccacctgcacgccaacaagcccctgagcgtgaccgacctgaaggaggtgctgggctgcctgtacgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtgttcctggagaactacatggacttcgagctggacatcgagttcgagagatgcacctacctgaccatccccaactgggccagacaggacctgagaagcctgagactgtggaccgacttctgcagcctgttcagcagcaacagcaacctgaagttcctggaggtgaagcagagcttcctgagcgacagcagcgtgagaatcctgtgcgaccacgtgaccagaagcacctgccacctgcagaaggtggagatcaagaacgtgacccccgacaccgcctacagagacttctgcctggccttcatcggcaagaagaccctgacccacctgaccctggccggccacatcgagtgggagagaaccatgatgctgatgctgtgcgacctgctgagaaaccacaagtgcaacctgcagtacctgagactgggcggccactgcgccacccccgagcagtgggccgagttcttctacgtgctgaaggccaaccagagcctgaagcacctgagactgagcgccaacgtgctgctggacgagggcgccatgctgctgtacaagaccatgaccagacccaagcacttcctgcagatgctgagcctggagaactgcagactgaccgaggccagctgcaaggacctggccgccgtgctggtggtgagcaagaagctgacccacctgtgcctggccaagaaccccatcggcgacaccggcgtgaagttcctgtgcgagggcctgagctaccccgactgcaagctgcagaccctggtgctgcagcagtgcagcatcaccaagctgggctgcagatacctgagcgaggccctgcaggaggcctgcagcctgaccaacctggacctgagcatcaaccagatcgccagaggcctgtggatcctgtgccaggccctggagaaccccaactgcaacctgaagcacctgagactgtggagctgcagcctgatgcccttctactgccagcacctgggcagcgccctgctgagcaaccagaagctggagaccctggacctgggccagaaccacctgtggaagagcggcatcatcaagctgttcggcgtgctgagacagagaaccggcagcctgaagatcctgagactgaagacctacgagaccaacctggagatcaagaagctgctggaggaggtgaaggagaagaaccccaagctgaccatcgactgcaacgccagcggcgccaccgcccccccctgctgcgacttcttctgctag

SEQ ID NO: 22828 - DNA, 3114 bp, Artificial Sequence; identical to SEQ ID NO: 22827
  Description of Artificial Sequence: Synthetic coding sequence

SEQ ID NO: 22829 - DNA, 3114 bp, Artificial Sequence; identical to SEQ ID NO: 22827
  Description of Artificial Sequence: Synthetic coding sequence

SEQ ID NO: 22830 - DNA, 3114 bp, Artificial Sequence; identical to SEQ ID NO: 22827
  Description of Artificial Sequence: Synthetic coding sequence

SEQ ID NO: 22831 - DNA, 3114 bp, Artificial Sequence; identical to SEQ ID NO: 22827
  Description of Artificial Sequence: Synthetic coding sequence

SEQ ID NO: 22832 - DNA, 3114 bp, Artificial Sequence; identical to SEQ ID NO: 22827
  Description of Artificial Sequence: Synthetic coding sequence

SEQ ID NO: 22833 - DNA, 3114 bp, Artificial Sequence; identical to SEQ ID NO: 22827
  Description of Artificial Sequence: Synthetic coding sequence

SEQ ID NO: 22834 - DNA, 1080 bp, Artificial Sequence
  Description of Artificial Sequence: Synthetic coding sequence
atgaacttcatcaaggacaacagcagagccctgatccagagaatgggcatgaccgtgatcaagcagatcaccgacgacctgttcgtgtggaacgtgctgaacagagaggaggtgaacatcatctgctgcgagaaggtggagcaggacgccgccagaggcatcatccacatgatcctgaagaagggcagcgagagctgcaacctgttcctgaagagcctgaaggagtggaactaccccctgttccaggacctgaacggccagagcggcctgaccgacagcctgggcaacctgaagaacctgaccaagctgatcatggacaacatcaagatgaacgaggaggacgccatcaagctggccgagggcctgaagaacctgaagaagatgtgcctgttccacctgacccacctgagcgacatcggcgagggcatggactacatcgtgaagagcctgagcagcgagccctgcgacctggaggagatccagctggtgagctgctgcctgagcgccaacgccgtgaagatcctggcccagaacctgcacaacctggtgaagctgagcatcctggacctgagcgagaactacctggagaaggacggcaacgaggccctgcacgagctgatcgacagaatgaacgtgctggagcagctgaccgccctgatgctgccctggggctgcgacgtgcagggcagcctgagcagcctgctgaagcacctggaggaggtgccccagctggtgaagctgggcctgaagaactggagactgaccgacaccgagatcagaatcctgggcgccttcttcggcaagaaccccctgaagaacttccagcagctgaacctggccggcaacagagtgagcagcgacggctggctggccttcatgggcgtgttcgagaacctgaagcagctggtgttcttcgacttcagcaccaaggagttcctgcccgaccccgccctggtgagaaagctgagccaggtgctgagcaagctgaccttcctgcaggaggccagactggtgggctggcagttcgacgacgacgacctgagcgtgatcaccggcgccttcaagctggtgaccgcctag

SEQ ID NO: 22835 - DNA, 5514 bp, Artificial Sequence
  Description of Artificial Sequence: Synthetic coding sequence
atggaccccgtgggcctgcagctgggcaacaagaacctgtggagctgcctggtgagactgctgaccaaggaccccgagtggctgaacgccaagatgaagttcttcctgcccaacaccgacctggacagcagaaacgagaccctggaccccgagcagagagtgatcctgcagctgaacaagctgcacgtgcagggcagcgacacctggcagagcttcatccactgcgtgtgcatgcagctggaggtgcccctggacctggaggtgctgctgctgagcaccttcggctacgacgacggcttcaccagccagctgggcgccgagggcaagagccagcccgagagccagctgcaccacggcctgaagagaccccaccagagctgcggcagcagccccagaagaaagcagtgcaagaagcagcagctggagctggccaagaagtacctgcagctgctgagaaccagcgcccagcagagatacagaagccagatccccggcagcggccagccccacgccttccaccaggtgtacgtgccccccatcctgagaagagccaccgccagcctggacacccccgagggcgccatcatgggcgacgtgaaggtggaggacggcgccgacgtgagcatcagcgacctgttcaacaccagagtgaacaagggccccagagtgaccgtgctgctgggcaaggccggcatgggcaagaccaccctggcccacagactgtgccagaagtgggccgagggccacctgaactgcttccaggccctgttcctgttcgagttcagacagctgaacctgatcaccagattcctgacccccagcgagctgctgttcgacctgtacctgagccccgagagcgaccacgacaccgtgttccagtacctggagaagaacgccgaccaggtgctgctgatcttcgacggcctggacgaggccctgcagcccatgggccccgacggccccggccccgtgctgaccctgttcagccacctgtgcaacggcaccctgctgcccggctgcagagtgatggccaccagcagacccggcaagctgcccgcctgcctgcccgccgaggccgccatggtgcacatgctgggcttcgacggccccagagtggaggagtacgtgaaccacttcttcagcgcccagcccagcagagagggcgccctggtggagctgcagaccaacggcagactgagaagcctgtgcgccgtgcccgccctgtgccaggtggcctgcctgtgcctgcaccacctgctgcccgaccacgcccccggccagagcgtggccctgctgcccaacatgacccagctgtacatgcagatggtgctggccctgagcccccccggccacctgcccaccagcagcctgctggacctgggcgaggtggccctgagaggcctggagaccggcaaggtgatcttctacgccaaggacatcgccccccccctgatcgccttcggcgccacccacagcctgctgaccagcttctgcgtgtgcaccggccccggccaccagcagaccggctacgccttcacccacctgagcctgcaggagttcctggccgccctgcacctgatggccagccccaaggtgaacaaggacaccctgacccagtacgtgaccctgcacagcagatgggtgcagagaaccaaggccagactgggcctgagcgaccacctgcccaccttcctggccggcctggccagctgcacctgcagacccttcctgagccacctggcccagggcaacgaggactgcgtgggcgccaagcaggccgccgtggtgcaggtgctgaagaagctggccaccagaaagctgaccggccccaaggtggtggagctgtgccactgcgtggacgagacccaggagcccgagctggccagcctgaccgcccagagcctgccctaccagctgcccttccacaacttccccctgacctgcaccgacctggccaccctgaccaacatcctggagcacagagaggcccccatccacctggacttcgacggctgccccctggagccccactgccccgaggccctggtgggctgcggccagatcgagaacctgagcttcaagagcagaaagtgcggcgacgccttcgccgaggccctgagcagaagcctgcccaccatgggcagactgcagatgctgggcctggccggcagcaagatcaccgccagaggcatcagccacctggtgaaggccctgcccctgtgcccccagctgaaggaggtgagcttcagagacaaccagctgagcgaccaggtggtgctgaacatcgtggaggtgctgccccacctgcccagactgagaaagctggacctgagcagcaacagcatctgcgtgagcaccctgctgtgcctggccagagtggccgtgacctgccccaccgtgagaatgctgcaggccagagaggccgacctgatcttcctgctgagcccccccaccgagaccaccgccgagctgcagagagcccccgacctgcaggagagcgacggccagagaaagggcgcccagagcagaagcctgaccctgagactgcagaagtgccagctgcaggtgcacgacgccgaggccctgatcgccctgctgcaggagggcccccacctggaggaggtggacctgagcggcaaccagctggaggacgagggctgcagactgatggccgaggccgccagccagctgcacatcgccagaaagctggacctgagcaacaacggcctgagcgtggccggcgtgcactgcgtgctgagagccgtgagcgcctgctggaccctggccgagctgcacatcagcctgcagcacaagaccgtgatcttcatgttcgcccaggagcccgaggagcagaagggcccccaggagagagccgccttcctggacagcctgatgctgcagatgcccagcgagctgcccctgagcagcagaagaatgagactgacccactgcggcctgcaggagaagcacctggagcagctgtgcaaggccctgggcggcagctgccacctgggccacctgcacctggacttcagcggcaacgccctgggcgacgagggcgccgccagactggcccagctgctgcccggcctgggcgccctgcagagcctgaacctgagcgagaacggcctgagcctggacgccgtgctgggcctggtgagatgcttcagcaccctgcagtggctgttcagactggacatcagcttcgagagccagcacatcctgctgagaggcgacaagaccagcagagacatgtgggccaccggcagcctgcccgacttccccgccgccgccaagttcctgggcttcagacagagatgcatccccagaagcctgtgcctgagcgagtgccccctggagccccccagcctgaccagactgtgcgccaccctgaaggactgccccggccccctggagctgcagctgagctgcgagttcctgagcgaccagagcctggagaccctgctggactgcctgccccagctgccccagctgagcctgctgcagctgagccagaccggcctgagccccaagagccccttcctgctggccaacaccctgagcctgtgccccagagtgaagaaggtggacctgagaagcctgcaccacgccaccctgcacttcagaagcaacgaggaggaggagggcgtgtgctgcggcctgagcgccaacctgctgggcgacagcggcctgagatgcctgctggagtgcctgccccaggtgcccatcagcggcctgctggacctgagccacaacagcatcagccaggagagcgccctgtacctgctggagaccctgcccagctgccccagagtgagagaggccagcgtgaacctgggcagcgagcagagcttcagaatccacttcagcagagaggaccaggccggcaagaccctgagactgagcgagtgcagcttcagacccgagcacgtgagcagactggccaccggcctgagcaagagcctgcagctgaccgagctgaccctgacccagtgctgcctgggccagaagcagctggccatcctgctgagcctggtgggcagacccgccggcctgttcagcctgagagtgcaggagccctgggccgacagagccagagtgctgagcctgctggaggtgtgcgcccaggccagcggcagcgtgaccgagatcagcatcagcgagacccagcagcagctgtgcgtgcagctggagttccccagacaggaggagaaccccgaggccgtggccctgagactggcccactgcgacctgggcgcccaccacagcctgctggtgggccagctgatggagacctgcgccagactgcagcagctgagcctgagccaggtgaacctgtgcgaggacgacgacgccagcagcctgctgctgcagagcctgctgctgagcctgagcgagctgaagaccttcagactgaccagcagctgcgtgagcaccgagggcctggcccacctggccagcggcctgggccactgccaccacctggaggagctggacctgagcaacaaccagttcgacgaggagggcaccaaggccctgatgagagccctggagggcaagtggatgctgaagagactggacctgagccacctgctgctgaacagcagcaccctggccctgctgacccacagactgagccagatgacctgcctgcagagcctgagactgaacagaaacagcatcggcgacgtgggctgctgccacctgagcgaggccctgagagccgccaccagcctggaggagctggacctgagccacaaccagatcggcgacgccggcgtgcagcacctggccaccatcctgcccggcctgcccgagctgagaaagatcgacctgagcggcaacagcatcagcagcgccggcggcgtgcagctggccgagagcctggtgctgtgcagaagactggaggagctgatgctgggctgcaacgccctgggcgaccccaccgccctgggcctggcccaggagctgccccagcacctgagagtgctgcacctgcccttcagccacctgggccccggcggcgccctgagcctggcccaggccctggacggcagcccccacctggaggagatcagcctggccgagaacaacctggccggcggcgtgctgagattctgcatggagctgcccctgctgagacagatcgacctggtgagctgcaagatcgacaaccagaccgccaagctgctgaccagcagcttcaccagctgccccgccctggaggtgatcctgctgagctggaacctgctgggcgacgaggccgccgccgagctggcccaggtgctgccccagatgggcagactgaagagagtggacctggagaagaaccagatcaccgccctgggcgcctggctgctggccgagggcctggcccagggcagcagcatccaggtgatcagactgtggaacaaccccatcccctgcgacatggcccagcacctgaagagccaggagcccagactggacttcgccttcttcgacaaccagccccaggccccctggggcacctag

SEQ ID NO: 22836 - DNA, 2553 bp, Artificial Sequence
  Description of Artificial Sequence: Synthetic coding sequence
atggccagccccaaggtgaacaaggacaccctgacccagtacgtgaccctgcacagcagatgggtgcagagaaccaaggccagactgggcctgagcgaccacctgcccaccttcctggccggcctggccagctgcacctgcagacccttcctgagccacctggcccagggcaacgaggactgcgtgggcgccaagcaggccgccgtggtgcaggtgctgaagaagctggccaccagaaagctgaccggccccaaggtggtggagctgtgccactgcgtggacgagacccaggagcccgagctggccagcctgaccgcccagagcctgccctaccagctgcccttccacaacttccccctgacctgcaccgacctggccaccctgaccaacatcctggagcacagagaggcccccatccacctggacttcgacggctgccccctggagccccactgccccgaggccctggtgggctgcggccagatcgagaacctgagcttcaagagcagaaagtgcggcgacgccttcgccgaggccctgagcagaagcctgcccaccatgggcagactgcagatgctgggcctggccggcagcaagatcaccgccagaggcatcagccacctggtgaaggccctgcccctgtgcccccagctgaaggaggtgagcttcagagacaaccagctgagcgaccaggtggtgctgaacatcgtggaggtgctgccccacctgcccagactgagaaagctggacctgagcagcaacagcatctgcgtgagcaccctgctgtgcctggccagagtggccgtgacctgccccaccgtgagaatgctgcaggccagagaggccgacctgatcttcctgctgagcccccccaccgagaccaccgccgagctgcagagagcccccgacctgcaggagagcgacggccagagaaagggcgcccagagcagaagcctgaccctgagactgcagaagtgccagctgcaggtgcacgacgccgaggccctgatcgccctgctgcaggagggcccccacctggaggaggtggacctgagcggcaaccagctggaggacgagggctgcagactgatggccgaggccgccagccagctgcacatcgccagaaagctggacctgagcaacaacggcctgagcgtggccggcgtgcactgcgtgctgagagccgtgagcgcctgctggaccctggccgagctgcacatcagcctgcagcacaagaccgtgatcttcatgttcgcccaggagcccgaggagcagaagggcccccaggagagagccgccttcctggacagcctgatgctgcagatgcccagcgagctgcccctgagcagcagaagaatgagactgacccactgcggcctgcaggagaagcacctggagcagctgtgcaaggccctgggcggcagctgccacctgggccacctgcacctggacttcagcggcaacgccctgggcgacgagggcgccgccagactggcccagctgctgcccggcctgggcgccctgcagagcctgaacctgagcgagaacggcctgagcctggacgccgtgctgggcctggtgagatgcttcagcaccctgcagtggctgttcagactggacatcagcttcgagagccagcacatcctgctgagaggcgacaagaccagcagcctgagcgagtgccccctggagccccccagcctgaccagactgtgcgccaccctgaaggactgccccggccccctggagctgcagctgagctgcgagttcctgagcgaccagagcctggagaccctgctggactgcctgccccagctgccccagctgagcctgctgcagctgagccagaccggcctgagccccaagagccccttcctgctggccaacaccctgagcctgtgccccagagtgaagaaggtggacctgagaagcctgcaccacgccaccctgcacttcagaagcaacgaggaggaggagggcgtgtgctgcggcttcaccggctgcagcctgagccaggagcacgtggagagcctgtgctggctgctgagcaagtgcaaggacctgagccaggtggacctgagcgccaacctgctgggcgacagcggcctgagatgcctgctggagtgcctgccccaggtgcccatcagcggcctgctggacctgagccacaacagcatcagccaggagagcgccctgtacctgctggagaccctgcccagctgccccagagtgagagaggccagcgtgaacctgggcagcgagcagagcttcagaatccacttcagcagagaggaccaggccggcaagaccctgagactgagcgagtgcagcttcagacccgagcacgtgagcagactggccaccggcctgagcaagagcctgcagctgaccgagctgaccctgacccagtgctgcctgggccagaagcagctggccatcctgctgagcctggtgggcagacccgccggcctgttcagcctgagagacagcaccagacacaccgagaagctgagcttccccaccctggaggcctgcgccctgggcttcaagtag

SEQ ID NO: 22837 - DNA, 4656 bp, Artificial Sequence
  Description of Artificial Sequence: Synthetic coding sequence
atggaccccgtgggcctgcagctgggcaacaagaacctgtggagctgcctggtgagactgctgaccaaggaccccgagtggctgaacgccaagatgaagttcttcctgcccaacaccgacctggacagcagaaacgagaccctggaccccgagcagagagtgatcctgcagctgaacaagctgcacgtgcagggcagcgacacctggcagagcttcatccactgcgtgtgcatgcagctggaggtgcccctggacctggaggtgctgctgctgagcaccttcggctacgacgacggcttcaccagccagctgggcgccgagggcaagagccagcccgagagccagctgcaccacggcctgaagagaccccaccagagctgcggcagcagccccagaagaaagcagtgcaagaagcagcagctggagctggccaagaagtacctgcagctgctgagaaccagcgcccagcagagatacagaagccagatccccggcagcggccagccccacgccttccaccaggtgtacgtgccccccatcctgagaagagccaccgccagcctggacacccccgagggcgccatcatgggcgacgtgaaggtggaggacggcgccgacgtgagcatcagcgacctgttcaacaccagagtgaacaagggccccagagtgaccgtgctgctgggcaaggccggcatgggcaagaccaccctggcccacagactgtgccagaagtgggccgagggccacctgaactgcttccaggccctgttcctgttcgagttcagacagctgaacctgatcaccagattcctgacccccagcgagctgctgttcgacctgtacctgagccccgagagcgaccacgacaccgtgttccagtacctggagaagaacgccgaccaggtgctgctgatcttcgacggcctggacgaggccctgcagcccatgggccccgacggccccggccccgtgctgaccctgttcagccacctgtgcaacggcaccctgctgcccggctgcagagtgatggccaccagcagacccggcaagctgcccgcctgcctgcccgccgaggccgccatggtgcacatgctgggcttcgacggccccagagtggaggagtacgtgaaccacttcttcagcgcccagcccagcagagagggcgccctggtggagctgcagaccaacggcagactgagaagcctgtgcgccgtgcccgccctgtgccaggtggcctgcctgtgcctgcaccacctgctgcccgaccacgcccccggccagagcgtggccctgctgcccaacatgacccagctgtacatgcagatggtgctggccctgagcccccccggccacctgcccaccagcagcctgctggacctgggcgaggtggccctgagaggcctggagaccggcaaggtgatcttctacgccaaggacatcgccccccccctgatcgccttcggcgccacccacagcctgctgaccagcttctgcgtgtgcaccggccccggccaccagcagaccggctacgccttcacccacctgagcctgcaggagttcctggccgccctgcacctgatggccagccccaaggtgaacaaggacaccctgacccagtacgtgaccctgcacagcagatgggtgcagagaaccaaggccagactgggcctgagcgaccacctgcccaccttcctggccggcctggccagctgcacctgcagacccttcctgagccacctggcccagggcaacgaggactgcgtgggcgccaagcaggccgccgtggtgcaggtgctgaagaagctggccaccagaaagctgaccggccccaaggtggtggagctgtgccactgcgtggacgagacccaggagcccgagctggccagcctgaccgcccagagcctgccctaccagctgcccttccacaacttccccctgacctgcaccgacctggccaccctgaccaacatcctggagcacagagaggcccccatccacctggacttcgacggctgccccctggagccccactgccccgaggccctggtgggctgcggccagatcgagaacctgagcttcaagagcagaaagtgcggcgacgccttcgccgaggccctgagcagaagcctgcccaccatgggcagactgcagatgctgggcctggccggcagcaagatcaccgccagaggcatcagccacctggtgaaggccctgcccctgtgcccccagctgaaggaggtgagcttcagagacaaccagctgagcgaccaggtggtgctgaacatcgtggaggtgctgccccacctgcccagactgagaaagctggacctgagcagcaacagcatctgcgtgagcaccctgctgtgcctggccagagtggccgtgacctgccccaccgtgagaatgctgcaggccagagaggccgacctgatcttcctgctgagcccccccaccgagaccaccgccgagctgcagagagcccccgacctgcaggagagcgacggccagagaaagggcgcccagagcagaagcctgaccctgagactgcagaagtgccagctgcaggtgcacgacgccgaggccctgatcgccctgctgcaggagggcccccacctggaggaggtggacctgagcggcaaccagctggaggacgagggctgcagactgatggccgaggccgccagccagctgcacatcgccagaaagctggacctgagcaacaacggcctgagcgtggccggcgtgcactgcgtgctgagagccgtgagcgcctgctggaccctggccgagctgcacatcagcctgcagcacaagaccgtgatcttcatgttcgcccaggagcccgaggagcagaagggcccccaggagagagccgccttcctggacagcctgatgctgcagatgcccagcgagctgcccctgagcagcagaagaatgagactgacccactgcggcctgcaggagaagcacctggagcagctgtgcaaggccctgggcggcagctgccacctgggccacctgcacctggacttcagcggcaacgccctgggcgacgagggcgccgccagactggcccagctgctgcccggcctgggcgccctgcagagcctgaacctgagcgagaacggcctgagcctggacgccgtgctgggcctggtgagatgcttcagcaccctgcagtggctgttcagactggacatcagcttcgagagccagcacatcctgctgagaggcgacaagaccagcagagacatgtgggccaccggcagcctgcccgacttccccgccgccgccaagttcctgggcttcagacagagatgcatccccagaagcctgtgcctgagcgagtgccccctggagccccccagcctgaccagactgtgcgccaccctgaaggactgccccggccccctggagctgcagctgagctgcgagttcctgagcgaccagagcctggagaccctgctggactgcctgccccagctgccccagctgagcctgctgcagctgagccagaccggcctgagccccaagagccccttcctgctggccaacaccctgagcctgtgccccagagtgaagaaggtggacctgagaagcctgcaccacgccaccctgcacttcagaagcaacgaggaggaggagggcgtgtgctgcggcagattcaccggctgcagcctgagccaggagcacgtggagagcctgtgctggctgctgagcaagtgcaaggacctgagccaggtggacctgagcgccaacctgctgggcgacagcggcctgagatgcctgctggagtgcctgccccaggtgcccatcagcggcctgctggacctgagccacaacagcatcagccaggagagcgccctgtacctgctggagaccctgcccagctgccccagagtgagagaggccagcgtgaacctgggcagcgagcagagcttcagaatccacttcagcagagaggaccaggccggcaagaccctgagactgagcgagtgcagcttcagacccgagcacgtgagcagactggccaccggcctgagcaagagcctgcagctgaccgagctgaccctgacccagtgctgcctgggccagaagcagctggccatcctgctgagcctggtgggcagacccgccggcctgttcagcctgagagtgcaggagccctgggccgacagagccagagtgctgagcctgctggaggtgtgcgcccaggccagcggcagcgtgaccgagatcagcatcagcgagacccagcagcagctgtgcgtgcagctggagttccccagacaggaggagaaccccgaggccgtggccctgagactggcccactgcgacctgggcgcccaccacagcctgctggtgggccagctgatggagacctgcgccagactgcagcagctgagcctgagccaggtgaacctgtgcgaggacgacgacgccagcagcctgctgctgcagagcctgctgctgagcctgagcgagctgaagaccttcagaatccagagcagccaggaccccggcagactgctgcccgacctgctgcccttcgacccccaccaggccgacctgcagctgtgcgagcacagaggccccagaccccccggcatctggagcggccccctgccccccctgggcggcgccggcctggtgtag

SEQ ID NO: 22838 - DNA, 60 bp, Artificial Sequence
  Description of Artificial Sequence: Synthetic coding sequence
atggaccccgtgggcctgcagctgggcaacaagaacctgtggagctgcctggtgagatag

SEQ ID NO: 22839 - DNA, 225 bp, Artificial Sequence
  Description of Artificial Sequence: Synthetic coding sequence
atggaccccgtgggcctgcagctgggcaacaagaacctgtggagctgcctggtgagactgctgaccaaggaccccgagtggctgaacgccaagatgaagttcttcctgcccaacaccgacctggacagcagaaacgagaccctggaccccgagcagagagtgatcctgcagctgaacaagctgcacgtgcagggcagcgacacctggcagagcttcatccactag

SEQ ID NO: 22840 - DNA, 1968 bp, Artificial Sequence
  Description of Artificial Sequence: Synthetic coding sequence
atggccatggccaaggccagaaagcccagagaggccctgctgtgggccctgagcgacctggaggagaacgacttcaagaagctgaagttctacctgagagacatgaccctgagcgagggccagccccccctggccagaggcgagctggagggcctgatccccgtggacctggccgagctgctgatcagcaagtacggcgagaaggaggccgtgaaggtggtgctgaagggcctgaaggtgatgaacctgctggagctggtggaccagctgagccacatctgcctgcacgactacagagaggtgtacagagagcacgtgagatgcctggaggagtggcaggaggccggcgtgaacggcagatacaaccaggtgctgctggtggccaagcccagcagcgagagccccgagagcctggcctgccccttccccgagcaggagctggagagcgtgaccgtggaggccctgttcgacagcggcgagaagcccagcctggcccccagcctggtggtgctgcagggcagcgccggcaccggcaagaccaccctggccagaaagatggtgctggactgggccaccggcaccctgtaccccggcagattcgactacgtgttctacgtgagctgcaaggaggtggtgctgctgctggagagcaagctggagcagctgctgttctggtgctgcggcgacaaccaggcccccgtgaccgagatcctgagacagcccgagagactgctgttcatcctggacggcttcgacgagctgcagagacccttcgaggagaagctgaagaagagaggcctgagccccaaggagagcctgctgcacctgctgatcagaagacacaccctgcccacctgcagcctgctgatcaccaccagacccctggccctgagaaacctggagcccctgctgaagcaggccagacacgtgcacatcctgggcttcagcgaggaggagagagccagatacttcagcagctacttcaccgacgagaagcaggccgacagagccttcgacatcgtgcagaagaacgacatcctgtacaaggcctgccaggtgcccggcatctgctgggtggtgtgcagctggctgcagggccagatggagagaggcaaggtggtgctggagacccccagaaacagcaccgacatcttcatggcctacgtgagcaccttcctgccccccgacgacgacggcggctgcagcgagctgagcagacacagagtgctgagaagcctgtgcagcctggccgccgagggcatccagcaccagagattcctgttcgaggaggccgagctgagaaagcacaacctggacggccccagactggccgccttcctgagcagcaacgactaccagctgggcctggccatcaagaagttctacagcttcagacacatcagcttccaggacttcttccacgccatgagctacctggtgaaggaggaccagagcagactgggcaaggagagcagaagagaggtgcagagactgctggaggtgaaggagcaggagggcaacgacgagatgaccctgaccatgcagttcctgctggacatcagcaagaaggacagcttcagcaacctggagctgaagttctgcttcagaatcagcccctgcctggcccaggacctgaagcacttcaaggagcagatggagagcatgaagcacaacagaacctgggacctggagttcagcctgtacgaggccaagatcaagaacctggtgaagggcatccagatgaacaacgtgagcttcaagatcaagcacagcaacgagaagaagagccagagccagaacctgttcagcgtgaagagcagcctgagccacggccccaaggaggagcagaagtgccccagcgtgcacggccagaaggagggcaaggacaacatcgccggcacccagaaggaggccagcaccggcaagggcagaggcaccgaggagacccccaagaacacctacatctag

SEQ ID NO: 22841 - DNA, 201 bp, Artificial Sequence
  Description of Artificial Sequence: Synthetic coding sequence
atggccatggccaaggccagaaagcccagagaggccctgctgtgggccctgagcgacctggaggagaacgacttcaagaagctgaagttctacctgagagacatgaccctgagcgagggccagccccccctggccagaggcgagctggagggcctgatccccgtggacctggccgagctgctgatcagcaagtacggctag

SEQ ID NO: 22842 - DNA, 2940 bp, Artificial Sequence
  Description of Artificial Sequence: Synthetic coding sequence
atggccgagagcgacagcaccgacttcgacctgctgtggtacctggagaacctgagcgacaaggagttccagagcttcaagaagtacctggccagaaagatcctggacttcaagctgccccagttccccctgatccagatgaccaaggaggagctggccaacgtgctgcccatcagctacgagggccagtacatctggaacatgctgttcagcatcttcagcatgatgagaaaggaggacctgtgcagaaagatcatcggcagaagaaacagaaaccaggaggcctgcaaggccgtgatgagaagaaagttcatgctgcagtgggagagccacaccttcggcaagttccactacaagttcttcagagacgtgagcagcgacgtgttctacatcctgcagctggcctacgacagcaccagctactacagcgccaacaacctgaacgtgttcctgatgggcgagagagccagcggcaagaccatcgtgatcaacctggccgtgctgagatggatcaagggcgagatgtggcagaacatgatcagctacgtggtgcacctgaccgcccacgagatcaaccagatgaccaacagcagcctggccgagctgatcgccaaggactggcccgacggccaggcccccatcgccgacatcctgagcgaccccaagaagctgctgttcatcctggaggacctggacaacatcagattcgagctgaacgtgaacgagagcgccctgtgcagcaacagcacccagaaggtgcccatccccgtgctgctggtgagcctgctgaagagaaagatggcccccggctgctggttcctgatcagcagcagacccaccagaggcaacaacgtgaagaccttcctgaaggaggtggactgctgcaccaccctgcagctgagcaacggcaagagagagatctacttcaacagcttcttcaaggacagacagagagccagcgccgccctgcagctggtgcacgaggacgagatcctggtgggcctgtgcagagtggccatcctgtgctggatcacctgcaccgtgctgaagagacagatggacaagggcagagacttccagctgtgctgccagacccccaccgacctgcacgcccacttcctggccgacgccctgaccagcgaggccggcctgaccgccaaccagtaccacctgggcctgctgaagagactgtgcctgctggccgccggcggcctgttcctgagcaccctgaacttcagcggcgaggacctgagatgcgtgggcttcaccgaggccgacgtgagcgtgctgcaggccgccaacatcctgctgcccagcaacacccacaaggacagatacaagttcatccacctgaacgtgcaggagttctgcaccgccatcgccttcctgatggccgtgcccaactacctgatccccagcggcagcagagagtacaaggagaagagagagcagtacagcgacttcaaccaggtgttcaccttcatcttcggcctgctgaacgccaacagaagaaagatcctggagaccagcttcggctaccagctgcccatggtggacagcttcaagtggtacagcgtgggctacatgaagcacctggacagagaccccgagaagctgacccaccacatgcccctgttctactgcctgtacgagaacagagaggaggagttcgtgaagaccatcgtggacgccctgatggaggtgaccgtgtacctgcagagcgacaaggacatgatggtgagcctgtactgcctggactactgctgccacctgagaaccctgaagctgagcgtgcagagaatcttccagaacaaggagcccctgatcagacccaccgccagactgagctacgtgagcaccgccagcggcttcgaggacctgctgaaggccctggccagaaacagaagcctgacctacctgagcatcaactgcaccagcatcagcctgaacatgttcagcctgctgcacgacatcctgcacgagcccacctgccagatcagccacctgagcctgatgaagtgcgacctgagagccagcgagtgcgaggagatcgccagcctgctgatcagcggcggcagcctgagaaagctgaccctgagcagcaaccccctgagaagcgacggcatgaacatcctgtgcgacgccctgctgcaccccaactgcaccctgatcagcctggtgctggtgttctgctgcctgaccgagaactgctgcagcgccctgggcagagtgctgctgttcagccccaccctgagacagctggacctgtgcgtgaacagactgaagaactacggcgtgctgcacgtgaccttccccctgctgttccccacctgccagctggaggagctgcacctgagcggctgcttcttcagcagcgacatctgccagtacatcgccatcgtgatcgccaccaacgagaagctgagaagcctggagatcggcagcaacaagatcgaggacgccggcatgcagctgctgtgcggcggcctgagacaccccaactgcatgctggtgaacatcggcctggaggagtgcatgctgaccagcgcctgctgcagaagcctggccagcgtgctgaccaccaacaagaccctggagagactgaacctgctgcagaaccacctgggcaacgacggcgtggccaagctgctggagagcctgatcagccccgactgcgtgctgaaggtggtgggcctgcccctgaccggcctgaacacccagacccagcagctgctgatgaccgtgaaggagagaaagcccagcctgatcttcctgagcgagacctggagcctgaaggagggcagagagatcggcgtgacccccgccagccagcccggcagcatcatccccaacagcaacctggactacatgttcttcaagttccccagaatgagcgccgccatgagaaccagcaacaccgccagcagacagcccctgtag

SEQ ID NO: 22843 - DNA, 3102 bp, Artificial Sequence
  Description of Artificial Sequence: Synthetic coding sequence
atggccgagagcgacagcaccgacttcgacctgctgtggtacctggagaacctgagcgacaaggagttccagagcttcaagaagtacctggccagaaagatcctggacttcaagctgccccagttccccctgatccagatgaccaaggaggagctggccaacgtgctgcccatcagctacgagggccagtacatctggaacatgctgttcagcatcttcagcatgatgagaaaggaggacctgtgcagaaagatcatcggcagaagaaacagaaaccaggaggcctgcaaggccgtgatgagaagaaagttcatgctgcagtgggagagccacaccttcggcaagttccactacaagttcttcagagacgtgagcagcgacgtgttctacatcctgcagctggcctacgacagcaccagctactacagcgccaacaacctgaacgtgttcctgatgggcgagagagccagcggcaagaccatcgtgatcaacctggccgtgctgagatggatcaagggcgagatgtggcagaacatgatcagctacgtggtgcacctgaccgcccacgagatcaaccagatgaccaacagcagcctggccgagctgatcgccaaggactggcccgacggccaggcccccatcgccgacatcctgagcgaccccaagaagctgctgttcatcctggaggacctggacaacatcagattcgagctgaacgtgaacgagagcgccctgtgcagcaacagcacccagaaggtgcccatccccgtgctgctggtgagcctgctgaagagaaagatggcccccggctgctggttcctgatcagcagcagacccaccagaggcaacaacgtgaagaccttcctgaaggaggtggactgctgcaccaccctgcagctgagcaacggcaagagagagatctacttcaacagcttcttcaaggacagacagagagccagcgccgccctgcagctggtgcacgaggacgagatcctggtgggcctgtgcagagtggccatcctgtgctggatcacctgcaccgtgctgaagagacagatggacaagggcagagacttccagctgtgctgccagacccccaccgacctgcacgcccacttcctggccgacgccctgaccagcgaggccggcctgaccgccaaccagtaccacctgggcctgctgaagagactgtgcctgctggccgccggcggcctgttcctgagcaccctgaacttcagcggcgaggacctgagatgcgtgggcttcaccgaggccgacgtgagcgtgctgcaggccgccaacatcctgctgcccagcaacacccacaaggacagatacaagttcatccacctgaacgtgcaggagttctgcaccgccatcgccttcctgatggccgtgcccaactacctgatccccagcggcagcagagagtacaaggagaagagagagcagtacagcgacttcaaccaggtgttcaccttcatcttcggcctgctgaacgccaacagaagaaagatcctggagaccagcttcggctaccagctgcccatggtggacagcttcaagtggtacagcgtgggctacatgaagcacctggacagagaccccgagaagctgacccaccacatgcccctgttctactgcctgtacgagaacagagaggaggagttcgtgaagaccatcgtggacgccctgatggaggtgaccgtgtacctgcagagcgacaaggacatgatggtgagcctgtactgcctggactactgctgccacctgagaaccctgaagctgagcgtgcagagaatcttccagaacaaggagcccctgatcagacccaccgccagccagatgaagagcctggtgtactggagagagatctgcagcctgttctacaccatggagagcctgagagagctgcacatcttcgacaacgacctgaacggcatcagcgagagaatcctgagcaaggccctggagcacagcagctgcaagctgagaaccctgaagctgagctacgtgagcaccgccagcggcttcgaggacctgctgaaggccctggccagaaacagaagcctgacctacctgagcatcaactgcaccagcatcagcctgaacatgttcagcctgctgcacgacatcctgcacgagcccacctgccagatcagccacctgagcctgatgaagtgcgacctgagagccagcgagtgcgaggagatcgccagcctgctgatcagcggcggcagcctgagaaagctgaccctgagcagcaaccccctgagaagcgacggcatgaacatcctgtgcgacgccctgctgcaccccaactgcaccctgatcagcctggtgctggtgttctgctgcctgaccgagaactgctgcagcgccctgggcagagtgctgctgttcagccccaccctgagacagctggacctgtgcgtgaacagactgaagaactacggcgtgctgcacgtgaccttccccctgctgttccccacctgccagctggaggagctgcacctgagcggctgcttcttcagcagcgacatctgccagtacatcgccatcgtgatcgccaccaacgagaagctgagaagcctggagatcggcagcaacaagatcgaggacgccggcatgcagctgctgtgcggcggcctgagacaccccaactgcatgctggtgaacatcggcctggaggagtgcatgctgaccagcgcctgctgcagaagcctggccagcgtgctgaccaccaacaagaccctggagagactgaacctgctgcagaaccacctgggcaacgacggcgtggccaagctgctggagagcctgatcagccccgactgcgtgctgaaggtggtgggcctgcccctgaccggcctgaacacccagacccagcagctgctgatgaccgtgaaggagagaaagcccagcctgatcttcctgagcgagacctggagcctgaaggagggcagagagatcggcgtgacccccgccagccagcccggcagcatcatccccaacagcaacctggactacatgttcttcaagttccccagaatgagcgccgccatgagaaccagcaacaccgccagcagacagcccctgtag

SEQ ID NO: 22844 - DNA, 3132 bp, Artificial Sequence
  Description of Artificial Sequence: Synthetic coding sequence
atgaacttcagcgtgatcacctgccccaacggcggcaccaaccagggcctgctgccctacctgatggccctggaccagtaccagctggaggagttcaagctgtgcctggagccccagcagctgatggacttctggagcgccccccagggccacttccccagaatcccctgggccaacctgagagccgccgaccccctgaacctgagcttcctgctggacgagcacttccccaagggccaggcctggaaggtggtgctgggcatcttccagaccatgaacctgaccagcctgtgcgagaaggtgagagccgagatgaaggagaacgtgcagacccaggagctgcaggaccccacccaggaggacctggagatgctggaggccgccgccggcaacatgcagacccagggctgccaggaccccaaccaggaggagctggacgagctggaggaggagaccggcaacgtgcaggcccagggctgccaggaccccaaccaggaggagcccgagatgctggaggaggccgaccacagaagaaagtacagagagaacatgaaggccgagctgctggagacctgggacaacatcagctggcccaaggaccacgtgtacatcagaaacaccagcaaggacgagcacgaggagctgcagagactgctggaccccaacagaaccagagcccaggcccagaccatcgtgctggtgggcagagccggcgtgggcaagaccaccctggccatgcaggccatgctgcactgggccaacggcgtgctgttccagcagagattcagctacgtgttctacctgagctgccacaagatcagatacatgaaggagaccaccttcgccgagctgatcagcctggactggcccgacttcgacgcccccatcgaggagttcatgagccagcccgagaagctgctgttcatcatcgacggcttcgaggagatcatcatcagcgagagcagaagcgagagcctggacgacggcagcccctgcaccgactggtaccaggagctgcccgtgaccaagatcctgcacagcctgctgaagaaggagctggtgcccctggccaccctgctgatcaccatcaagacctggttcgtgagagacctgaaggccagcctggtgaacccctgcttcgtgcagatcaccggcttcaccggcgacgacctgagagtgtacttcatgagacacttcgacgacagcagcgaggtggagaagatcctgcagcagctgagaaagaacgagaccctgttccacagctgcagcgcccccatggtgtgctggaccgtgtgcagctgcctgaagcagcccaaggtgagatactacgacctgcagagcatcacccagaccaccaccagcctgtacgcctacttcttcagcaacctgttcagcaccgccgaggtggacctggccgacgacagctggcccggccagtggagagccctgtgcagcctggccatcgagggcctgtggagcatgaacttcaccttcaacaaggaggacaccgagatcgagggcctggaggtgcccttcatcgacagcctgtacgagttcaacatcctgcagaagatcaacgactgcggcggctgcaccaccttcacccacctgagcttccaggagttcttcgccgccatgagcttcgtgctggaggagcccagagagttccccccccacagcaccaagccccaggagatgaagatgctgctgcagcacgtgctgctggacaaggaggcctactggacccccgtggtgctgttcttcttcggcctgctgaacaagaacatcgccagagagctggaggacaccctgcactgcaagatcagccccagagtgatggaggagctgctgaagtggggcgaggagctgggcaaggccgagagcgccagcctgcagttccacatcctgagactgttccactgcctgcacgagagccaggaggaggacttcaccaagaagatgctgggcagaatcttcgaggtggacctgaacatcctggaggacgaggagctgcaggccagcagcttctgcctgaagcactgcaagagactgaacaagctgagactgagcgtgagcagccacatcctggagagagacctggagatcctggagaccagcaagttcgacagcagaatgcacgcctggaacagcatctgcagcaccctggtgaccaacgagaacctgcacgagctggacctgagcaacagcaagctgcacgccagcagcgtgaagggcctgtgcctggccctgaagaaccccagatgcaaggtgcagaagctgacctgcaagagcgtgacccccgagtgggtgctgcaggacctgatcatcgccctgcagggcaacagcaagctgacccacctgaacttcagcagcaacaagctgggcatgaccgtgcccctgatcctgaaggccctgagacacagcgcctgcaacctgaagtacctgtgcctggagaagtgcaacctgagcgccgccagctgccaggacctggccctgttcctgaccagcatccagcacgtgaccagactgtgcctgggcttcaacagactgcaggacgacggcatcaagctgctgtgcgccgccctgacccaccccaagtgcgccctggagagactggagctgtggttctgccagctggccgcccccgcctgcaagcacctgagcgacgccctgctgcagaacagaagcctgacccacctgaacctgagcaagaacagcctgagagacgagggcgtgaagttcctgtgcgaggccctgggcagacccgacggcaacctgcagagcctgaacctgagcggctgcagcttcaccagagagggctgcggcgagctggccaacgccctgagccacaaccacaacgtgaagatcctggacctgggcgagaacgacctgcaggacgacggcgtgaagctgctgtgcgaggccctgaagccccacagagccctgcacaccctgggcctggccaagtgcaacctgaccaccgcctgctgccagcacctgttcagcgtgctgagcagcagcaagagcctggtgaacctgaacctgctgggcaacgagctggacaccgacggcgtgaagatgctgtgcaaggccctgaagaagagcacctgcagactgcagaagctgggctag

SEQ ID NO: 22845 - DNA, 3282 bp, Artificial Sequence
  Description of Artificial Sequence: Synthetic coding sequence
atggccgacagcagcagcagcagcttcttccccgacttcggcctgctgctgtacctggaggagctgaacaaggaggagctgaacaccttcaagctgttcctgaaggagaccatggagcccgagcacggcctgaccccctggaacgaggtgaagaaggccagaagagaggacctggccaacctgatgaagaagtactaccccggcgagaaggcctggagcgtgagcctgaagatcttcggcaagatgaacctgaaggacctgtgcgagagagccaaggaggagatcaactggagcgcccagaccatcggccccgacgacgccaaggccggcgagacccaggaggaccaggaggccgtgctgggcgacggcaccgagtacagaaacagaatcaaggagaagttctgcatcacctgggacaagaagagcctggccggcaagcccgaggacttccaccacggcatcgccgagaaggacagaaagctgctggagcacctgttcgacgtggacgtgaagaccggcgcccagccccagatcgtggtgctgcagggcgccgccggcgtgggcaagaccaccctggtgagaaaggccatgctggactgggccgagggcagcctgtaccagcagagattcaagtacgtgttctacctgaacggcagagagatcaaccagctgaaggagagaagcttcgcccagctgatcagcaaggactggcccagcaccgagggccccatcgaggagatcatgtaccagcccagcagcctgctgttcatcatcgacagcttcgacgagctgaacttcgccttcgaggagcccgagttcgccctgtgcgaggactggacccaggagcaccccgtgagcttcctgatgagcagcctgctgagaaaggtgatgctgcccgaggccagcctgctggtgaccaccagactgaccaccagcaagagactgaagcagctgctgaagaaccaccactacgtggagctgctgggcatgagcgaggacgccagagaggagtacatctaccagttcttcgaggacaagagatgggccatgaaggtgttcagcagcctgaagagcaacgagatgctgttcagcatgtgccaggtgcccctggtgtgctgggccgcctgcacctgcctgaagcagcagatggagaagggcggcgacgtgaccctgacctgccagaccaccaccgccctgttcacctgctacatcagcagcctgttcacccccgtggacggcggcagccccagcctgcccaaccaggcccagctgagaagactgtgccaggtggccgccaagggcatctggaccatgacctacgtgttctacagagagaacctgagaagactgggcctgacccagagcgacgtgagcagcttcatggacagcaacatcatccagaaggacgccgagtacgagaactgctacgtgttcacccacctgcacgtgcaggagttcttcgccgccatgttctacatgctgaagggcagctgggaggccggcaaccccagctgccagcccttcgaggacctgaagagcctgctgcagagcaccagctacaaggacccccacctgacccagatgaagtgcttcctgttcggcctgctgaacgaggacagagtgaagcagctggagagaaccttcaactgcaagatgagcctgaagatcaagagcaagctgctgcagtgcatggaggtgctgggcaacagcgactacagccccagccagctgggcttcctggagctgttccactgcctgtacgagacccaggacaaggccttcatcagccaggccatgagatgcttccccaaggtggccatcaacatctgcgagaagatccacctgctggtgagcagcttctgcctgaagcactgcagatgcctgagaaccatcagactgagcgtgaccgtggtgttcgagaagaagatcctgaagaccagcctgcccaccaacacctgggacggcgacagaatcacccactgctggcaggacctgtgcagcgtgctgcacaccaacgagcacctgagagagctggacctgtaccacagcaacctggacaagagcgccatgaacatcctgcaccacgagctgagacaccccaactgcaagctgcagaagctgctgctgaagttcatcaccttccccgacggctgccaggacatcagcaccagcctgatccacaacaagaacctgatgcacctggacctgaagggcagcgacatcggcgacaacggcgtgaagagcctgtgcgaggccctgaagcaccccgagtgcaagctgcagaccctgagactggagagctgcaacctgaccgtgttctgctgcctgaacatcagcaacgccctgatcagaagccagagcctgatcttcctgaacctgagcaccaacaacctgctggacgacggcgtgcagctgctgtgcgaggccctgagacaccccaagtgctacctggagagactgagcctggagagctgcggcctgaccgaggccggctgcgagtacctgagcctggccctgatcagcaacaagagactgacccacctgtgcctggccgacaacgtgctgggcgacggcggcgtgaagctgatgagcgacgccctgcagcacgcccagtgcaccctgaagagcctggtgctgagaagatgccacttcaccagcctgagcagcgagtacctgagcaccagcctgctgcacaacaagagcctgacccacctggacctgggcagcaactggctgcaggacaacggcgtgaagctgctgtgcgacgtgttcagacaccccagctgcaacctgcaggacctggagctgatgggctgcgtgctgaccaacgcctgctgcctggacctggccagcgtgatcctgaacaaccccaacctgagaagcctggacctgggcaacaacgacctgcaggacgacggcgtgaagatcctgtgcgacgccctgagataccccaactgcaacatccagagactgggcctggagtactgcggcctgaccagcctgtgctgccaggacctgagcagcgccctgatctgcaacaagagactgatcaagatgaacctgacccagaacaccctgggctacgagggcatcgtgaagctgtacaaggtgctgaagagccccaagtgcaagctgcaggtgctgggcctgtgcaaggaggccttcgacgaggaggcccagaagctgctggaggccgtgggcgtgagcaacccccacctgatcatcaagcccgactgcaactaccacaacgaggaggacgtgagctggtggtggtgcttctag

SEQ ID NO: 22846 - DNA, 2985 bp, Artificial Sequence
  Description of Artificial Sequence: Synthetic coding sequence
atggccgccagcttcttcagcgacttcggcctgatgtggtacctggaggagctgaagaaggaggagttcagaaagttcaaggagcacctgaagcagatgaccctgcagctggagctgaagcagatcccctggaccgaggtgaagaaggccagcagagaggagctggccaacctgctgatcaagcactacgaggagcagcaggcctggaacatcaccctgagaatcttccagaagatggacagaaaggacctgtgcatgaaggtgatgagagagagaaccggctacaccaagacctaccaggcccacgccaagcagaagttcagcagactgtggagcagcaagagcgtgaccgagatccacctgtacttcgaggaggaggtgaagcaggaggagtgcgaccacctggacagactgttcgcccccaaggaggccggcaagcagcccagaaccgtgatcatccagggcccccagggcatcggcaagaccaccctgctgatgaagctgatgatggcctggagcgacaacaagatcttcagagacagattcctgtacaccttctacttctgctgcagagagctgagagagctgccccccaccagcctggccgacctgatcagcagagagtggcccgaccccgccgcccccatcaccgagatcgtgagccagcccgagagactgctgttcgtgatcgacagcttcgaggagctgcagggcggcctgaacgagcccgacagcgacctgtgcggcgacctgatggagaagagacccgtgcaggtgctgctgagcagcctgctgagaaagaagatgctgcccgaggccagcctgctgatcgccatcaagcccgtgtgccccaaggagctgagagaccaggtgaccatcagcgagatctaccagcccagaggcttcaacgagagcgacagactggtgtacttctgctgcttcttcaaggaccccaagagagccatggaggccttcaacctggtgagagagagcgagcagctgttcagcatctgccagatccccctgctgtgctggatcctgtgcaccagcctgaagcaggagatgcagaagggcaaggacctggccctgacctgccagagcaccaccagcgtgtacagcagcttcgtgttcaacctgttcacccccgagggcgccgagggccccaccccccagacccagcaccagctgaaggccctgtgcagcctggccgccgagggcatgtggaccgacaccttcgagttctgcgaggacgacctgagaagaaacggcgtggtggacgccgacatccccgccctgctgggcaccaagatcctgctgaagtacggcgagagagagagcagctacgtgttcctgcacgtgtgcatccaggagttctgcgccgccctgttctacctgctgaagagccacctggaccacccccaccccgccgtgagatgcgtgcaggagctgctggtggccaacttcgagaaggccagaagagcccactggatcttcctgggctgcttcctgaccggcctgctgaacaagaaggagcaggagaagctggacgccttcttcggcttccagctgagccaggagatcaagcagcagatccaccagtgcctgaagagcctgggcgagagaggcaacccccagggccaggtggacagcctggccatcttctactgcctgttcgagatgcaggaccccgccttcgtgaagcaggccgtgaacctgctgcaggaggccaacttccacatcatcgacaacgtggacctggtggtgagcgcctactgcctgaagtactgcagcagcctgagaaagctgtgcttcagcgtgcagaacgtgttcaagaaggaggacgagcacagcagcaccagcgactacagcctgatctgctggcaccacatctgcagcgtgctgaccaccagcggccacctgagagagctgcaggtgcaggacagcaccctgagcgagagcaccttcgtgacctggtgcaaccagctgagacaccccagctgcagactgcagaagctgggcatcaacaacgtgagcttcagcggccagagcgtgctgctgttcgaggtgctgttctaccagcccgacctgaagtacctgagcttcaccctgaccaagctgagcagagacgacatcagaagcctgtgcgacgccctgaactaccccgccggcaacgtgaaggagctggccctggtgaactgccacctgagccccatcgactgcgaggtgctggccggcctgctgaccaacaacaagaagctgacctacctgaacgtgagctgcaaccagctggacaccggcgtgcccctgctgtgcgaggccctgtgcagccccgacaccgtgctggtgtacctgatgctggccttctgccacctgagcgagcagtgctgcgagtacatcagcgagatgctgctgagaaacaagagcgtgagatacctggacctgagcgccaacgtgctgaaggacgagggcctgaagaccctgtgcgaggccctgaagcaccccgactgctgcctggacagcctgtgcctggtgaagtgcttcatcaccgccgccggctgcgaggacctggccagcgccctgatcagcaaccagaacctgaagatcctgcagatcggctgcaacgagatcggcgacgtgggcgtgcagctgctgtgcagagccctgacccacaccgactgcagactggagatcctgggcctggaggagtgcggcctgaccagcacctgctgcaaggacctggccagcgtgctgacctgcagcaagaccctgcagcagctgaacctgaccctgaacaccctggaccacaccggcgtggtggtgctgtgcgaggccctgagacaccccgagtgcgccctgcaggtgctgggcctgagaaagaccgacttcgacgaggagacccaggccctgctgaccgccgaggaggagagaaaccccaacctgaccatcaccgacgactgcgacaccatcaccagagtggagatctag

SEQ ID NO: 22847 - DNA, 2817 bp, Artificial Sequence
  Description of Artificial Sequence: Synthetic coding sequence
atggccgccagcttcttcagcgacttcggcctgatgtggtacctggaggagctgaagaaggaggagttcagaaagttcaaggagcacctgaagcagatgaccctgcagctggagctgaagcagatcccctggaccgaggtgaagaaggccagcagagaggagctggccaacctgctgatcaagcactacgaggagcagcaggcctggaacatcaccctgagaatcttccagaagatggacagaaaggacctgtgcatgaaggtgatgagagagagaaccggctacaccaagacctaccaggcccacgccaagcagaagttcagcagactgtggagcagcaagagcgtgaccgagatccacctgtacttcgaggaggaggtgaagcaggaggagtgcgaccacctggacagactgttcgcccccaaggaggccggcaagcagcccagaaccgtgatcatccagggcccccagggcatcggcaagaccaccctgctgatgaagctgatgatggcctggagcgacaacaagatcttcagagacagattcctgtacaccttctacttctgctgcagagagctgagagagctgccccccaccagcctggccgacctgatcagcagagagtggcccgaccccgccgcccccatcaccgagatcgtgagccagcccgagagactgctgttcgtgatcgacagcttcgaggagctgcagggcggcctgaacgagcccgacagcgacctgtgcggcgacctgatggagaagagacccgtgcaggtgctgctgagcagcctgctgagaaagaagatgctgcccgaggccagcctgctgatcgccatcaagcccgtgtgccccaaggagctgagagaccaggtgaccatcagcgagatctaccagcccagaggcttcaacgagagcgacagactggtgtacttctgctgcttcttcaaggaccccaagagagccatggaggccttcaacctggtgagagagagcgagcagctgttcagcatctgccagatccccctgctgtgctggatcctgtgcaccagcctgaagcaggagatgcagaagggcaaggacctggccctgacctgccagagcaccaccagcgtgtacagcagcttcgtgttcaacctgttcacccccgagggcgccgagggccccaccccccagacccagcaccagctgaaggccctgtgcagcctggccgccgagggcatgtggaccgacaccttcgagttctgcgaggacgacctgagaagaaacggcgtggtggacgccgacatccccgccctgctgggcaccaagatcctgctgaagtacggcgagagagagagcagctacgtgttcctgcacgtgtgcatccaggagttctgcgccgccctgttctacctgctgaagagccacctggaccacccccaccccgccgtgagatgcgtgcaggagctgctggtggccaacttcgagaaggccagaagagcccactggatcttcctgggctgcttcctgaccggcctgctgaacaagaaggagcaggagaagctggacgccttcttcggcttccagctgagccaggagatcaagcagcagatccaccagtgcctgaagagcctgggcgagagaggcaacccccagggccaggtggacagcctggccatcttctactgcctgttcgagatgcaggaccccgccttcgtgaagcaggccgtgaacctgctgcaggaggccaacttccacatcatcgacaacgtggacctggtggtgagcgcctactgcctgaagtactgcagcagcctgagaaagctgtgcttcagcgtgcagaacgtgttcaagaaggaggacgagcacagcagcaccagcgactacagcctgatctgctggcaccacatctgcagcgtgctgaccaccagcggccacctgagagagctgcaggtgcaggacagcaccctgagcgagagcaccttcgtgacctggtgcaaccagctgagacaccccagctgcagactgcagaagctgggcatcaacaacgtgagcttcagcggccagagcgtgctgctgttcgaggtgctgttctaccagcccgacctgaagtacctgagcttcaccctgaccaagctgagcagagacgacatcagaagcctgtgcgacgccctgaactaccccgccggcaacgtgaaggagctggccctggccttctgccacctgagcgagcagtgctgcgagtacatcagcgagatgctgctgagaaacaagagcgtgagatacctggacctgagcgccaacgtgctgaaggacgagggcctgaagaccctgtgcgaggccctgaagcaccccgactgctgcctggacagcctgtgcctggtgaagtgcttcatcaccgccgccggctgcgaggacctggccagcgccctgatcagcaaccagaacctgaagatcctgcagatcggctgcaacgagatcggcgacgtgggcgtgcagctgctgtgcagagccctgacccacaccgactgcagactggagatcctgggcctggaggagtgcggcctgaccagcacctgctgcaaggacctggccagcgtgctgacctgcagcaagaccctgcagcagctgaacctgaccctgaacaccctggaccacaccggcgtggtggtgctgtgcgaggccctgagacaccccgagtgcgccctgcaggtgctgggcctgagaaagaccgacttcgacgaggagacccaggccctgctgaccgccgaggaggagagaaaccccaacctgaccatcaccgacgactgcgacaccatcaccagagtggagatctag

SEQ ID NO: 22848 - DNA, 3114 bp, Artificial Sequence; identical to SEQ ID NO: 22827
  Description of Artificial Sequence: Synthetic coding sequence

SEQ ID NO: 22849 - DNA, 2943 bp, Artificial Sequence; identical to SEQ ID NO: 22809
  Description of Artificial Sequence: Synthetic coding sequence

SEQ ID NO: 22850 - DNA, 2019 bp, Artificial Sequence
  Description of Artificial Sequence: Synthetic coding sequence
atgaccagcccccagctggagtggaccctgcagaccctgctggagcagctgaacgaggacgagctgaagagcttcaagagcctgctgtgggccttccccctggaggacgtgctgcagaagaccccctggagcgaggtggaggaggccgacggcaagaagctggccgagatcctggtgaacaccagcagcgagaactggatcagaaacgccaccgtgaacatcctggaggagatgaacctgaccgagctgtgcaagatggccaaggccgagatgatggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagatgagcgtgttccacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacgccctggagaaggaggagggcgaggacagagacggccacgcctgggacatcggcgacgtgcagaagctgctgagcggcgaggagagactgaagaaccccgacctgatccaggtgggccacttcctgttcggcctggccaacgagaagagagccaaggagctggaggccaccttcggctgcagaatgagccccgacatcaagcaggagctgctgcagtgcaaggcccacctgcacgccaacaagcccctgagcgtgaccgacctgaaggaggtgctgggctgcctgtacgagagccaggaggaggagctggccaaggtggtggtggcccccttcaaggagatcagcatccacctgaccaacaccagcgaggtgatgcactgcagcttcagcctgaagcactgccaggacctgcagaagctgagcctgcaggtggccaagggcgtgttcctggagaactacatggacttcgagctggacatcgagttcgagagatgcacctacctgaccatccccaactgggccagacaggacctgagaagcctgagactgtggaccgacttctgcagcctgttcagcagcaacagcaacctgaagttcctggaggtgaagcagagcttcctgagcgacagcagcgtgagaatcctgtgcgaccacgtgaccagaagcacctgccacctgcagaaggtggagatcaagaacgtgacccccgacaccgcctacagagacttctgcctggccttcatcggcaagaagaccctgacccacctgaccctggccggccacatcgagtgggagagaaccatgatgctgatgctgtgcgacctgctgagaaaccacaagtgcaacctgcagtacctgagactgggcggccactgcgccacccccgagcagtgggccgagttcttctacgtgctgaaggccaaccagagcctgaagcacctgagactgagcgccaacgtgctgctggacgagggcgccatgctgctgtacaagaccatgaccagacccaagcacttcctgcagatgctgagcctggagaactgcagactgaccgaggccagctgcaaggacctggccgccgtgctggtggtgagcaagaagctgacccacctgtgcctggccaagaaccccatcggcgacaccggcgtgaagttcctgtgcgagggcctgagctaccccgactgcaagctgcagccccacaagcccggcctggagtaccagcccgacagcagctggatcgtggacagcctgagcggcatcagagagagcaagctgtag

SEQ ID NO: 22851 - DNA, 3198 bp, Artificial Sequence; identical to SEQ ID NO: 22811
  Description of Artificial Sequence: Synthetic coding sequence

SEQ ID NO: 22852 - DNA, 3030 bp, Artificial Sequence; identical to SEQ ID NO: 22810
  Description of Artificial Sequence: Synthetic coding sequence

SEQ ID NO: 22853 - DNA, 828 bp, Artificial Sequence
  Description of Artificial Sequence: Synthetic coding sequence
atggaggaggtgagagagggccacgccctgggcggcggcatggaggccgacggccccgccagcctgcaggagctgccccccagccccagaagccccagccccccccccagccccccccccctgcccagcccccccagcctgcccagccccgccgcccccgaggcccccgagctgcccgagcccgcccagcccagcgaggcccacgccagacagctgctgctggaggagtggggccccctgagcggcggcctggagctgccccagagactgacctggaagctgctgctgctgagaagacccctgtacagaaacctgctgagaagccccaaccccgagggcatcaacatctacgagcccgccccccccaccggccccacccagagacccctggagaccctgggcaacttcagaggctggtacatcagaaccgagaagctgcagcagaaccagagctggaccgtgaagcagcagtgcgtggacctgctggccgagggcctgtgggaggagctgctggacgacgagcagcccgccatcaccgtgatggactggttcgaggacagcagactggacgcctgcgtgtacgagctgcacgtgtggctgctggccgccgacagaagaaccgtgatcgcccagcaccacgtggcccccagaaccagcggcagaggcccccccggcagatgggtgcaggtgagccacgtgttcagacactacggccccggcgtgagattcatccacttcctgcacaaggccaagaacagaatggagcccggcggcctgagaagaaccagagtgaccgacagcagcgtgagcgtgcagctgagagagtag

SEQ ID NO: 22854 - DNA, 1413 bp, Artificial Sequence
  Description of Artificial Sequence: Synthetic coding sequence
atgggcctgtacgccgccgccgccggcgtgctggccggcgtggagagcagacagggcagcatcaagggcctggtgtacagcagcaacttccagaacgtgaagcagctgtacgccctggtgtgcgagacccagagatacagcgccgtgctggacgccgtgatcgccagcgccggcctgctgagagccgagaagaagctgagaccccacctggccaaggtgctggtgtacgagctgctgctgggcaagggcttcagaggcggcggcggcagatggaaggccctgctgggcagacaccaggccagactgaaggccgagctggccagactgaaggtgcacagaggcgtgagcagaaacgaggacctgctggaggtgggcagcagacccggccccgccagccagctgcccagattcgtgagagtgaacaccctgaagacctgcagcgacgacgtggtggactacttcaagagacagggcttcagctaccagggcagagccagcagcctggacgacctgagagccctgaagggcaagcacttcctgctggaccccctgatgcccgagctgctggtgttccccgcccagaccgacctgcacgagcaccccctgtacagagccggccacctgatcctgcaggacagagccagctgcctgcccgccatgctgctggaccccccccccggcagccacgtgatcgacgcctgcgccgcccccggcaacaagaccagccacctggccgccctgctgaagaaccagggcaagatcttcgccttcgacctggacgccaagagactggccagcatggccaccctgctggccagagccggcgtgagctgctgcgagctggccgaggaggacttcctggccgtgagccccagcgaccccagataccacgaggtgcactacatcctgctggaccccagctgcagcggcagcggcatgcccagcagacagctggaggagcccggcgccggcacccccagccccgtgagactgcacgccctggccggcttccagcagagagccctgtgccacgccctgaccttccccagcctgcagagactggtgtacagcacctgcagcctgtgccaggaggagaacgaggacgtggtgagagacgccctgcagcagaaccccggcgccttcagactggcccccgccctgcccgcctggccccacagaggcctgagcaccttccccggcgccgagcactgcctgagagccagccccgagaccaccctgagcagcggcttcttcgtggccgtgatcgagagagtggaggtgcccagcctgaccggccagagcatcagcaccagaacccacacccagcccagccccaaggagaaggaggagaccgccaagagcagaagcagatgcctgcacaccgccctgcacatcgccgaggcccccggctag

SEQ ID NO: 22855 - DNA, 1176 bp, Artificial Sequence
  Description of Artificial Sequence: Synthetic coding sequence
atgggcctgtacgccgccgccgccggcgtgctggccggcgtggagagcagacagggcagcatcaagggcctggtgtacagcagcaacttccagaacgtgaagcagctgtacgccctggtgtgcgagacccagagatacagcgccgtgctggacgccgtgatcgccagcgccggcctgctgagagccgagaagaagctgagaccccacctggccaaggtgcacagaggcgtgagcagaaacgaggacctgctggaggtgggcagcagacccggccccgccagccagctgcccagattcgtgagagtgaacaccctgaagacctgcagcgacgacgtggtggactacttcaagagacagggcttcagctaccagggcagagccagcagcctggacgacctgagagccctgaagggcaagcacttcctgctggaccccctgatgcccgagctgctggtgttccccgcccagaccgacctgcacgagcaccccctgtacagagccggccacctgatcctgcaggacagagccagctgcctgcccgccatgctgctggaccccccccccggcagccacgtgatcgacgcctgcgccgcccccggcaacaagaccagccacctggccgccctgctgaagaaccagggcaagatcttcgccttcgacctggacgccaagagactggccagcatggccaccctgctggccagagccggcgtgagctgctgcgagctggccgaggaggacttcctggccgtgagccccagcgaccccagataccacgaggtgcactacatcctgctggaccccagctgcagcggcagcggcatgcccagcagacagctggaggagcccggcgccggcacccccagccccgtgagactgcacgccctggccggcttccagcagagagccctgtgccacgccctgaccttccccagcctgcagagactggtgtacagcacctgcagcctgtgccaggaggagaacgaggacgtggtgagagacgccctgcagcagaaccccggcgccttcagactggcccccgccctgcccgcctggccccacagaggcctgagcaccttccccggcgccgagcactgcctgagagccagccccgagaccaccctgagcagcggcttcttcgtggccgtgatcgagagagtggaggtgcccagatag

SEQ ID NO: 22856 - DNA, 1023 bp, Artificial Sequence
  Description of Artificial Sequence: Synthetic coding sequence
atgctgacccagctgaaggccaagagcgagggcaagctggccaagcagatctgcaaggtggtgctggaccacttcgagaagcagtacagcaaggagctgggcgacgcctggaacaccgtgagagagatcctgaccagccccagctgctggcagtacgccgtgctgctgaacagattcaactaccccttcgagctggagaaggacctgcacctgaagggctaccacaccctgagccagggcagcctgcccaactaccccaagagcgtgaagtgctacctgagcagaacccccggcagaatccccagcgagagacaccagatcggcaacctgaagaagtactacctgctgaacgccgccagcctgctgcccgtgctggccctggagctgagagacggcgagaaggtgctggacctgtgcgccgcccccggcggcaagagcatcgccctgctgcagtgcgcctgccccggctacctgcactgcaacgagtacgacagcctgagactgagatggctgagacagaccctggagagcttcatcccccagcccctgatcaacgtgatcaaggtgagcgagctggacggcagaaagatgggcgacgcccagcccgagatgttcgacaaggtgctggtggacgccccctgcagcaacgacagaagctggctgttcagcagcgacagccagaaggccagctgcagaatcagccagagaagaaacctgcccctgctgcagatcgagctgctgagaagcgccatcaaggccctgagacccggcggcatcctggtgtacagcacctgcaccctgagcaaggccgagaaccaggacgtgatcagcgagatcctgaacagccacggcaacatcatgcccatggacatcaagggcatcgccagaacctgcagccacgacttcaccttcgcccccaccggccaggagtgcggcctgctggtgatccccgacaagggcaaggcctggggccccatgtacgtggccaagctgaagaagagctggagcaccggcaagtggtag

SEQ ID NO: 22857 - DNA, 1155 bp, Artificial Sequence
  Description of Artificial Sequence: Synthetic coding sequence
atggccgccctgaccctgagaggcgtgagagagctgctgaagagagtggacctggccaccgtgcccagaagacacagatacaagaagaagtgggccgccaccgagcccaagttccccgccgtgagactggccctgcagaacttcgacatgacctacagcgtgcagttcggcgacctgtggcccagcatcagagtgagcctgctgagcgagcagaagtacggcgccctggtgaacaacttcgccgcctgggaccacgtgagcgccaagctggagcagctgagcgccaaggacttcgtgaacgaggccatcagccactgggagctgcagagcgagggcggccagagcgccgcccccagccccgccagctgggcctgcagccccaacctgagatgcttcaccttcgacagaggcgacatcagcagattcccccccgccagacccggcagcctgggcgtgatggagtactacctgatggacgccgccagcctgctgcccgtgctggccctgggcctgcagcccggcgacatcgtgctggacctgtgcgccgcccccggcggcaagaccctggccctgctgcagaccggctgctgcagaaacctggccgccaacgacctgagccccagcagaatcgccagactgcagaagatcctgcacagctacgtgcccgaggagatcagagacggcaaccaggtgagagtgaccagctgggacggcagaaagtggggcgagctggagggcgacacctacgacagagtgctggtggacgtgccctgcaccaccgacagacacagcctgcacgaggaggagaacaacatcttcaagagaagcagaaagaaggagagacagatcctgcccgtgctgcaggtgcagctgctggccgccggcctgctggccaccaagcccggcggccacgtggtgtacagcacctgcagcctgagccacctgcagaacgagtacgtggtgcagggcgccatcgagctgctggccaaccagtacagcatccaggtgcaggtggaggacctgacccacttcagaagagtgttcatggacaccttctgcttcttcagcagctgccaggtgggcgagctggtgatccccaacctgatggccaacttcggccccatgtacttctgcaagatgagaagactgacctag

SEQ ID NO: 22858 - DNA, 1008 bp, Artificial Sequence
  Description of Artificial Sequence: Synthetic coding sequence
atgacctacagcgtgcagttcggcgacctgtggcccagcatcagagtgagcctgctgagcgagcagaagtacggcgccctggtgaacaacttcgccgcctgggaccacgtgagcgccaagctggagcagctgagcgccaaggacttcgtgaacgaggccatcagccactgggagctgcagagcgagggcggccagagcgccgcccccagccccgccagctgggcctgcagccccaacctgagatgcttcaccttcgacagaggcgacatcagcagattcccccccgccagacccggcagcctgggcgtgatggagtactacctgatggacgccgccagcctgctgcccgtgctggccctgggcctgcagcccggcgacatcgtgctggacctgtgcgccgcccccggcggcaagaccctggccctgctgcagaccggctgctgcagaaacctggccgccaacgacctgagccccagcagaatcgccagactgcagaagatcctgcacagctacgtgcccgaggagatcagagacggcaaccaggtgagagtgaccagctgggacggcagaaagtggggcgagctggagggcgacacctacgacagagtgctggtggacgtgccctgcaccaccgacagacacagcctgcacgaggaggagaacaacatcttcaagagaagcagaaagaaggagagacagatcctgcccgtgctgcaggtgcagctgctggccgccggcctgctggccaccaagcccggcggccacgtggtgtacagcacctgcagcctgagccacctgcagaacgagtacgtggtgcagggcgccatcgagctgctggccaaccagtacagcatccaggtgcaggtggaggacctgacccacttcagaagagtgttcatggacaccttctgcttcttcagcagctgccaggtgggcgagctggtgatccccaacctgatggccaacttcggccccatgtacttctgcaagatgagaagactgacctag

SEQ ID NO: 22859 - DNA, 1008 bp, Artificial Sequence; identical to SEQ ID NO: 22858
  Description of Artificial Sequence: Synthetic coding sequence

SEQ ID NO: 22860 - DNA, 1290 bp, Artificial Sequence
  Description of Artificial Sequence: Synthetic coding sequence
atgggcctgtacgccgccgccgccggcgtgctggccggcgtggagagcagacagggcagcatcaagggcctggtgtacagcagcaacttccagaacgtgaagcagctgtacgccctggtgtgcgagacccagagatacagcgccgtgctggacgccgtgatcgccagcgccggcctgctgagagccgagaagaagctgagaccccacctggccaaggtgctggtgtacgagctgctgctgggcaagggcttcagaggcggcggcggcagatggaaggccctgctgggcagacaccaggccagactgaaggccgagctggccagactgaaggtgcacagaggcgtgagcagaaacgaggacctgctggaggtgggcagcagacccggccccgccagccagctgcccagattcgtgagagtgaacaccctgaagacctgcagcgacgacgtggtggactacttcaagagacagggcttcagctaccagggcagagccagcagcctggacgacctgagagccctgaagggcaagcacttcctgctggaccccctgatgcccgagctgctggtgttccccgcccagaccgacctgcacgagcaccccctgtacagagccggccacctgatcctgcaggacagagccagctgcctgcccgccatgctgctggaccccccccccggcagccacgtgatcgacgcctgcgccgcccccggcaacaagaccagccacctggccgccctgctgaagaaccagggcaagatcttcgccttcgacctggacgccaagagactggccagcatggccaccctgctggccagagccggcgtgagctgctgcgagctggccgaggaggacttcctggccgtgagccccagcgaccccagataccacgaggtgcactacatcctgctggaccccagctgcagcggcagcggcatgcccagcagacagctggaggagcccggcgccggcacccccagccccgtgagactgcacgccctggccggcttccagcagagagccctgtgccacgccctgaccttccccagcctgcagagactggtgtacagcacctgcagcctgtgccaggaggagaacgaggacgtggtgagagacgccctgcagcagaaccccggcgccttcagactggcccccgccctgcccgcctggccccacagaggcctgagcaccttccccggcgccgagcactgcctgagagccagccccgagaccaccctgagcagcggcttcttcgtggccgtgatcgagagagtggaggtgcccagatag

SEQ ID NO: 22861 - DNA, 1401 bp, Artificial Sequence
  Description of Artificial Sequence: Synthetic coding sequence
atgggcctgtacgccgccgccgccggcgtgctggccggcgtggagagcagacagggcagcatcaagggcctggtgtacagcagcaacttccagaacgtgaagcagctgtacgccctggtgtgcgagacccagagatacagcgccgtgctggacgccgtgatcgccagcgccggcctgctgagagccgagaagaagctgagaccccacctggccaaggtgctggtgtacgagctgctgctgggcaagggcttcagaggcggcggcggcagatggaaggccctgctgggcagacaccaggccagactgaaggccgagctggccagactgaaggtgcacagaggcgtgagcagaaacgaggacctgctggaggtgggcagcagacccggccccgccagccagctgcccagattcgtgagagtgaacaccctgaagacctgcagcgacgacgtggtggactacttcaagagacagggcttcagctaccagggcagagccagcagcctggacgacctgagagccctgaagggcaagcacttcctgctggaccccctgatgcccgagctgctggtgttccccgcccagaccgacctgcacgagcaccccctgtacagagccggccacctgatcctgcaggacagagccagctgcctgcccgccatgctgctggaccccccccccggcagccacgtgatcgacgcctgcgccgcccccggcaacaagaccagccacctggccgccctgctgaagaaccagggcaagatcttcgccttcgacctggacgccaagagactggccagcatggccaccctgctggccagagccggcgtgagctgctgcgagctggccgaggaggacttcctggccgtgagccccagcgaccccagataccacgaggtgcactacatcctgctggaccccagctgcagcggcagcggcatgcccagcagacagctggaggagcccggcgccggcacccccagccccgtgagactgcacgccctggccggcttccagcagagagccctgtgccacgccctgaccttccccagcctgcagagactggtgtacagcacctgcagcctgtgccaggaggagaacgaggacgtggtgagagacgccctgcagcagaaccccggcgccttcagactggcccccgccctgcccgcctggccccacagaggcctgagcaccttccccggcgccgagcactgcctgagagccagccccgagaccaccctgagcagcggcttcttcgtggccgtgatcgagagagtggaggtgcccagcagcgccagccaggccaaggccagcgcccccgagagaacccccagccccgcccccaagagaaagaagagacagcagagagccgccgccggcgcctgcacccccccctgcacctag

SEQ ID NO: 22862 - DNA, 1410 bp, Artificial Sequence
  Description of Artificial Sequence: Synthetic coding sequence
atgagcatcttccccaagatcagcctgagacccgaggtggagaactacctgaaggagggcttcatgaacaaggagatcgtgaccgccctgggcaagcaggaggccgagagaaagttcgagaccctgctgaagcacctgagccacccccccagcttcaccaccgtgagagtgaacacccacctggccagcgtgcagcacgtgaagaacctgctgctggacgagctgcagaagcagttcaacggcctgagcgtgcccatcctgcagcaccccgacctgcaggacgtgctgctgatccccgtgatcggccccagaaagaacatcaagaagcagcagtgcgaggccatcgtgggcgcccagtgcggcaacgccgtgctgagaggcgcccacgtgtacgcccccggcatcgtgagcgccagccagttcatgaaggccggcgacgtgatcagcgtgtacagcgacatcaagggcaagtgcaagaagggcgccaaggagttcgacggcaccaaggtgttcctgggcaacggcatcagcgagctgagcagaaaggagatcttcagcggcctgcccgagctgaagggcatgggcatcagaatgaccgagcccgtgtacctgagccccagcttcgacagcgtgctgcccagatacctgttcctgcagaacctgcccagcgccctggtgagccacgtgctgaacccccagcccggcgagaagatcctggacctgtgcgccgcccccggcggcaagaccacccacatcgccgccctgatgcacgaccagggcgaggtgatcgccctggacaagatcttcaacaaggtggagaagatcaagcagaacgccctgctgctgggcctgaacagcatcagagccttctgcttcgacggcaccaaggccgtgaagctggacatggtggaggacaccgagggcgagccccccttcctgcccgagagcttcgacagaatcctgctggacgccccctgcagcggcatgggccagagacccaacatggcctgcacctggagcgtgaaggaggtggccagctaccagcccctgcagagaaagctgttcaccgccgccgtgcagctgctgaagcccgagggcgtgctggtgtacagcacctgcaccatcaccctggccgagaacgaggagcaggtggcctgggccctgaccaagttcccctgcctgcagctgcagccccaggagccccagatcggcggcgagggcatgagaggcgccggcctgagctgcgagcagctgaagcagctgcagagattcgaccccagcgccgtgcccctgcccgacaccgacatggacagcctgagagaggccagaagagaggacatgctgagactggccaacaaggacagcatcggcttcttcatcgccaagttcgtgaagtgcaagagcacctag

SEQ ID NO: 22863 - DNA, 2157 bp, Artificial Sequence
  Description of Artificial Sequence: Synthetic coding sequence
atgctgaacagcaccggcgagctggagttcagcaacgaggaggaccccgagatcatcagccagctgaccagcctgcccctgagcggcggcaagagcagcgccggcgtgcccgagaagaccggctaccccgacagcgtgtacgtgatggccgccaacatcttccagggcatcagaatcgagaagagcgcccagaaggtgctgatcaagtacggcaacgagcccctgagaagcctgagcgagagcgaggaccagagcttccagagactgagctacgagctggccttcagcgccctgaagtaccaggacatcctggagaccatcctgatcgacagctgcatcttccccagcaccaccatccccgaccacctgagcagcctgatcatcgtgatgctgtacgacttccaggacagaaagttccagaccagagtgctgagcgacaacgaggagcccatcagcgaggtgcaggaggtggagaacctgctgaacagcttcaagatcaagctggccgccgccctggccagatgcagaatcaagcacgacgccctgagcatctaccacatcctgcccgagaccgtgagaaagcaggagctgagagccagcaccctgcccctgtacgcctggatcaacacctgcaagatcagccccgaggaggtgtacaacaacctgaagagaagaggctacaacaaggtgaagagcgtgctgcacatcgacgacaaggtgttcgccgtggaccagcactgctacgacgtgctgatcttccccagccacctgaagaacgacctgatcaacatcgacctgttcaaggactacaagctgatcttccaggacaagagcagaagcctggccgtgcacagcgtgaaggccctgctgaacatggacgacgacgtgctgatggtgaacaccggcagctggtacaccgtgagccacatgagcatcctgaccaacaacaacaccagcaaggtgttcgtgtgcggcgtgcagagccaggccaaggaccccgacctgaagaccctgttcaccaagatcggctgcaagaacatcgagatcctgcacgagaagttcatcaacatcgagagcaaggaccacagactgcagaaggtgaaggtgatcctgctgctgcccagatgcagcggcctgggcgtgagcaaccccgtggagttcatcctgaacgagcacgaggacaccgagttcctgaaggaccacagccagggcggcatcagcgtggacaagctgcacgtgctggcccagcagcagtacgagcagctgacccacgccatgaagttcaccaaggcccaggccgtggtgtactgcacctgcagcgtgttccccgaggagaacgaggccgtggtgaagaaggccctggagttccaggacctgggcaacaagggccagccctacagactgagcccccccgtgctgcccctgtgcagcctgaaggagatccagctgagcaccgacaagttcttcagaatggagcccagcgagatcaccaacggctgcttcctgagcatcctgaccagagagagagaccccagcgagaccgtgagcgtgaacgacgtgctggccagagccgccgccaagggcctgctggacggcatcgagctgggcaagagcagcaagagagagaagaagaagaagaagagcaagaccagcctgaccaagggcgccaccaccgacaacggcatccagatgaagatcgccgagttcctgaacagagagaccaaggccagcgccaacctgagcgagaccgtgaccaagccccccctgccccagaagaacaccgcccaggtgggcgccagcagccagaccagaaagcccaacaagctggccccccaccccgccgtgcccgccttcgtgaagaacacctgccccagcagacccagagagagacagacccacttcctgagacccagacccgaggacagaatggtggccctgaagcccatcaagatcgtgctgccccccgtgttcatgcccttcagcagcccccagggcatcagaagcagaatgcccacccagcacctgtactgcagatgggtggcccccaaggccctggtgcccacctgcctgcccacccacagcctgagcagaaaggaggagaagcccaaggacgacacccccagcagcctgctgagaccccccagaagatggctgtag

SEQ ID NO: 22864 - DNA, 711 bp, Artificial Sequence
  Description of Artificial Sequence: Synthetic coding sequence
atgtgcgtgacctaccacaacggcaccggctactgcaagtgccccgagggcttcctgggcgagtactgccagcacagagacccctgcgagaagaacagatgccagaacggcggcacctgcgtggcccaggccatgctgggcaaggccacctgcagatgcgccagcggcttcaccggcgaggactgccagtacagcaccagccacccctgcttcgtgagcagaccctgcctgaacggcggcacctgccacatgctgagcagagacacctacgagtgcacctgccaggtgggcttcaccggcaaggagtgccagtggaccgacgcctgcctgagccacccctgcgccaacggcagcacctgcaccaccgtggccaaccagttcagctgcaagtgcctgaccggcttcaccggccagaagtgcgagaccgacgtgaacgagtgcgacatccccggccactgccagcacggcggcacctgcctgaacctgcccggcagctaccagtgccagtgcctgcagggcttcaccggccagtactgcgacagcctgtacgtgccctgcgcccccagcccctgcgtgaacggcggcacctgcagacagaccggcgacttcaccttcgagtgcaactgcctgcccgagaccgtgagaagaggcaccgagctgtgggagagagacagagaggtgtggaacggcaaggagcacgacgagaactag

SEQ ID NO: 22865 - DNA, 345 bp, Artificial Sequence
  Description of Artificial Sequence: Synthetic coding sequence
atgagccaggccgagctgagcacctgcagcgccccccagacccagagaatcttccaggaggccgtgagaaagggcaacacccaggagctgcagagcctgctgcagaacatgaccaactgcgagttcaacgtgaacagcttcggccccgagggccagaccgccctgcaccagagcgtgatcgacggcaacctggagctggtgaagctgctggtgaagttcggcgccgacatcagactggccaacagagacggctggagcgccctgcacatcgccgccttcggcggccaccaggacatcgtgctgtacctgatcaccaaggccaagtacgccgccagcggcagatag

SEQ ID NO: 22866 - DNA, 423 bp, Artificial Sequence
  Description of Artificial Sequence: Synthetic coding sequence
atgctgaccatcatgtgcggcttccagatgcagagccacctggccgccggcgacatgaagagactgggctacgacttcgaccacctgctgagccccgccctgcccatcagcaccagcgtggccagagagggccccagcctgatcaccctgagagccaccagagacgccgagtgcgccctgagcagcggcgccggccagggcgccggcagaggcgagaagacccccgccagccccaccaaccagcaccccggcctggaggagctgcagcaggccgccgacagagagttccacccccagcccgacagcagaaacagcgaggtgcaggacagagccagctgcagatgggagcccggcatggtgggcgccgccagcagcgccgccggcgagagcgtgtgcgtgcagggctgcagagtggcctgctag

SEQ ID NO: 22867 - DNA, 1602 bp, Artificial Sequence
  Description of Artificial Sequence: Synthetic coding sequence
atgatcagcagcagcagcgtgcacagcagaaccttcaacaccagcaacgccctgggccccgtgtgcaagcacaagaagcccctgagcgccgccaaggcctgcatcagcgagatcctgcccagcaagttcaagcccagactgagcgcccccagcgccctgctgcaggagcagaagagcatcctgctgcccagcgagaaggcccagagctgcgagaacctgtgcgtgagcggcagcctgaacgacagcaagagaggcctgcccctgcaggtgggcggcagcatcgagaacctgctgatgagaagcagaagagactacgacagcaagagcagcagcaccatgagcctgcaggagtacagcaccagcggcagaagaccctgccccctgagcagaaaggccggcatgcagttcaccatgctgtacagagacatgcaccagatcaacagaagcggcctgttcctgggcagcatcagcagcagcagcagcgtgagagacctggccagccacttcgagaagagcagcctggccctgagcagaggcgagctgggccccagccaggagggcagcgagcacatccccaagcacaccgtgagcagcagaatcaccgccttcgagcagctgatccagagaagcagaagcatgcccagcctggacctgagcggcagactgagcaagagccccacccccgtgctgagcagaggcagcctgaccagcgccagaagcgccgagagcctgctggagagcaccaagctgcaccccaaggagatggacggcatgaacagcagcggcgtgtacgccagccccacctgcagcaacatggcccaccacgccctgagcttcagaggcctggtgcccagcgagcccctgagcacctgcagcgacgacgtggacagatgcagcaacatcagcaccgacagcagagagggcagcggcggcagcgtgcacggcgacttccccaagcacagactgaacaagtgcaagggcacctgccccgccagctacaccagattcaccaccatcagaaagcacgagcagcagcagaccagcagacagcccgagtggagactggacgccagaggcgacaagagcaccctgctgagaaacatctacctgatgagccccctgcccttcagactgaagaagcccctgcaccaccaccccagacagcccagccccggcgacagcagcggcctgctggtgggccagaagcccgacctgcccagccagccccaccaggaccagccccccagcggcggcaagcccgtggtgcccaccagactgagcagcagacacaccatggccagactgagcagaagcagcgagcccagccaggagagacccaccgccctggaggactaccccagagccatcaacaacggcaacagcgtgccctacagcgaccacagcctggacagaaacaacaacccccagagcgagctggcccccagcagaggcggcggcatcctgtgcgtgtgcctggtgagccccgccagacccagcaccctgctggccctgagcagaccccccctgtgcccctggtgcagcttcagcggcctgagcttcgtgttctgcctgttctgcctggccatcaaccacggcagctag

SEQ ID NO: 22868 - DNA, 4533 bp, Artificial Sequence
  Description of Artificial Sequence: Synthetic coding sequence
atggccaccagagtggaggtgggcagcatcacccccctgaccgccgtgcccggcctgggcgagatgggcaaggaggagaccctgaccagaacctacttcctgcaggccggcgaggccagcggcgccccccccgccagaatcctggaggccaagagccccctgagaagccccgccagactgctgcccctgcccagactggcccccaagcccttcagcaaggagcaggacgtgaagagccccgtgcccagcctgagacccagcagcaccggccccagccccagcggcggcctgagcgaggagcccgccgccaaggacctggacaacagaatgcccggcctggtgggccaggaggtgggcagcggcgagggccccagaaccagcagccccctgttcaacaaggccgtgttcctgagacccagcagcagcaccatgatcctgttcgagaccaccaagagcggccccgccctgggcaaggccgtgagcgagggcgccgaggaggccaagctgggcgtgagcggcagcagacccgaggtggccgccaagcccgccctgcccacccagaagcccgccggcaccctgcccagaagcgcccccctgagccaggacaccaagccccccgtgccccaggaggaggccggccaggaccacccccccagcaaggccagcagcgtggaggacaccgccagacccctggtggagcccagacccagactgaagagaagacccgtgagcgccatcttcaccgagagcatccagccccagaagcccggccccggcgccgccgccaccgtgggcaaggtgccccccaccccccccgagaagacctgggtgagaaagcccagacccctgagcatggacctgaccgccagattcgagaacaaggaggccctgctgagaaaggtggccgacgagggcagcggccccaccgccggcgacatggccggcctggagagacccagagccgccagcaagctggacagagactgcctggtgaaggccgaggcccccctgcacgaccccgacctggacttcctggaggtggccaagaagatcagagagagaaaggagaagatgctgagcaagcccgagatgggcagccccagagccctggtgggcggcagcagcggcgtgacccccagcaacgaccagagcccctgggaggagaaggccaagctggaccccgagcccgagaaggccgccgagagccccagccccagactgggcagaggcctggagctggccgaggtgaagagcagagtggccgacggcgaggccgccgccggcggcgagtgggccagcagaagaagcgtgagaaagtgcatcagcctgttcagagaggacagcaccctggccctggccgtgggcagcgagagccccctggccacccccgccagccccagcgccgcccccgagcccgagaagggcgtggtgagcgtgcaggagagaatcagaggctggaccgccgagagcagcgaggccaagcccgaggtgagaagaagaaccttccaggccagacccctgagcgccgacctgaccaagctgttcagcagcagcgccagcagcaacgaggtgaagtacgagaagagcgccgagctgagcggcgagttccccaaggagcccagagagaagcagaaggagggccacagcctggacggcgcctgcatccccagaagcccctggaagcccggcaccctgagagacaagagcagacagaccgagcagaaggtgagcagcaaccaggaccccgacagctgcagaggcggcagcagcgtggaggccccctgccccagcgacgtgacccccgaggacgacagaagcttccagaccgtgtgggccaccgtgttcgagcaccacgtggagagacacaccgtggccgaccagagcggcagatgcctgagcaccaccccccccggcgacatggcccacgccagagtgagcgagcccagacccagacccgagatgggcagctggctgggcagagacccccccgacatgaccaagctgaagaaggagaacagcagaggcttcgacaaccccgagaccgagaagctgggccccaccaccctgctgaacggcgagctgagaccctaccacacccccctgagagacaagtaccccctgagcgagaaccacaacaacaacaccttcctgaagcacctggagaacccccccaccagccagagaatcgagcccagatacgacatcgtgcacgccgtgggcgagagagtgcacagcgaggccatcagccccgcccccgaggagaaggccgtgaccctgagaagcctgagaagctggctgagcctgaaggacagacagctgagccaggaggtgacccccgccgacctggagtgcggcctggagggccaggccggcagcgtgcagagagccagcctgatctgggaggccagaggcatgcccgaggccagcggccccaagttcggcggcaactgccccttccccaagtggaccggcggcgccgtggtgagcagccacaaggccaccgtggccgtgagcgaggagcactgcgcccccggcgccaccagcgtgagagccatcaaggccgccatctgggagagccagcacgagggccccgagggcgccagaagcaagcccggcgtgggcgccagaggccccccccagggctgccccctggaccccctgagcagagccaccaacggccccagcgacagccaggccagaacccaccccgacgccttcgccgtgcagaagggccccttcatcgtggccgccagagagggcgaccccggccccgcccaggtgccccagcccgccgtgagaatgagaaaggccggcgccatggaccagagaatggacagatggagaagaagaaccctgccccccaacgtgaagttcgacaccttcagcagcctggtgcccgaggacagcccccacgtgggccacagaagaaccgactacgtgagccccaccgccagcgccctgagaaagccccagctgagccactacagagtggagacccaggaggtgaaccccggcgccagcagagaccagaccagccccgccgtgaagcagggcagccccgtggagcccaaggccaccttcttcgccgtgacctaccagatccccaacacccagaaggccaagggcgtggtgctgagcggcgccgagagcctgctggagcacagcagaaagatcaccccccccagcagcccccacagcctgaccagcaccctggtgagcctgggccacgaggaggccctggagatggccggcagcaagaactggatgaagggcagagagcacgagaacgccagcatcctgaagaccctgaagcccaccgacagacccagcagcctgggcgcctggagcctggaccccttcaacggcagaatcatcgacgtggacgccctgtggagccacagaggcagcgaggacggccccagaccccagagcaactggaaggagagcgccaacaagatgagccccagcggcggcgccccccagaccacccccaccctgagaagcagacccaaggacctgcccgtgagaagaaagaccgacgtgatcagcgacaccttccccggcaagatcagagacggctacagaagcagcgtgctggacatcgacgccctgatggccgagtaccaggagctgagcctgaaggtgcccggcgaggcccaggagagaagaagccccaccgtggagcccagcaccctgcccagagagagacccgtgcagctgggcggcgtggagcagagaagaagaagcctgaaggagatgcccgacaccggcggcctgtggaagcccgccagcagcgccgagatcaaccacagcttcacccccggcctgggcaagcagctggccgagaccctggagaccgccatgggcaccaagagcagcccccccttctgggccctgccccccagcgcccccagcgagagataccccggcggcagccccatccccgccgaccccagaaagaagaccggcttcgccgaggacgacagaaaggccttcgccagcaagcaccacgtggccaagtgccagaactacctggccgagagcaagcccagcggcagagaggaccccggcagcggcgtgagagtgagccccaagagcccccccaccgaccagaagaagggcacccccagaaagagcaccggcagaggcgaggaggacagcgtggcccagtggggcgaccaccccagagactgcggcagagtgcccctggacatcaagagagcctacagcgagaagggcccccccgccaacatcagagagggcctgagcatcatgcacgaggccagagagagaagaagagagcagcccaagggcagacccagcctgaccggcgagaacctggaggccaagatgggcccctgctggtgggagagcggcaccggcgacagccacaaggtgctgcccagagacctggagaaggaggacgccccccaggagaaggagagacccctgcagcaggtgagccccgtggccagcgtgccctggagaagccacagcttctgcaaggacagaagaagcggccccttcgtgtag

SEQ ID NO: 22869 - DNA, 390 bp, Artificial Sequence
  Description of Artificial Sequence: Synthetic coding sequence
tgaatcagcgcctacttcgccaccggcagcagcatgacctaccacttccaggagcactacaccctgagcgagaacagcagcagcctggtgagcagcctgcacagagacgtgaccctgaccagagagatgatcaccctgagcttcagaaccaccagaacccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgatcccccagatgcagaagagcaactag

SEQ ID NO: 22870 - DNA, 543 bp, Artificial Sequence
  Description of Artificial Sequence: Synthetic coding sequence
tgaagagacgtgaccctgaccagagagatgatcaccctgagcttcagaaccaccagaacccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgaaccagagcgccaagaagcaggtgatcctgagcagcggcaccgagttcaacgccgtgaagagcctgatcctgggcaaggtgctgggcagaagcggccccgtggacgagggcgagcccctggtgaacgccgacagaagagacagcgccgtgatcggcggcgtgatcgccgtggagatcttcatcctgctgtgcatcaccgccatcgccatcagaatctaccagcagagaaagctgagaaaggagaacgagagcaaggtgagcaagaaggaggagtgctag

SEQ ID NO: 22871 - DNA, 873 bp, Artificial Sequence
  Description of Artificial Sequence: Synthetic coding sequence
tgaatcagcgcctacttcgccaccggcagcagcatgacctaccacttccaggagcactacaccctgagcgagaacagcagcagcctggtgagcagcctgcacagagacgtgaccctgaccagagagatgatcaccctgagcttcagaaccaccagaacccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgaaccagagcgccaagaagcaggtgatcctgagcagcggcaccgagttcaacgccgtgaagagcctgatcctgggcaaggtgctggaggccgccggcgccgaccccgacaccagaagagccgccaccagcggcttcaccggctgcctgagcgccgtgagattcggctgcgccgcccccctgaaggccgccctgagacccagcggccccagcagagtgaccgtgagaggccacgtggcccccatggccagatgcgccgccggcgccgccagcggcagccccgccagagagctggcccccagactggccggcggcgccggcagaagcggccccgtggacgagggcgagcccctggtgaacgccgacagaagagacagcgccgtgatcggcggcgtgatcgccgtggagatcttcatcctgctgtgcatcaccgccatcgccatcagaatctaccagcagagaaagctgagaaaggagaacgagagcaaggtgagcaagaaggaggagtgctag

SEQ ID NO: 22872 - DNA, 273 bp, Artificial Sequence
  Description of Artificial Sequence: Synthetic coding sequence
atgtggcactacatcggcgccgccgagtgcccctacctgcagctgcccagatgcagaggcagcagcaccagatactggcacaagaagagcagaggcagactgacctggccctggctgctgatgagccagctgagaacctgccacatcaacagccccttccccctggccgtgacctgcggcgtgaagttcagcgaggccgccgtgcccgtgcacctgagcggctgcgtgcagaagatgaacatctgcctgcagctgcagttcagcaacgactag

SEQ ID NO: 22873 - DNA, 312 bp, Artificial Sequence
  Description of Artificial Sequence: Synthetic coding sequence
atgcccctggagaagttcgtggacatggagttcctggaccagatgatcctgagaggcacctgcctggaggccgacctgtgcccccagtacaccaacagccccttcaacgcccacaccgaccagatcacccagacccacctgcccccccagcacctggacagcagccacagcacccacacctgcctgcccgtgcacagacacatccagagacacaccgacaagcaccacagcaagaagatgttccccagaacccacggccaccccaaccccagaatcatcagactgagccagagacacgtgtgcaccgcctag

SEQ ID NO: 22874 - DNA, 186 bp, Artificial Sequence
  Description of Artificial Sequence: Synthetic coding sequence
atggaggccagcctgggcggccccgagcccaacggcgtgatcaacgaggaggccaaggccggcgccaccggcaagagaagaggcagagcccccgccaacggcggcagagccagcggcgagaacagagccttccccgtgctgcagctgcccggcaactggcactgcagaagaagacagggctgctag

SEQ ID NO: 22875 - DNA, 342 bp, Artificial Sequence
  Description of Artificial Sequence: Synthetic coding sequence
atgggcagccccttctactgcaacggcggctactggctgcagagaaccgagtgctggagaaccatgaacgagttccacttcagaagcgcccagctggccgtgcccggcagacagccccaggagctgttcagaagacacagagccaccagcgcctggagcagcagaagaagaagcgccctggtggtgggcaccatcggccccggccacggcagactgcaggaccccagctgcaccaagctgcccagcccccccgcctggttccccttcttcatgaacagaagcatgggccacagccaggtgggcatgcacgtgttccacagaatgggcaccaccagcagctag

SEQ ID NO: 22876 - DNA, 780 bp, Artificial Sequence
  Description of Artificial Sequence: Synthetic coding sequence
atgaccatcaacatgctgaacgtgttcggcaacgaggacttcgactgccacggcgacctgaagaccgaccagctgaagatggacatcctgatcaagaagctgaagcagaagttcgacgacctgaccgccgagaaggaggccctgagcagcaagtgcgtgaacctggccaaggacaaccaggtgctgcagcaggagttcctgagcatgaagaaggtgcagcagcagtgcgagaagctggaggaggacaagaagatgctgaaggaggagatcctgaacctgaagacccacatggagaacaacagagtggagctgagcaagctgcaggagtacaagctggagctggacgagaaggccatgcaggccgtggagaagctggaggagatccacctgcaggagcaggcccagtacgagaagcagctggagcagctgagcaaggacaacatggccagcctgaacaagaaggagctgaccctgaaggacgtggagtgcaagttcagcgagatgaagaccgcctacgaggaggtgaccaccgagctggaggagtacaaggaggccttcgccgccgccctgaaggccaacaacagcatgagcaagaagctgaccaagagcaacaagaagatcgccgtgatcagcatgaagctgctgatggagaaggagcagatgaagtacttcctgagcgccctgcccaccagaagagaccccgagagcccctgcgtggagaacctgaccagcatcggcctgaacagaaagtacatcccccagacccccatcagaatctag

SEQ ID NO: 22877 - DNA, 519 bp, Artificial Sequence
  Description of Artificial Sequence: Synthetic coding sequence
tgatacaagaagctgctggagatgaccatcaacatgctgaacgtgttcggcaacgaggacttcgactgccacggcgacctgaagaccgaccagctgaagatggacatcctgatcaagaagctgaagcagaaggagcaggcccagtacgagaagcagctggagcagctgagcaaggacaacatggccagcctgaacaagaaggagctgaccctgaaggacgtggagtgcaagttcagcgagatgaagaccgcctacgaggaggtgaccaccgagctggaggagtacaaggaggccttcgccgccgccctgaaggccaacaacagcatgagcaagaagctgaccaagagcaacaagaagatcgccgtgatcagcatgaagctgctgatggagaaggagcagatgaagtacttcctgagcgccctgcccaccagaagagaccccgagagcccctgcgtggagaacctgaccagcatcggcctgaacagaaagtacatcccccagacccccatcagaatctag

SEQ ID NO: 22878 - DNA, 1602 bp, Artificial Sequence
  Description of Artificial Sequence: Synthetic coding sequence
atgagccagaccagcctgaagcagaagaagaacgagcccggcatgagaagcagcaaggagagcctggaggccgagaagagaaaggagagcgacaagaccggcgtgagactgagcaaccagggcagccaggagagcagcctgagaaagaccgacagcagaggctacctggtgagaagccagtggagcagaatcagcagaagccccagcaccaaggcccccagcatcgacgagcccagaagcagaaacaccagcgccaaggtggagctgcccagcagcagcaccagcagcagaacccccagcaccagccccagcctgcacgacagcagccccccccccctgagcggccagcccagcctgcagccccccgccagcccccagctgcccagaagcctggacagcagaccccccaccccccccgagcccgaccccggcagcagaagaagcaccaagatgcaggagaaccccgaggcctgggcccagggcatcgtgagagagatcagacagaccagagacagccagcccctggagtacagcagaaccagccccaccgagtggaagagcagcagccagagaagaggcatctaccccgccagcacccagctggacagaaacagcctgagcgagcagcagcagcagcagagagaggacgaggacgactacgaggccgcctactgggccagcatgagaagcttctacgagaagaaccccagctgcagcagaccctggccccccaagcccaagaacgccatcaccatcgccctgagcagctgcgccctgttcaacatggtggacggcagaaagatctacgagcaggagggcctggagaagtacatggagtaccagctgaccaacgagaacgtgatcctgacccccggccccgccttcagattcgtgaaggccctgcagtacgtgaacgccagactgagagacctgtaccccgacgagcaggacctgttcgacatcgtgctgatgaccaacaaccacgcccaggtgggcgtgagactgatcaacagcgtgaaccactacggcctgctgatcgacagattctgcctgaccggcggcaaggaccccatcggctacctgaaggcctacctgaccaacctgtacatcgccgccgacagcgagaaggtgcaggaggccatccaggagggcatcgccagcgccaccatgttcgacggcgccaaggacatggcctactgcgacacccagctgagagtggccttcgacggcgacgccgtgctgttcagcgacgagagcgagcacttcaccaaggagcacggcctggacaagttcttccagtacgacaccctgtgcgagagcaagcccctggcccaggaggagcccagactggacgtgctgatcaacaacgccggcatcttccagtgcccctacatgaagaccgaggacggcttcgagatgcagttcggcgtgaaccacctgggccacttcctgctgaccaacctgctgctgggcctgctgaagagcagcgcccccagcagaatcgtggtggtgagcagcaagctgtacaagtacggcgacatcaacttcgacgacctgaacagcgagcagagctacaacaagagcttctgctacagcagatag

SEQ ID NO: 22879 - DNA, 1809 bp, Artificial Sequence
  Description of Artificial Sequence: Synthetic coding sequence
atgagccagaccagcctgaagcagaagaagaacgagcccggcatgagaagcagcaaggagagcctggaggccgagaagagaaaggagagcgacaagaccggcgtgagactgagcaaccagatgagaagagccgtgaaccccaaccacagcctgagatgctgccccttccagggccacagcagctgcagaagatgcctgtgcgccgccgagggcaccgccctgggcccctgccacaccatcagaatctacatccacatgtgcctgctgtgggagcagggccagcagatcaccatgatgagaggcagccaggagagcagcctgagaaagaccgacagcagaggctacctggtgagaagccagtggagcagaatcagcagaagccccagcaccaaggcccccagcatcgacgagcccagaagcagaaacaccagcgccaagctgcccagcagcagcaccagcagcagaacccccagcaccagccccagcctgcacgacagcagccccccccccctgagcggccagcccagcctgcagccccccgccagcccccagctgcccagaagcctggacagcagaccccccaccccccccgagcccgaccccggcagcagaagaagcaccaagatgcaggagaaccccgaggcctgggcccagggcatcgtgagagagatcagacagaccagagacagccagcccctggagtacagcagaaccagccccaccgagtggaagagcagcagccagagaagaggcatctaccccgccagcacccagctggacagaaacagcctgagcgagcagcagcagcagcagagagaggacgaggacgactacgaggccgcctactgggccagcatgagaagcttctacgagaagaaccccagctgcagcagaccctggccccccaagcccaagaacgccatcaccatcgccctgagcagctgcgccctgttcaacatggtggacggcagaaagatctacgagcaggagggcctggagaagtacatggagtaccagctgaccaacgagaacgtgatcctgacccccggccccgccttcagattcgtgaaggccctgcagtacgtgaacgccagactgagagacctgtaccccgacgagcaggacctgttcgacatcgtgctgatgaccaacaaccacgcccaggtgggcgtgagactgatcaacagcgtgaaccactacggcctgctgatcgacagattctgcctgaccggcggcaaggaccccatcggctacctgaaggcctacctgaccaacctgtacatcgccgccgacagcgagaaggtgcaggaggccatccaggagggcatcgccagcgccaccatgttcgacggcgccaaggacatggcctactgcgacacccagctgagagtggccttcgacggcgacgccgtgctgttcagcgacgagagcgagcacttcaccaaggagcacggcctggacaagttcttccagtacgacaccctgtgcgagagcaagcccctggcccagggccccctgaagggcttcctggaggacctgggcagactgcagaagaagttctacgccaagaacgagagactgctgtgccccatcagaacctacctggtgaccgccagaagcgccgccagcagcggcgccagagtgctgaagaccctgagaagatggggcctggagatcgacgaggccctgttcctggccggcgcccccaagagccccatcctggtgaagatcagaccccacatcttcttcgacgaccacatgttccacatcgagggcgcccagagaaagagcctgggctggatgagctag

SEQ ID NO: 22880 - DNA, 1887 bp, Artificial Sequence
  Description of Artificial Sequence: Synthetic coding sequence
atggagagcctggtgttcgccagaagaagcggccccacccccagcgccgccgagctggccagacccctggccgagggcctgatcaagagccccaagcccctgatgaagaagcaggccgtgaagagacaccaccacaagcacaacctgagacacagatacgagttcctggagaccctgggcaagggcacctacggcaaggtgaagaaggccagagagagcagcggcagactggtggccatcaagagcatcagaaaggacaagatcaaggacgagcaggacctgatgcacatcagaagagagatcgagatcatgagcagcctgaaccacccccacatcatcgccatccacgaggtgttcgagaacagcagcaagatcgtgatcgtgatggagtacgccagcagaggcgacctgtacgactacatcagcgagagacagcagctgagcgagagagaggccagacacttcttcagacagatcgtgagcgccgtgcactactgccaccagaacagagtggtgcacagagacctgaagctggagaacatcctgctggacgccaacggcaacatcaagatcgccgacttcggcctgagcaacctgtaccaccagggcaagttcctgcagaccttctgcggcagccccctgtacgccagccccgagatcgtgaacggcaagccctacaccggccccgaggtggacagctggagcctgggcgtgctgctgtacatcctggtgcacggcaccatgcccttcgacggccacgaccacaagatcctggtgaagcagatcagcaacggcgcctacagagagccccccaagcccagcgacgcctgcggcctgatcagatggctgctgatggtgaaccccaccagaagagccaccctggaggacgtggccagccactggtgggtgaactggggctacgccaccagagtgggcgagcaggaggccccccacgagggcggccaccccggcagcgacagcgccagagccagcatggccgactggctgagaagaagcagcagacccctgctggagaacggcgccaaggtgtgcagcttcttcaagcagcacgcccccggcggcggcagcaccacccccggcctggagagacagcacagcctgaagaagagcagaaaggagaacgacatggcccagagcctgcacagcgacaccgccgacgacaccgcccacagacccggcaagagcaacctgaagctgcccaagggcatcctgaagaagaaggtgagcgccagcgccgagggcgtgcaggaggacccccccgagctgagccccatccccgccagccccggccaggccgcccccctgctgcccaagaagggcatcctgaagaagcccagacagagagagagcggctactacagcagccccgagcccagcgagagcggcgagctgctggacgccggcgacgtgttcgtgagcggcgaccccaaggagcagaagcccccccaggccagcggcctgctgctgcacagaaagggcatcctgaagctgaacggcaagttcagccagaccgccctggagctggccgcccccaccaccttcggcagcctggacgagctggccccccccagacccctggccagagccagcagacccagcggcgccgtgagcgaggacagcatcctgagcagcgagagcttcgaccagctggacctgcccgagagactgcccgagccccccctgagaggctgcgtgagcgtggacaacctgaccggcctggaggagccccccagcgagggccccggcagctgcctgagaagatggagacaggaccccctgggcgacagctgcttcagcctgaccgactgccaggaggtgaccgccacctacagacaggccctgagagtgtgcagcaagctgacctag

SEQ ID NO: 22881 - DNA, 462 bp, Artificial Sequence
  Description of Artificial Sequence: Synthetic coding sequence
atgagcaaggacctgaagatcctgtgcaaggaccccgccctggagctgagctgctacagagaccaccagttcagcggcagaaagttccagcaggagaagctgctgaaggagagcagcaccctgaacatgggcaacctgagcttctacaccaccgaggagaagatccacgagctgttcagcagaagcgacatcagaaacatcttcatgggcctggacaagatcaagaagaccgcctgcggcttctgcttcgtggagtgccacaacagagccgacgccgagaacgccatgagattcctgaccggcacctgcctggacgagtggatcatctgcaccgactgggacgtgggcttcagagagggccagcagtacggcagaggcaagagcggcggccaggtgagagacgagttcagagaggacttccacagcggcagaggcggcttcggcagacagacccagatctag

SEQ ID NO: 22882 - DNA, 831 bp, Artificial Sequence
  Description of Artificial Sequence: Synthetic coding sequence
atgcccaagacctgccagtgctacgtgggcaccaagaccaccaaccccagcgcctggcccagcagagagatgaagaagaagaagctgcccagcgacagcggcgacctggaggccctggagggcaaggacaaggagaaggagagcaccgtgcacatcgagacccaccagaacaccagcaagaacgtggccgccgtgcagcccatgaagagaggccagaagagcaagatgaagaagatgaaggagaagtacaaggaccaggacgaggaggacagagagctgatcatgaagctgctgggcagcgccggcagcaacaaggaggagaagggcaagaagggcaagaagggcaagaccaaggacgagcccgtgaagaagcagccccagaagcccagaggcggccagagagtgagcgacaacatcaagaaggagacccccttcctggaggtgatcacccacgagctgcaggacttcgccgtggacgacccccacgacgacaaggaggagcaggacctggaccagcagggcaacgaggagaacctgttcgacagcctgaccggccagccccaccccgaggacgtgctgctgttcgccatccccatctgcgccccctacaccaccatgaccaactacaagtacaaggtgaagctgacccccggcgtgcagaagaagggcaaggccgccaagaccgccctgaacagcttcatgcacagcaaggaggccaccgccagagagaaggacctgttcagaagcgtgaaggacaccgacctgagcagaaacatccccggcaaggtgaaggtgagcgcccccaacctgctgaacgtgaagagaaagtag

SEQ ID NO: 22883 - DNA, 2349 bp, Artificial Sequence
  Description of Artificial Sequence: Synthetic coding sequence
atggacagcagagtgatgagcaagtggatgaagaacctgaagctgaagggctacatcatccagaagagagagatcaagcccagcctggaggccgacaagcccgtggaggacatcctgacctacgaggagttccaccccttcctgttcagccagcacagccagtgcccctacatcgagttcgagagcttcgacaaggccgtggacgagttctacagcaagatcgagggccagaagatcgacctgaaggccctgcagcaggagaagcaggccctgaagaagctggacaacgtgagaaaggaccacgagaacagactggaggccctgcagcaggcccaggagatcgacaagctgaagggcgagctgatcgagatgaacctgcagatcgtggacagagccatccaggtggtgagaagcgccctggccaaccagatcgactggaccgagatcggcctgatcgtgaaggaggcccaggcccagggcgaccccgtggccagcgccatcaaggagctgaagctgcagaccaaccacgtgaccatgctgctgagaaacccctacctgctgagcgaggaggaggacgacgacgtggacggcgacgtgaacgtggagaagaacgagaccgagccccccaagggcaagaagaagaagcagaagaacaagcagctgcagaagccccagaagaacaagcccctgctggtggacgtggacctgagcctgagcgcctacgccaacgccaagaagtactacgaccacaagagatacgccgccaagaagacccagaagaccgtggaggccgccgagaaggccttcaagagcgccgagaagaagaccaagcagaccctgaaggaggtgcagaccgtgaccagcatccagaaggccagaaaggtgtactggttcgagaagttcctgtggttcatcagcagcgagaactacctgatcatcggcggcagagaccagcagcagaacgagatcatcgtgaagagatacctgacccccgagggcgacatctacgtgcacgccgacctgcacggcgccaccagctgcgtgatcaagaaccccaccggcgagcccatcccccccagaaccctgaccgaggccggcaccatggccctgtgctacagcgccgcctgggacgccagagtgatcaccagcgcctggtgggtgtaccaccaccaggtgagcaagaccgcccccaccggcgagtacctgaccaccggcagcttcatgatcagaggcaagaagaacttcctgccccccagctacctgatgatgggcttcagcttcctgttcaaggtggacgagagctgcgtgtggagacaccagggcgagagaaaggtgagagtgcaggacgaggacatggagaccctggccagctgcaccagcgagctgatcagcgaggagatggagcagctggacggcggcgacaccagcagcgacgaggacaaggaggagcacgagacccccgtggaggtggagctgatgacccaggtggaccaggaggacatcaccctgcagagcggcagagacgagctgaacgaggagctgatccaggaggagagcagcgaggacgagggcgagtacgaggaggtgagaaaggaccaggacagcgtgggcgagatgaaggacgagggcgaggagaccctgaactaccccgacaccaccatcgacctgagccacctgcagccccagagaagcatccagaagctggccagcaaggaggagagcagcaacagcagcgacagcaagagccagagcagaagacacctgagcgccaaggagagaagagagatgaagaagaagaagctgcccagcgacagcggcgacctggaggccctggagggcaaggacaaggagaaggagagcaccgtgcacatcgagacccaccagaacaccagcaagaacgtggccgccgtgcagcccatgaagagaggccagaagagcaagatgaagaagatgaaggagaagtacaaggaccaggacgaggaggacagagagctgatcatgaagctgctgggcagcgccggcagcaacaaggaggagaagggcaagaagggcaagaagggcaagaccaaggacgagcccgtgaagaagcagccccagaagcccagaggcggccagagagtgagcgacaacatcaagaaggagacccccttcctggaggtgatcacccacgagctgcaggacttcgccgtggacgacccccacgacgacaaggaggagcaggacctggaccagcagggcaacgaggagaacctgttcgacagcctgaccggccagccccaccccgaggacgtgctgctgttcgccatccccatctgcgccccctacaccaccatgaccaactacaagtag

SEQ ID NO: 22884 - DNA, 3105 bp, Artificial Sequence
  Description of Artificial Sequence: Synthetic coding sequence
atgaagagcagattcagcaccatcgacctgagagccgtgctggccgagctgaacgccagcctgctgggcatgagagtgaacaacgtgtacgacgtggacaacaagacctacctgatcagactgcagaagcccgacttcaaggccaccctgctgctggagagcggcatcagaatccacaccaccgagttcgagtggcccaagaacatgatgcccagcagcttcgccatgaagggcaacatcgtgctgaccgactacgagtacgtgatcctgaacatcctgagattcagaaccgacgaggccgacgacgtgaagttcgccgtgagagagagataccccctggaccacgccagagccgccgagcccctgctgaccctggagagactgaccgagatcgtggccagcgcccccaagggcgagctgctgaagagagtgctgaaccccctgctgccctacggccccgccctgatcgagcactgcctgctggagaacggcttcagcggcaacgtgaaggtggacgagaagctggagaccaaggacatcgagaaggtgctggtgagcctgcagaaggccgaggactacatgaagaccaccagcaacttcagcggcaagggctacatcatccagaagagagagatcaagcccagcctggaggccgacaagcccgtggaggacatcctgacctacgaggagttccaccccttcctgttcagccagcacagccagtgcccctacatcgagttcgagagcttcgacaaggccgtggacgagttctacagcaagatcgagggccagaagatcgacctgaaggccctgcagcaggagaagcaggccctgaagaagctggacaacgtgagaaaggaccacgagaacagactggaggccctgcagcaggcccaggagatcgacaagctgaagggcgagctgatcgagatgaacctgcagatcgtggacagagccatccaggtggtgagaagcgccctggccaaccagatcgactggaccgagatcggcctgatcgtgaaggaggcccaggcccagggcgaccccgtggccagcgccatcaaggagctgaagctgcagaccaaccacgtgaccatgctgctgagaaacccctacctgctgagcgaggaggaggacgacgacgtggacggcgacgtgaacgtggagaagaacgagaccgagccccccaagggcaagaagaagaagcagaagaacaagcagctgcagaagccccagaagaacaagcccctgctggtggacgtggacctgagcctgagcgcctacgccaacgccaagaagtactacgaccacaagagatacgccgccaagaagacccagaagaccgtggaggccgccgagaaggccttcaagagcgccgagaagaagaccaagcagaccctgaaggaggtgcagaccgtgaccagcatccagaaggccagaaaggtgtactggttcgagaagttcctgtggttcatcagcagcgagaactacctgatcatcggcggcagagaccagcagcagaacgagatcatcgtgaagagatacctgacccccggcgacatctacgtgcacgccgacctgcacggcgccaccagctgcgtgatcaagaaccccaccggcgagcccatcccccccagaaccctgaccgaggccggcaccatggccctgtgctacagcgccgcctgggacgccagagtgatcaccagcgcctggtgggtgtaccaccaccaggtgagcaagaccgcccccaccggcgagtacctgaccaccggcagcttcatgatcagaggcaagaagaacttcctgccccccagctacctgatgatgggcttcagcttcctgttcaaggtggacgagagctgcgtgtggagacaccagggcgagagaaaggtgagagtgcaggacgaggacatggagaccctggccagctgcaccagcgagctgatcagcgaggagatggagcagctggacggcggcgacaccagcagcgacgaggacaaggaggagcacgagacccccgtggaggtggagctgatgacccaggtggaccaggaggacatcaccctgcagagcggcagagacgagctgaacgaggagctgatccaggaggagagcagcgaggacgagggcgagtacgaggaggtgagaaaggaccaggacagcgtgggcgagatgaaggacgagggcgaggagaccctgaactaccccgacaccaccatcgacctgagccacctgcagccccagagaagcatccagaagctggccagcaaggaggagagcagcaacagcagcgacagcaagagccagagcagaagacacctgagcgccaaggagagaagagagatgaagaagaagaagctgcccagcgacagcggcgacctggaggccctggagggcaaggacaaggagaaggagagcaccgtgcacatcgagacccaccagaacaccagcaagaacgtggccgccgtgcagcccatgaagagaggccagaagagcaagatgaagaagatgaaggagaagtacaaggaccaggacgaggaggacagagagctgatcatgaagctgctgggcagcgccggcagcaacaaggaggagaagggcaagaagggcaagaagggcaagaccaaggacgagcccgtgaagaagcagccccagaagcccagaggcggccagagagtgagcgacaacatcaagaaggagacccccttcctggaggtgatcacccacgagctgcaggacttcgccgtggacgacccccacgacgacaaggaggagcaggacctggaccagcagggcaacgaggagaacctgttcgacagcctgaccggccagccccaccccgaggacgtgctgctgttcgccatccccatctgcgccccctacaccaccatgaccaactacaagtacaaggtgaagctgacccccggcgtgcagaagaagggcaaggccgccaagaccgccctgaacagcttcatgcacagcaaggaggccaccgccagagagaaggacctgttcagaagcgtgaaggacaccgacctgagcagaaacatccccggcaaggtgaaggtgagcgcccccaacctgctgaacgtgaagagaaagtag

SEQ ID NO: 22885 - DNA, 3168 bp, Artificial Sequence
  Description of Artificial Sequence: Synthetic coding sequence
atgaagagcagattcagcaccatcgacctgagagccgtgctggccgagctgaacgccagcctgctgggcatgagagtgaacaacgtgtacgacgtggacaacaagacctacctgatcagactgcagaagcccgacttcaaggccaccctgctgctggagagcggcatcagaatccacaccaccgagttcgagtggcccaagaacatgatgcccagcagcttcgccatgaagtgcagaaagcacctgaagagcagaagactggtgagcgccaagcagctgggcgtggacagaatcgtggacttccagttcggcagcgacgaggccgcctaccacctgatcatcgagctgtacgacagaggcaacatcgtgctgaccgactacgagtacgtgatcctgaacatcctgagattcagaaccgacgaggccgacgacgtgaagttcgccgtgagagagagataccccctggaccacgccagagccgccgagcccctgctgaccctggagagactgaccgagatcgtggccagcgcccccaagggcgagctgctgaagagagtgctgaaccccctgctgccctacggccccgccctgatcgagcactgcctgctggagaacggcttcagcggcaacgtgaaggtggacgagaagctggagaccaaggacatcgagaaggtgctggtgagcctgcagaaggccgaggactacatgaagaccaccagcaacttcagcggcaagggctacatcatccagaagagagagatcaagcccagcctggaggccgacaagcccgtggaggacatcctgacctacgaggagttccaccccttcctgttcagccagcacagccagtgcccctacatcgagttcgagagcttcgacaaggccgtggacgagttctacagcaagatcgagggccagaagatcgacctgaaggccctgcagcaggagaagcaggccctgaagaagctggacaacgtgagaaaggaccacgagaacagactggaggccctgcagcaggcccaggagatcgacaagctgaagggcgagctgatcgagatgaacctgcagatcgtggacagagccatccaggtggtgagaagcgccctggccaaccagatcgactggaccgagatcggcctgatcgtgaaggaggcccaggcccagggcgaccccgtggccagcgccatcaaggagctgaagctgcagaccaaccacgtgaccatgctgctgagaaacccctacctgctgagcgaggaggaggacgacgacgtggacggcgacgtgaacgtggagaagaacgagaccgagccccccaagggcaagaagaagaagcagaagaacaagcagctgcagaagccccagaagaacaagcccctgctggtggacgtggacctgagcctgagcgcctacgccaacgccaagaagtactacgaccacaagagatacgccgccaagaagacccagaagaccgtggaggccgccgagaaggccttcaagagcgccgagaagaagaccaagcagaccctgaaggaggtgcagaccgtgaccagcatccagaaggccagaaaggtgtactggttcgagaagttcctgtggttcatcagcagcgagaactacctgatcatcggcggcagagaccagcagcagaacgagatcatcgtgaagagatacctgacccccggcgagcccatcccccccagaaccctgaccgaggccggcaccatggccctgtgctacagcgccgcctgggacgccagagtgatcaccagcgcctggtgggtgtaccaccaccaggtgagcaagaccgcccccaccggcgagtacctgaccaccggcagcttcatgatcagaggcaagaagaacttcctgccccccagctacctgatgatgggcttcagcttcctgttcaaggtggacgagagctgcgtgtggagacaccagggcgagagaaaggtgagagtgcaggacgaggacatggagaccctggccagctgcaccagcgagctgatcagcgaggagatggagcagctggacggcggcgacaccagcagcgacgaggacaaggaggagcacgagacccccgtggaggtggagctgatgacccaggtggaccaggaggacatcaccctgcagagcggcagagacgagctgaacgaggagctgatccaggaggagagcagcgaggacgagggcgagtacgaggaggtgagaaaggaccaggacagcgtgggcgagatgaaggacgagggcgaggagaccctgaactaccccgacaccaccatcgacctgagccacctgcagccccagagaagcatccagaagctggccagcaaggaggagagcagcaacagcagcgacagcaagagccagagcagaagacacctgagcgccaaggagagaagagagatgaagaagaagaagctgcccagcgacagcggcgacctggaggccctggagggcaaggacaaggagaaggagagcaccgtgcacatcgagacccaccagaacaccagcaagaacgtggccgccgtgcagcccatgaagagaggccagaagagcaagatgaagaagatgaaggagaagtacaaggaccaggacgaggaggacagagagctgatcatgaagctgctgggcagcgccggcagcaacaaggaggagaagggcaagaagggcaagaagggcaagaccaaggacgagcccgtgaagaagcagccccagaagcccagaggcggccagagagtgagcgacaacatcaagaaggagacccccttcctggaggtgatcacccacgagctgcaggacttcgccgtggacgacccccacgacgacaaggaggagcaggacctggaccagcagggcaacgaggagaacctgttcgacagcctgaccggccagccccaccccgaggacgtgctgctgttcgccatccccatctgcgccccctacaccaccatgaccaactacaagtacaaggtgaagctgacccccggcgtgcagaagaagggcaaggccgccaagaccgccctgaacagcttcatgcacagcaaggaggccaccgccagagagaaggacctgttcagaagcgtgaaggacaccgacctgagcagaaacatccccggcaaggtgaaggtgagcgcccccaacctgctgaacgtgaagagaaagtag

SEQ ID NO: 22886 - DNA, 1383 bp, Artificial Sequence
  Description of Artificial Sequence: Synthetic coding sequence
atggccttccagacccaggccggcgcccagatccccatcgagagactggccagcgagagagccatcaccgtgaaggtgcccaacaacagcgactgggccgccagaggccacagaagcagcgccaacagcgtggtggtgcagccccaggccagcgtgggcgccgtggtgaccctggacagcagcaaccccgccgccgtgctgcacctgcagctgaactacaccctgctggacggcagatacctgagcgaggagcccgagccctacctggccgtgtacctgcacagcgagcccagacccaacgagcacaactgcagcgccagcagaagaatcagacccgagagcctgcagggcgccgaccacagaccctacaccttcttcatcagccccggcaccagagaccccgtgggcagctacagactgaacctgagcagccacttcagactgagcgccctggaggtgagcgtgggcctgtacaccagcctgtgccagtacttcagcgaggaggacgtggtgtggagaaccgagggcctgctgcccctggaggagaccagccccagacaggccgtgtgcctgaccagacacctgaccgccttcggcgccagcctgttcgtgccccccagccacgtgagattcgtgttccccgagcccaccgccgacgtgaactacatcgtgatgctgacctgcgccgtgtgcctggtgacctacatggtgatggccgccatcctgcacaagctggaccagctggacgccagcagaggcagagccatccccttctgcggccagagaggcagattcaagtacgagagcagcagcagacaggccggcgccggcgcccaggtgcccagacccacctgggccagctgctgcatgggctggaccgccggcgccgccaccggcacctggatggccaccgagcccagcaccgccaccgcctggaccagcagcggcagcccccccagaaccgcctgggtggcctgcggcagaagcgagtgcggcaccaccaagggcagcgccctgcccggcagctgcagcaccagcagcagcggcacctgcagaagacacaccgcccccagcagctggagcatgaccggcttcagatggagaagaagacccaccggcgcctggtggagaagaagatgctggcccagagtgacccagccctgctgcgccagcggcgcctgctggtggctgagctgcagcgccgccagcctgaccagcaccagcggcagcccctacggcaccggcagactggtggccgtgagcctggccagcagaggcccccccgccgccttcagcagcagcgccagcagctgggcccccaccccctgcggcaccggcctgctggtgaccctgcccaccgccagaggcatgtgccccggctag

SEQ ID NO: 22887 - DNA, 1332 bp, Artificial Sequence
  Description of Artificial Sequence: Synthetic coding sequence
atgagactgagattctggctgctgatctggctgctgctgggcttcatcagccaccagcccacccccgtgatcaacagcctggccgtgtacagacacagagagaccgacttcggcgtgggcgtgagagaccaccccggccagcacggcaagacccccagcccccagaagctggacaacctgatcatcatcatcatcggcttcctgagaagagacaccttcaccatcctgttctgcaccagctacctgtgcgtgagcttcctgaagaccatcttctggagcagaaacggccacgacggcagcaccgacgtgcagcagagagcctggagaagcaacagaagcagacagaagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaacagacacgacaagatcaacggcaagagaaagaccgccagaaagcagaagatgttccagagagcccaggagctgagaagaagagccgaggactaccacaagtgcaagatcccccccagcgccagaaagcccctgtgcaactgggtgagaatggccgccgccgagcacagacacagcagcggcctgccctgctggccctacctgaccgccgaggccctgaagaacagaatgggcagacagccccccccccccacccagcagcacagcatcaccgacaacagcctgagcctgaagaccccccccgagtgcctgctgcaccccctgccccccagcgtggacgacaacatcaaggagtgccccctggcccccctgccccccagcgtggacgacaacctgaaggagtacctgctggtgcccctgccccccagccccctgccccccagcgtggacgacaacctgaaggactgcctgttcgtgcccctgccccccagccccctgccccccagcgtggacgacaacctgaagaccccccccctggccacccaggaggccgaggccgagaagccccccaagcccaagagatggagagtggacgaggtggagcagagccccaagcccaagagaagaagagccgacgaggtggagcagagccccaagcccaagagacagagagaggccgaggcccagcagctgcccaagcccaagagaagaagactgagcaagctgagaaccagacactgcacccaggcctgggccatcagaatcaacccctgggtggagaagaagaagaagatcaagaagcagaacaagacccacgcccccaagaccaactag

SEQ ID NO: 22888 - DNA, 1983 bp, Artificial Sequence
  Description of Artificial Sequence: Synthetic coding sequence
atgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccttccacccccagagaatgatcagcagacacctgcccagcgtgagcagcctgcccttccacccccagctgcacccccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgctgagcgtgtgcggcggcagattccaccccgagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 22889 - DNA, 3189 bp, Artificial Sequence
  Description of Artificial Sequence: Synthetic coding sequence
atgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacccctgccccccagcgccccccccagcgccgacgacaacatcaagacccccgccgagagactgagaggccccctgccccccagcgccgacgacaacctgaagacccccagcgagagacacatcatgcccttccccagcgccgacgacaacatcaacacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccttccacccccagagaatgatcagcagacacctgcccagcgtgagcagcctgcccttccacccccagctgcacccccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgctgagcgtgtgcggcggcagattccaccccgagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 22890 - DNA, 2547 bp, Artificial Sequence
  Description of Artificial Sequence: Synthetic coding sequence
atggtgaagctgagcatcgtgctgaccccccagttcctgagccacgaccagggccagctgaccaaggagctgcagcagcacgtgaagagcgtgacctgcccctgcgagtacctgagaaaggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacccccagcagatgatcatcagcagacacctgcccagcgtgtgcggcggcagattccacccccagcccatgatcatcagcagacacctgcccagcgtgagcagcctgcccttccacccccagctgcacccccagcagatgatcatcagcagacacctgctgagcgtgtgcggcggcagattccaccccgagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 22891 - DNA, 2949 bp, Artificial Sequence
  Description of Artificial Sequence: Synthetic coding sequence
atgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagaagaacccccctgccccccagcgccccccccagcgccgacgacaacatcaagacccccgccgagagactgagaggccccctgccccccagcgccgacgacaacctgaagacccccagcgagagacacatcatgcccccccccagcgccgacgacaacatcaacacccccgccgagagactgagaggccccctgccccccagcgccgacgacaacctgaagacccccagcgagagacagctgacccccctgccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagatccccgccgagagactgagaatccccctgccccccagcgccgacgacaacctgaagacccccagcgagagacagctgacccccctgccccccagcgccccccccagcgccgacgacaacatcaagacccccggcttccaccccgagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagcagatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 22892 - DNA, 1263 bp, Artificial Sequence
  Description of Artificial Sequence: Synthetic coding sequence
atggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 22893 - DNA, 462 bp, Artificial Sequence
  Description of Artificial Sequence: Synthetic coding sequence
atggccgccgtggagcacagacacagcagcggcctgccctactggccctacctgaccgccgagaccctgaagaacagaatgggccaccagccccccccccccacccagcagcacagcatcatcgacaacagcctgagcctgaagacccccagcgagtgcgtgctgtaccccctgccccccagcgccgacgacaacctgaagaccccccccgagtgcctgctgacccccctgccccccagcgccctgcccagcgccgacgacaacctgaagacccccgccgagtgcctgctgtaccccctgccccccagcgccgacgacaacctgaagaccccccccgagtgcctgctgacccccctgccccccagcgccccccccagcgccgacgacaacctgaagaccccccccgagtgcgtgtgcagcctgcccttccacccccagagaatgatcatcagcagaaactag

SEQ ID NO: 22894 - DNA, 528 bp, Artificial Sequence
  Description of Artificial Sequence: Synthetic coding sequence
atgaaggtgaccaccaaggtgaacagacacgacaagatcaacggcaagagaaagaccgccaaggagcacctgagaaagctgagcatgaaggagagagagcacagagaggaggagagacaggtgagcgaggccgaggagaacggcaagctggacatgaaggagatccacacctacatggagatgttccagagagcccaggccctgagaagaagagccgaggactactacagatgcaagatcacccccagcgccagaaagcccctgtgcaacagagtgagcctgctggtgttcctggccttcggccacagcctgcccggccaggacatggacaccttcttcagcctgagactgtgcgcccaggccctgcagagagagatggccgagagaaaggccgcctacaagcaccacagccccatccccgtgggcaactgcgtggcccagaagcacctgcacccccaccccgtgggcccccccagcaacatcctgagcgtgagaggcagcgtgttcgtgatcgccaacggcccctag

SEQ ID NO: 22895 - DNA, 1062 bp, Artificial Sequence
  Description of Artificial Sequence: Synthetic coding sequence
atgagactgagattctggctgctgatctggctgctgctgggcttcatcagccaccagcccacccccgtgagcttcctgaagaccatcttctggagcagaaacggccacgacggcagcatggacgtgcagcagagagcctggagaagcaacagaagcagacagaagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaacagacacgacaagatcaacggcaagagaaagaccgccagaaagcagaagatgttccagagagcccaggagctgagaagaagagccgaggactaccacaagtgcaagatcccccccagcgccagaaagcccctgtgcaactgggtgagaatggccgccgccgagcacagacacagcagcggcctgccctactggctgtacctgaccgccgagaccctgaagaacagaatgggcagacagccccccccccccacccagcagcacagcatcaccgacaacagcctgagcctgaagaccccccccgagtgcctgctgacccccctgccccccagcgtggacgacaacatcaaggagtgccccctggcccccctgccccccagccccctgccccccagcgtggacgacaacctgaaggagtgcctgttcgtgcccctgccccccagccccctgccccccagcgtggacgacaacctgaaggagtgcctgttcgtgcccctgccccccagccccctgccccccagcgtggacgacaacctgaagaccccccccctggccacccaggaggccgaggtggagaagccccccaagcccaagagatggagagtggacgaggtggagcagagccccaagcccaagagacagagagaggccgaggcccagcagctgcccaagcccaagagaagaagactgagcaagctgagaaccagacactgcacccaggcctgggccatcagaatcaacccctag

SEQ ID NO: 22896 - DNA, 294 bp, Artificial Sequence
  Description of Artificial Sequence: Synthetic coding sequence
atggaggcccccgccgagagagccctgcccagactgcaggccctggccagaccccccccccccatcagctacgaggaggagctgtacgactgcctggactactactacctgagagacttccccgcctgcggcgccggcagaagcaagggcagaaccagaagagagcaggccctgagaaccaactggcccgcccccggcggccacgagagaaaggtggcccagaagctgctgaacggccagagaaagagaagacagagacagctgcaccccaagatgagaaccagactgacctag

SEQ ID NO: 22897 - DNA, 1845 bp, Artificial Sequence
  Description of Artificial Sequence: Synthetic coding sequence
atgaacaccttccaggaccagagcggcagcagcagcaacagagagcccctgctgagatgcagcgacgccagaagagacctggagctggccatcggcggcgtgctgagagccgagcagcagatcaaggacaacctgagagaggtgaaggcccagatccacagctgcatcagcagacacctggagtgcctgagaagcagagaggtgtggctgtacgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgagcgtgtgcctggagagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcaccaactgccagggcaaccagcccaagggcgtggagatcgagaacctgggcaacctgaagtgcctgaacgaccacctggaggccaagaagcccctgagcacccccagcatggtgaccgaggactggctggtgcagaaccaccaggacccctgcaaggtggaggaggtgtgcagagccaacgagccctgcaccagcttcgccgagtgcgtgtgcgacgagaactgcgagaaggaggccctgtacaagtggctgctgaagaaggagggcaaggacaagaacggcatgcccgtggagcccaagcccgagcccgagaagcacaaggacagcctgaacatgtggctgtgccccagaaaggaggtgatcgagcagaccaaggcccccaaggccatgacccccagcagaatcgccgacagcttccaggtgatcaagaacagccccctgagcgagtggctgatcagacccccctacaaggagggcagccccaaggaggtgcccggcaccgaggacagagccggcaagcagaagttcaagagccccatgaacaccagctggtgcagcttcaacaccgccgactgggtgctgcccggcaagaagatgggcaacctgagccagctgagcagcggcgaggacaagtggctgctgagaaagaaggcccaggaggtgctgctgaacagccccctgcaggaggagcacaacttcccccccgaccactacggcctgcccgccgtgtgcgacctgttcgcctgcatgcagctgaaggtggacaaggagaagtggctgtacagaacccccctgcagatgtag

SEQ ID NO: 22898 - DNA, 1845 bp, Artificial Sequence; identical to SEQ ID NO: 22897
  Description of Artificial Sequence: Synthetic coding sequence

SEQ ID NO: 22899 - DNA, 1845 bp, Artificial Sequence; identical to SEQ ID NO: 22897
  Description of Artificial Sequence: Synthetic coding sequence

SEQ ID NO: 22900 - DNA, 1209 bp, Artificial Sequence
  Description of Artificial Sequence: Synthetic coding sequence
atgccccacagcgccggcggcaccgccggcgtgggcctggaggccgccgagcccaccgccctgctgaccagagccgagccccccagcgagcccaccgagatcagaccccagaagagaaagaagggccccgcccccaagatgctgggcaacgagctgtgcagcgtgtgcggcgacaaggccagcggcttccactacaacgtgctgagctgcgagggctgcaagggcttcttcagaagaagcgtgatcaagggcgcccactacatctgccacagcggcggccactgccccatggacacctacatgagaagaaagtgccaggagtgcagactgagaaagtgcagacaggccggcatgagagaggagtgcgtgctgagcgaggagcagatcagactgaagaagctgaagagacaggaggaggagcaggcccacgccaccagcctgccccccagagccagcagccccccccagatcctgccccagctgagccccgagcagctgggcatgatcgagaagctggtggccgcccagcagcagtgcaacagaagaagcttcagcgacagactgagagtgaccccctggcccatggcccccgacccccacagcagagaggccagacagcagagattcgcccacttcaccgagctggccatcgtgagcgtgcaggagatcgtggacttcgccaagcagctgcccggcttcctgcagctgagcagagaggaccagatcgccctgctgaagaccagcgccatcgaggtgatgctgctggagaccagcagaagatacaaccccggcagcgagagcatcaccttcctgaaggacttcagctacaacagagaggacttcgccaaggccggcctgcaggtggagttcatcaaccccatcttcgagttcagcagagccatgaacgagctgcagctgaacgacgccgagttcgccctgctgatcgccatcagcatcttcagcgccgacagacccaacgtgcaggaccagctgcaggtggagagactgcagcacacctacgtggaggccctgcacgcctacgtgagcatccaccacccccacgacagactgatgttccccagaatgctgatgaagctggtgagcctgagaaccctgagcagcgtgcacagcgagcaggtgttcgccctgagactgcaggacaagaagctgccccccctgctgagcgagatctgggacgtgcacgagtag

SEQ ID NO: 22901 - DNA, 1164 bp, Artificial Sequence
  Description of Artificial Sequence: Synthetic coding sequence
atgagcctgtggctgggcgcccccgtgcccgacatcccccccgacagcgccgtggagctgtggaagcccggcgcccaggacgccagcagccaggcccagggcggcagcagctgcatcctgagagaggaggccagaatgccccacagcgccggcggcaccgccggcgtgggcctggaggccgccgagcccaccgccctgctgaccagagccgagccccccagcgagcccaccgagatcagaccccagaagagaaagaagggccccgcccccaagatgctgggcaacgagctgtgcagcgtgtgcggcgacaaggccagcggcttccactacaacgtgctgagctgcgagggctgcaagggcttcttcagaagaagcgtgatcaagggcgcccactacatctgccacagcggcggccactgccccatggacacctacatgagaagaaagtgccaggagtgcagactgagaaagtgcagacaggccggcatgagagaggagtgcgtgctgagcgaggagcagatcagactgaagaagctgaagagacaggaggaggagcaggcccacgccaccagcctgccccccagagccagcagccccccccagatcctgccccagctgagccccgagcagctgggcatgatcgagaagctggtggccgcccagcagcagtgcaacagaagaagcttcagcgacagactgagagtgaccgtgatgctgctggagaccagcagaagatacaaccccggcagcgagagcatcaccttcctgaaggacttcagctacaacagagaggacttcgccaaggccggcctgcaggtggagttcatcaaccccatcttcgagttcagcagagccatgaacgagctgcagctgaacgacgccgagttcgccctgctgatcgccatcagcatcttcagcgccgacagacccaacgtgcaggaccagctgcaggtggagagactgcagcacacctacgtggaggccctgcacgcctacgtgagcatccaccacccccacgacagactgatgttccccagaatgctgatgaagctggtgagcctgagaaccctgagcagcgtgcacagcgagcaggtgttcgccctgagactgcaggacaagaagctgccccccctgctgagcgagatctgggacgtgcacgagtag

SEQ ID NO: 22902 - DNA, 1164 bp, Artificial Sequence; identical to SEQ ID NO: 22901
  Description of Artificial Sequence: Synthetic coding sequence

SEQ ID NO: 22903 - DNA, 609 bp, Artificial Sequence
  Description of Artificial Sequence: Synthetic coding sequence
atgagcctgtggctgggcgcccccgtgcccgacatcccccccgacagcgccgtggagctgtggaagcccggcgcccaggacgccagcagccaggcccagggcggcagcagctgcatcctgagagaggaggccagaatgccccacagcgccggcggcaccgccggcgtgggcctggaggccgccgagcccaccgccctgctgaccagagccgagccccccagcgagcccaccgagatcagaccccagaagagaaagaagggccccgcccccaagatgctgggcaacgagctgtgcagcgtgtgcggcgacaaggccagcggcttccactacaacgtgctgagctgcgagggctgcaagggcttcttcagaagaagcgtgatcaagggcgcccactacatctgccacagcggcggccactgccccatggacacctacatgagaagaaagtgccaggagtgcagactgagaaagtgcagacaggccggcatgagagaggagtgcgtgctgagcgaggagcagatcagactgaagaagctgaagagacaggaggaggagcaggcccacgccaccagcctgccccccagagccagcagccccccccagatctag

SEQ ID NO: 22904 - DNA, 207 bp, Artificial Sequence
  Description of Artificial Sequence: Synthetic coding sequence
atgagcctgtggctgggcgcccccgtgcccgacatcccccccgacagcgccgtggagctgtggaagcccggcgcccaggacgccagcagccaggcccagggcggcagcagctgcatcctgagagaggaggccagaatgccccacagcgccggcggcaccgccggcgtgggcctggaggccgccgagcccaccgccctgctgacctag

SEQ ID NO: 22905 - DNA, 1344 bp, Artificial Sequence
  Description of Artificial Sequence: Synthetic coding sequence
atgagcctgtggctgggcgcccccgtgcccgacatcccccccgacagcgccgtggagctgtggaagcccggcgcccaggacgccagcagccaggcccagggcggcagcagctgcatcctgagagaggaggccagaatgccccacagcgccggcggcaccgccggcgtgggcctggaggccgccgagcccaccgccctgctgaccagagccgagccccccagcgagcccaccgagatcagaccccagaagagaaagaagggccccgcccccaagatgctgggcaacgagctgtgcagcgtgtgcggcgacaaggccagcggcttccactacaacgtgctgagctgcgagggctgcaagggcttcttcagaagaagcgtgatcaagggcgcccactacatctgccacagcggcggccactgccccatggacacctacatgagaagaaagtgccaggagtgcagactgagaaagtgcagacaggccggcatgagagaggagtgcgtgctgagcgaggagcagatcagactgaagaagctgaagagacaggaggaggagcaggcccacgccaccagcctgccccccagagccagcagccccccccagatcctgccccagctgagccccgagcagctgggcatgatcgagaagctggtggccgcccagcagcagtgcaacagaagaagcttcagcgacagactgagagtgaccccctggcccatggcccccgacccccacagcagagaggccagacagcagagattcgcccacttcaccgagctggccatcgtgagcgtgcaggagatcgtggacttcgccaagcagctgcccggcttcctgcagctgagcagagaggaccagatcgccctgctgaagaccagcgccatcgaggtgatgctgctggagaccagcagaagatacaaccccggcagcgagagcatcaccttcctgaaggacttcagctacaacagagaggacttcgccaaggccggcctgcaggtggagttcatcaaccccatcttcgagttcagcagagccatgaacgagctgcagctgaacgacgccgagttcgccctgctgatcgccatcagcatcttcagcgccgacagacccaacgtgcaggaccagctgcaggtggagagactgcagcacacctacgtggaggccctgcacgcctacgtgagcatccaccacccccacgacagactgatgttccccagaatgctgatgaagctggtgagcctgagaaccctgagcagcgtgcacagcgagcaggtgttcgccctgagactgcaggacaagaagctgccccccctgctgagcgagatctgggacgtgcacgagtag

SEQ ID NO: 22906 - DNA, 585 bp, Artificial Sequence
  Description of Artificial Sequence: Synthetic coding sequence
atgagcctgtggctgggcgcccccgtgcccgacatcccccccgacagcgccgtggagctgtggaagcccggcgcccaggacgccagcagccaggcccagggcggcagcagctgcatcctgagagaggaggccagaatgccccacagcgccggcggcaccgccggcgtgggcctggaggccgccgagcccaccgccctgctgaccagagccgagccccccagcgagcccaccgagatcagaccccagaagagaaagaagggccccgcccccaagatgctgggcaacgagctgtgcagcgtgtgcggcgacaaggccagcggcttccactacaacgtgctgagctgcgagggctgcaagggcttcttcagaagaagcgtgatcaagggcgcccactacatctgccacagcggcggccactgccccatggacacctacatgagaagaaagtgccaggagtgcagactgagaaagtgcagacaggccggcatgagagaggagtgcgtgctgagcgaggagcagatcagactgaagaagctgaagagacaggaggaggagcaggcccacgccaccagcctgcccccctag

SEQ ID NO: 22907 - DNA, 618 bp, Artificial Sequence
  Description of Artificial Sequence: Synthetic coding sequence
atgagcctgtggctgggcgcccccgtgcccgacatcccccccgacagcgccgtggagctgtggaagcccggcgcccaggacgccagcagccaggcccagggcggcagcagctgcatcctgagagaggaggccagaatgccccacagcgccggcggcaccgccggcgtgggcctggaggccgccgagcccaccgccctgctgaccagagccgagccccccagcgagcccaccgagatcagaccccagaagagaaagaagggccccgcccccaagatgctgggcaacgagctgtgcagcgtgtgcggcgacaaggccagcggcttccactacaacgtgctgagctgcgagggctgcaagggcttcttcagaagaagcgtgatcaagggcgcccactacatctgccacagcggcggccactgccccatggacacctacatgagaagaaagtgccaggagtgcagactgagaaagtgcagacaggccggcatgagagaggagtgcgtgctgagcgaggagcagatcagactgaagaagctgaagagacaggaggaggagcaggcccacgccaccagcctgccccccagagccagcagccccccccagatcctgccccagtag

SEQ ID NO: 22908 - DNA, 234 bp, Artificial Sequence
  Description of Artificial Sequence: Synthetic coding sequence
atgagcctgtggctgggcgcccccgtgcccgacatcccccccgacagcgccgtggagctgtggaagcccggcgcccaggacgccagcagccaggcccagggcggcagcagctgcatcctgagagaggaggccagaatgccccacagcgccggcggcaccgccggcgtgggcctggaggccgccgagcccaccgccctgctgaccagagccgagccccccagcgagcccacctag

SEQ ID NO: 22909 - DNA, 1344 bp, Artificial Sequence; identical to SEQ ID NO: 22905
  Description of Artificial Sequence: Synthetic coding sequence

SEQ ID NO: 22910 - DNA, 1881 bp, Artificial Sequence
  Description of Artificial Sequence: Synthetic coding sequence
atgtgcagcaccctgaagaagtgcggcacctacagaaccgaggtggccgagtgccacgaccacggcagcaccttccagggcagaaagaagggcggcagcagcttcagagacaacttcgacaagagaagctgccactacgagcacggcggctacgagagaccccccagccactgccaggagaacgacggcagcgtggagatgagagacgtgcacaaggaccagcagctgagacacaccccctacagcatcagatgcgagagaagaatgaagtggcacagcgaggacgagatcagaatcaccacctggagaaacagaaagccccccgagagaaagatgagccagaacacccaggacggctacaccagaaactggttcaaggtgaccatcccctacggcatcaagtacgacaaggcctggctgatgaacagcatccagagccactgcagcgacagattcacccccgtggacttccactacgtgagaaacagagcctgcttcttcgtgcaggacgccagcgccgccagcgccctgaaggacgtgagctacaagatctacgacgacgagaaccagaagatctgcatcttcgtgaaccacagcaccgccccctacagcgtgaagaacaagctgaagcccggccagatggagatgctgaagctgaccatgaacaagagatacaacgtgagccagcaggccctggacctgcagaacctgagattcgaccccgacctgatgggcagagacatcgacatcatcctgaacagaagaaactgcatggccgccaccctgaagatcatcgagagaaacttccccgagctgctgagcctgaacctgtgcaacaacaagctgtaccagctggacggcctgagcgacatcaccgagaaggcccccaaggtgaagaccctgaacctgagcaagaacaagctggagagcgcctgggagctgggcaaggtgaagggcctgaagctggaggagctgtggctggagggcaaccccctgtgcagcaccttcagcgaccagagcgcctacgtgagcgccatcagagactgcttccccaagctgctgagactggacggcagagagctgagcgcccccgtgatcgtggacatcgacagcagcgagaccatgaagccctgcaaggagaacttcaccggcagcgagaccctgaagcacctggtgctgcagttcctgcagcagtactacagcatctacgacagcggcgacagacagggcctgctgggcgcctaccacgacgaggcctgcttcagcctggccatccccttcgaccccaaggacagcgcccccagcagcctgtgcaagtacttcgaggacagcagaaacatgaagaccctgaaggacccctacctgaagggcgagctgctgagaagaaccaagagagacatcgtggacagcctgagcgccctgcccaagacccagcacgacctgagcagcatcctggtggacgtgtggtgccagaccgagagaatgctgtgcttcagcgtgaacggcgtgttcaaggaggtggagggccagagccagggcagcgtgctggccttcaccagaaccttcatcgccacccccggcagcagcagcagcctgtgcatcgtgaacgacgagctgttcgtgagagacgccagcccccaggagacccagagcgccttcagcatccccgtgagcaccctgagcagcagcagcgagcccagcctgagccaggagcagcaggagatggtgcaggccttcagcgcccagagcggcatgaagctggagtggagccagaagtgcctgcaggacaacgagtggaactacaccagagccggccaggccttcaccatgctgcagaccgagggcaagatccccgccgaggccttcaagcagatcagctag

SEQ ID NO: 22911 - DNA, 1881 bp, Artificial Sequence; identical to SEQ ID NO: 22910
  Description of Artificial Sequence: Synthetic coding sequence

SEQ ID NO: 22912 - DNA, 471 bp, Artificial Sequence
  Description of Artificial Sequence: Synthetic coding sequence
atggtggacatcctgggcgagagacacctggtgacctgcaagggcgccaccgtggaggccgaggccgccctgcagaacaaggtggtggccctgtacttcgccgccgccagatgcgcccccagcagagacttcacccccctgctgtgcgacttctacaccgccctggtggccgaggccagaagacccgcccccttcgaggtggtgttcgtgagcgccgacggcagcagccaggagatgctggacttcatgagagagctgcacggcgcctggctggccctgcccttccacgacccctacagacacgagctgagaaagagatacaacgtgaccgccatccccaagctggtgatcgtgaagcagaacggcgaggtgatcaccaacaagggcagaaagcagatcagagagagaggcctggcctgcttccaggactgggtggaggccgccgacatcttccagaacttcagcgtgtag

SEQ ID NO: 22913 - DNA, 408 bp, Artificial Sequence
  Description of Artificial Sequence: Synthetic coding sequence
atggtggacatcctgggcgagagacacctggtgacctgcaagggcgccaccgtggaggccgaggccgccctgcagaacaaggtggtggccctgtacttcgccgccgccagatgcgcccccagcagagacttcacccccctgctgtgcgacttctacaccgccctggtggccgaggccagaagacccgcccccttcgaggtggtgttcgtgagcgccgacggcagcagccaggagatgctggacttcatgagagagctgcacggcgcctggctggccctgcccttccacgacccctacagacagagaagcctggccctgctgcccagactggagtgcagcggcgtgatcctggcccactgcaacctgtgcctgctgggcagcagcgacagcctggccctggccagctag

SEQ ID NO: 22914 - DNA, 687 bp, Artificial Sequence
  Description of Artificial Sequence: Synthetic coding sequence
atggccagacacgtgttcctgaccggcccccccggcgtgggcaagaccaccctgatccacaaggccagcgaggtgctgaagagcagcggcgtgcccgtggacggcttctacaccgaggaggtgagacagggcggcagaagaatcggcttcgacgtggtgaccctgagcggcaccagaggccccctgagcagagtgggcctggagcccccccccggcaagagagagtgcagagtgggccagtacgtggtggacctgaccagcttcgagcagctggccctgcccgtgctgagaaacgccgactgcagcagcggccccggccagagagtgtgcgtgatcgacgagatcggcaagatggagctgttcagccagctgttcatccaggccgtgagacagaccctgagcacccccggcaccatcatcctgggcaccatccccgtgcccaagggcaagcccctggccctggtggaggagatcagaaacagaaaggacgtgaaggtgttcaacagcccctactgcgtgatcgaggaccagagcaagttcagcagctgcgtgagccagagcaccctgaccgagcccggctggagacagaagctgctgcagagcctgctgaacagcgagtggaagaagagagcccccgtggtgcccaccagcgtgagcccccccttctacctgagatggatcccctag

SEQ ID NO: 22915 - DNA, 573 bp, Artificial Sequence
  Description of Artificial Sequence: Synthetic coding sequence
atggccagacacgtgttcctgaccggcccccccggcgtgggcaagaccaccctgatccacaaggccagcgaggtgctgaagagcagcggcgtgcccgtggacggcttctacaccgaggaggtgagacagggcggcagaagaatcggcttcgacgtggtgaccctgagcggcaccagaggccccctgagcagagtgggcctggagcccccccccggcaagagagagtgcagagtgggccagtacgtggtggacctgaccagcttcgagcagctggccctgcccgtgctgagaaacgccgactgcagcagcggccccggccagagagtgtgcgtgatcgacgagatcggcaagatggagctgttcagccagctgttcatccaggccgtgagacagaccctgagcacccccggcaccatcatcctgggcaccatccccgtgcccaagggcaagcccctggccctggtggaggagatcagaaacagaaaggacgtgaaggtgttcaacgtgaccaaggagaacagaaaccacctgctgcccgacatcgtgacctgcgtgcagagcagcagaaagtag

SEQ ID NO: 22916 - DNA, 324 bp, Artificial Sequence
  Description of Artificial Sequence: Synthetic coding sequence
atgatggagggcctgggcgagcacagcaccgccggcgagatgggccccctgctgggcgccgtggccgccaccgccagcccccagagcctgatggagtacagcagcgacgccgacttcatcgagagcctgcccctggtggtgaagtacagagtgtacaccctgaagaagctgcaggccaagtgcgccgtgctggaggccaagtacctgagagagttccacagcgtggagagaaagttcgccaccatctacggccccctgctggagaagagaagacagatcaccaacgccctgtacgagcccaccaaggaggagtgcgagagatag

SEQ ID NO: 22917 - DNA, 3042 bp, Artificial Sequence
  Description of Artificial Sequence: Synthetic coding sequence
atgtgcagccaggaggccttccaggcccagagaagccagctggtggagctgctggtgagcggcagcctggagggcttcgagagcgtgctggactggctgctgagctgggaggtgctgagctgggaggactacgagggcttccacctgctgggccagcccctgagccacctggccagaagactgctggacaccgtgtggaacaagggcacctgggcctgccagaagctgatcgccgccgcccaggaggcccaggccgacagccagagccccaagctgcacggctgctgggacccccacagcctgcaccccgccagagacctgcagagccacagacccgccatcgtgagaagactgcacagccacgtggagaacatgctggacctggcctgggagagaggcttcgtgagccagtacgagtgcgacgagatcagactgcccatcttcacccccagccagagagccagaagactgctggacctggccaccgtgaaggccaacggcctggccgccttcctgctgcagcacgtgcaggagctgcccgtgcccctggccctgcccctggaggccgccacctgcaagaagtacatggccaagctgagaaccaccgtgagcgcccagagcagattcctgagcacctacgacggcgccgagaccctgtgcctggaggacatctacaccgagaacgtgctggaggtgtgggccgacgtgggcatggccggccccccccagaagagccccgccaccctgggcctggaggagctgttcagcacccccggccacctgaacgacgacgccgacaccgtgctggtggtgggcgaggccggcagcggcaagagcaccctgctgcagagactgcacctgctgtgggccgccggccaggacttccaggagttcctgttcgtgttccccttcagctgcagacagctgcagtgcatggccaagcccctgagcgtgagaaccctgctgttcgagcactgctgctggcccgacgtgggccaggaggacatcttccagctgctgctggaccaccccgacagagtgctgctgaccttcgacggcttcgacgagttcaagttcagattcaccgacagagagagacactgcagccccaccgaccccaccagcgtgcagaccctgctgttcaacctgctgcagggcaacctgctgaagaacgccagaaaggtggtgaccagcagacccgccgccgtgagcgccttcctgagaaagtacatcagaaccgagttcaacctgaagggcttcagcgagcagggcatcgagctgtacctgagaaagagacaccacgagcccggcgtggccgacagactgatcagactgctgcaggagaccagcgccctgcacggcctgtgccacctgcccgtgttcagctggatggtgagcaagtgccaccaggagctgctgctgcaggagggcggcagccccaagaccaccaccgacatgtacctgctgatcctgcagcacttcctgctgcacgccaccccccccgacagcgccagccagggcctgggccccagcctgctgagaggcagactgcccaccctgctgcacctgggcagactggccctgtggggcctgggcatgtgctgctacgtgttcagcgcccagcagctgcaggccgcccaggtgagccccgacgacatcagcctgggcttcctggtgagagccaagggcgtggtgcccggcagcaccgcccccctggagttcctgcacatcaccttccagtgcttcttcgccgccttctacctggccctgagcgccgacgtgccccccgccctgctgagacacctgttcaactgcggcagacccggcaacagccccatggccagactgctgcccaccatgtgcatccaggccagcgagggcaaggacagcagcgtggccgccctgctgcagaaggccgagccccacaacctgcagatcaccgccgccttcctggccggcctgctgagcagagagcactggggcctgctggccgagtgccagaccagcgagaaggccctgctgagaagacaggcctgcgccagatggtgcctggccagaagcctgagaaagcacttccacagcatcccccccgccgcccccggcgaggccaagagcgtgcacgccatgcccggcttcatctggctgatcagaagcctgtacgagatgcaggaggagagactggccagaaaggccgccagaggcctgaacgtgggccacctgaagctgaccttctgcagcgtgggccccaccgagtgcgccgccctggccttcgtgctgcagcacctgagaagacccgtggccctgcagctggactacaacagcgtgggcgacatcggcgtggagcagctgctgccctgcctgggcgtgtgcaaggccctgtacctgagagacaacaacatcagcgacagaggcatctgcaagctgatcgagtgcgccctgcactgcgagcagctgcagaagctggccctgttcaacaacaagctgaccgacggctgcgcccacagcatggccaagctgctggcctgcagacagaacttcctggccctgagactgggcaacaactacatcaccgccgccggcgcccaggtgctggccgagggcctgagaggcaacaccagcctgcagttcctgggcttctggggcaacagagtgggcgacgagggcgcccaggccctggccgaggccctgggcgaccaccagagcctgagatggctgagcctggtgggcaacaacatcggcagcgtgggcgcccaggccctggccctgatgctggccaagaacgtgatgctggaggagctgtgcctggaggagaaccacctgcaggacgagggcgtgtgcagcctggccgagggcctgaagaagaacagcagcctgaagatcctgaagctgagcaacaactgcatcacctacctgggcgccgaggccctgctgcaggccctggagagaaacgacaccatcctggaggtgtggctgagaggcaacaccttcagcctggaggaggtggacaagctgggctgcagagacaccagactgctgctgtag

SEQ ID NO: 22918 - DNA, 441 bp, Artificial Sequence
  Description of Artificial Sequence: Synthetic coding sequence
atgtgcagccaggaggccttccaggcccagagaagccagctggtggagctgctggtgagcggcagcctggagggcttcgagagcgtgctggactggctgctgagctgggaggtgctgagctgggaggactacgagggcttccacctgctgggccagcccctgagccacctggccagaagactgctggacaccgtgtggaacaagggcacctgggcctgccagaagctgatcgccgccgcccaggaggcccaggccgacagccagagccccaagctgcacggctgctgggacccccacagcctgcaccccgccagagacctgcagagccacagacccgccatcgtgagaagactgcacagccacgtggagaacatgctggacctggcctgggagagaggcttcgtgagccagtacgagtgcgacgagatcagactgccctag

SEQ ID NO: 22919 - DNA, 1752 bp, Artificial Sequence
  Description of Artificial Sequence: Synthetic coding sequence
atggaggtggccgccaactgcagcctgagagtgaagagacccctgctggaccccagattcgagggctacaagctgagcctggagcccctgccctgctaccagctggagctggacgccgccgtggccgaggtgaagctgagagacgaccagtacaccctggagcacatgcacgccttcggcatgtacaactacctgcactgcgacagctggtaccaggacagcgtgtactacatcgacaccctgggcagaatcatgaacctgaccgtgatgctggacaccgccctgggcaagcccagagaggtgttcagactgcccaccgacctgaccgcctgcgacaacagactgtgcgccagcatccacttcagcagcagcacctgggtgaccctgagcgacggcaccggcagactgtacgtgatcggcaccggcgagagaggcaacagcgccagcgagaagtgggagatcatgttcaacgaggagctgggcgaccccttcatcatcatccacagcatcagcctgctgaacgccgaggagcacagcatcgccaccctgctgctgagaatcgagaaggaggagctggacatgaagggcagcggcttctacgtgagcctggagtgggtgaccatcagcaagaagaaccaggacaacaagaagtacgagatcatcaagagagacatcctgagaggcaagagcgtgccccactacgccgccatcgagcccgacggcaacggcctgatgatcgtgagctacaagagcctgaccttcgtgcaggccggccaggacctggaggagaacatggacgaggacatcagcgagaagatcaaggagcccctgtactactggcagcagaccgaggacgacctgaccgtgaccatcagactgcccgaggacagcaccaaggaggacatccagatccagttcctgcccgaccacatcaacatcgtgctgaaggaccaccagttcctggagggcaagctgtacagcagcatcgaccacgagagcagcacctggatcatcaaggagagcaacagcctggagatcagcctgatcaagaagaacgagggcctgacctggcccgagctggtgatcggcgacaagcagggcgagctgatcagagacagcgcccagtgcgccgccatcgccgagagactgatgcacctgaccagcgaggagctgaaccccaaccccgacaaggagaagcccccctgcaacgcccaggagctggaggagtgcgacatcttcttcgaggagagcagcagcctgtgcagattcgacggcaacaccctgaagaccacccacgtggtgaacctgggcagcaaccagtacctgttcagcgtgatcgtggaccccaaggagatgccctgcttctgcctgagacacgacgtggacgccctgctgtggcagccccacagcagcaagcaggacgacatgtgggagcacatcgccaccttcaacgccctgggctacgtgcaggccagcaagagagacaagaagttcttcgcctgcgcccccaactacagctacgccgccctgtgcgagtgcctgagaagagtgttcatctacagacagcccgcccccatgagcaccgtgctgtacaacagaaaggagggcagacaggtgggccaggtggccaagcagcaggtggccagcctggagaccaacgaccccatcctgggcttccaggccaccaacgagagactgttcgtgctgaccaccaagaacctgttcctgatcaaggtgaacaccgagaactag

SEQ ID NO: 22920 - DNA, 1665 bp, Artificial Sequence
  Description of Artificial Sequence: Synthetic coding sequence
atgctgtacctgcagggctggagcatgcccgccgtggccgaggtgaagctgagagacgaccagtacaccctggagcacatgcacgccttcggcatgtacaactacctgcactgcgacagctggtaccaggacagcgtgtactacatcgacaccctgggcagaatcatgaacctgaccgtgatgctggacaccgccctgggcaagcccagagaggtgttcagactgcccaccgacctgaccgcctgcgacaacagactgtgcgccagcatccacttcagcagcagcacctgggtgaccctgagcgacggcaccggcagactgtacgtgatcggcaccggcgagagaggcaacagcgccagcgagaagtgggagatcatgttcaacgaggagctgggcgaccccttcatcatcatccacagcatcagcctgctgaacgccgaggagcacagcatcgccaccctgctgctgagaatcgagaaggaggagctggacatgaagggcagcggcttctacgtgagcctggagtgggtgaccatcagcaagaagaaccaggacaacaagaagtacgagatcatcaagagagacatcctgagaggcaagagcgtgccccactacgccgccatcgagcccgacggcaacggcctgatgatcgtgagctacaagagcctgaccttcgtgcaggccggccaggacctggaggagaacatggacgaggacatcagcgagaagatcaaggagcccctgtactactggcagcagaccgaggacgacctgaccgtgaccatcagactgcccgaggacagcaccaaggaggacatccagatccagttcctgcccgaccacatcaacatcgtgctgaaggaccaccagttcctggagggcaagctgtacagcagcatcgaccacgagagcagcacctggatcatcaaggagagcaacagcctggagatcagcctgatcaagaagaacgagggcctgacctggcccgagctggtgatcggcgacaagcagggcgagctgatcagagacagcgcccagtgcgccgccatcgccgagagactgatgcacctgaccagcgaggagctgaaccccaaccccgacaaggagaagcccccctgcaacgcccaggagctggaggagtgcgacatcttcttcgaggagagcagcagcctgtgcagattcgacggcaacaccctgaagaccacccacgtggtgaacctgggcagcaaccagtacctgttcagcgtgatcgtggaccccaaggagatgccctgcttctgcctgagacacgacgtggacgccctgctgtggcagccccacagcagcaagcaggacgacatgtgggagcacatcgccaccttcaacgccctgggctacgtgcaggccagcaagagagacaagaagttcttcgcctgcgcccccaactacagctacgccgccctgtgcgagtgcctgagaagagtgttcatctacagacagcccgcccccatgagcaccgtgctgtacaacagaaaggagggcagacaggtgggccaggtggccaagcagcaggtggccagcctggagaccaacgaccccatcctgggcttccaggccaccaacgagagactgttcgtgctgaccaccaagaacctgttcctgatcaaggtgaacaccgagaactag

SEQ ID NO: 22921 - DNA, 474 bp, Artificial Sequence
  Description of Artificial Sequence: Synthetic coding sequence
atgagcgcccccttcgaggagagaagcggcgtggtgccctgcggcaccccctggggccagtggtaccagaccctggaggaggtgttcatcgaggtgcaggtgccccccggcaccagagcccaggacatccagtgcggcctgcagagcagacacgtggccctgagcgtgggcggcagagagatcctgaagggcaagctgttcgacagcaccatcgccgacgagggcacctggaccctggaggacagaaagatggtgagaatcgtgctgaccaagaccaagagagacgccgccaactgctggaccagcctgctggagagcgagtacgccgccgacccctgggtgcaggaccagatgcagagaaagctgaccctggagagattccagaaggagaaccccggcttcgacttcagcggcgccgagatcagcggcaactacaccaagggcggccccgacttcagcaacctggagaagtag

SEQ ID NO: 22922 - DNA, 1086 bp, Artificial Sequence
  Description of Artificial Sequence: Synthetic coding sequence
atggagaccggcgccgccgagctgtacgaccaggccctgctgggcatcctgcagcacgtgggcaacgtgcaggacttcctgagagtgctgttcggcttcctgtacagaaagaccgacttctacagactgctgagacaccccagcgacagaatgggcttcccccccggcgccgcccaggccctggtgctgcaggtgttcaagaccttcgaccacatggccagacaggacgacgagaagagaagacaggagctggaggagaagatcagaagaaaggaggaggaggaggccaagaccgtgagcgccgccgccgccgagaaggagcccgtgcccgtgcccgtgcaggagatcgagatcgacagcaccaccgagctggacggccaccaggaggtggagaaggtgcagccccccggccccgtgaaggagatggcccacggcagccaggaggccgaggcccccggcgccgtggccggcgccgccgaggtgcccagagagccccccatcctgcccagaatccaggagcagttccagaagaaccccgacagctacaacggcgccgtgagagagaactacacctggagccaggactacaccgacctggaggtgagagtgcccgtgcccaagcacgtggtgaagggcaagcaggtgagcgtggccctgagcagcagcagcatcagagtggccatgctggaggagaacggcgagagagtgctgatggagggcaagctgacccacaagatcaacaccgagagcagcctgtggagcctggagcccggcaagtgcgtgctggtgaacctgagcaaggtgggcgagtactggtggaacgccatcctggagggcgaggagcccatcgacatcgacaagatcaacaaggagagaagcatggccaccgtggacgaggaggagcaggccgtgctggacagactgaccttcgactaccaccagaagctgcagggcaagccccagagccacgagctgaaggtgcacgagatgctgaagaagggctgggacgccgagggcagccccttcagaggccagagattcgaccccgccatgttcaacatcagccccggcgccgtgcagttctag

SEQ ID NO: 22923 - DNA, 495 bp, Artificial Sequence
  Description of Artificial Sequence: Synthetic coding sequence
atgaagtgcaagcccaaccagaccagaacctacgaccccgagggcttcaagaagagagccgcctgcctgtgcttcagaagcgagagagaggacgaggtgctgctggtgagcagcagcagataccccgacagatggatcgtgcccggcggcggcatggagcccgaggaggagcccggcggcgccgccgtgagagaggtgtacgaggaggccggcgtgaagggcaagctgggcagactgctgggcgtgttcgagcagaaccaggaccccaagcacagaacctacgtgtacgtgctgaccgtgaccgagctgctggaggactgggaggacagcgtgagcatcggcagaaagagagagtggttcaaggtggaggacgccatcaaggtgctgcagtgccacaagcccgtgcacgccgagtacctggagaagctgaagctgggcggcagccccaccaacggcaacagcatggcccccagcagccccgacagcgacccctag

SEQ ID NO: 22924 - DNA, 495 bp, Artificial Sequence
  Description of Artificial Sequence: Synthetic coding sequence
atgaccgccagcgcccagcccagaggcagaagacccggcgtgggcgtgggcgtggtggtgaccagctgcaagcaccccagatgcgtgctgctgggcaagagaaagggcagcgtgggcgccggcagcttccagctgcccggcggccacctggagttcggcgagacctgggaggagtgcgcccagagagagacctgggaggaggccgccctgcacctgaagaacgtgcacttcgccagcgtggtgaacagcttcatcgagaaggagaactaccactacgtgaccatcctgatgaagggcgaggtggacgtgacccacgacagcgagcccaagaacgtggagcccgagaagaacgagagctgggagtgggtgccctgggaggagctgccccccctggaccagctgttctggggcctgagatgcctgaaggagcagggctacgaccccttcaaggaggacctgaaccacctggtgggctacaagggcaaccacctgtag

SEQ ID NO: 22925 - DNA, 987 bp, Artificial Sequence
  Description of Artificial Sequence: Synthetic coding sequence
atggccgaggtgagagtgcagctgctgctgagcagaagacccgagagcgtgagcttcgccagaagcgtgtgcggcctgctgggcgccggccccggcctgggcacctggcccatccactgcagcctgaagagaggcagactggtgctgagcagcagacccttccccggcgccagcgccagactgcccctgcagagaccccccttctgccccttcgccgccctggaggagagacccagagtgcccggcgccgagctgcccaccgacagaggcgtggacctgggcgtggccgtgatcctgcagagcagcgacaagaccgtgctgctgaccagaagagccagaaccctgagcgtgagccccaacctgtgggtgccccccggcggccacgtggagctggaggaggagctgctggacggcggcctgagagagctgtgggaggagagcggcctgcacctgccccagggccagttcagctgggtgcccctgggcctgtgggagagcgcctacccccccagactgagctggggcctgcccaagtaccaccacatcgtgctgtacctgctggtgatcagccaggagagccagcagcagctgcaggccagaatccagcccaaccccaacgaggtgagcgccctgatgtggctgacccccgacgtggccgccgccgtggccgccgccgaggacggcaccgagacccccggcctgctgccccaggacctgccccccagcgtgctggccgtggagctggaggaggacggcagagccagacccctggtgctgcacatgagcaccctgctgagaatgatccccaccatggccgaggacaaggagagagtgagcaccggcaccaagttcgccctgaagctgtggctgcagcacctgggcagaaccccccccccctgcaagagcgccgcctacctggaccccggccccgccaaggaggagtggaacatggaccccctgccccccaaccagggcagcggcaagtag

SEQ ID NO: 22926 - DNA, 555 bp, Artificial Sequence
  Description of Artificial Sequence: Synthetic coding sequence
tgagccgtgatcctgcagagcagcgacaagaccgtgctgctgaccagaagagccagaaccctgagcgtgagccccaacctgtgggtgccccccggcggcctgagagagctgtgggaggagagcggcctgcacctgccccagggccagttcagctgggtgcccctgggcctgtgggagagcgcctacccccccagactgagctggggcctgcccaagtaccaccacatcgtgctgtacctgctggtgatcagccaggagagccagcagcagctgcaggccagaatccagcccaaccccaacgaggtgagcgccctgatgtggctgacccccgacgtggccgccgccgtggccgccgccgaggacggcaccgagacccccggcctgctgcccagaaccagaggcggctggaagagccccaccagcggccccgcccacgtgcacccccccgccgacgaccccaaccacggcagaggccagagagagagccagcactggaaccaggtgtgcccccaggccctggccgccaccagcggccagaacacccccaccgtgtag

SEQ ID NO: 22927 - DNA, 972 bp, Artificial Sequence
  Description of Artificial Sequence: Synthetic coding sequence
atggccagcgagggcctggccggcgccctggccagcgtgctggccggccagggcagcagcgtgcacagctgcgacagcgcccccgccggcgagccccccgcccccgtgagactgagaaagaacgtgtgctacgtggtgctggccgtgttcctgagcgagcaggacgaggtgctgctgatccaggaggccaagagagagtgcagaggcagctggtacctgcccgccggcagaatggagcccggcgagaccatcgtggaggccctgcagagagaggtgaaggaggaggccggcctgcactgcgagcccgagaccctgctgagcgtggaggagagaggccccagctgggtgagattcgtgttcctggccagacccaccggcggcatcctgaagaccagcaaggaggccgacgccgagagcctgcaggccgcctggtaccccagaaccagcctgcccacccccctgagagcccacgacatcctgcacctggtggagctggccgcccagtacagacagcaggccagacaccccctgatcctgccccaggagctgccctgcgacctggtgtgccagagactggtggccaccttcaccagcgcccagaccgtgtgggtgctggtgggcaccgtgggcatgccccacctgcccgtgaccgcctgcggcctggaccccatggagcagagaggcggcatgaagatggccgtgctgagactgctgcaggagtgcctgaccctgcaccacctggtggtggagatcaagggcctgctgggcctgcagcacctgggcagagaccacagcgacggcatctgcctgaacgtgctggtgaccgtggccttcagaagccccggcatccaggacgagccccccaaggtgagaggcgagaacttcagctggtggaaggtgatggaggaggacctgcagagccagctgctgcagagactgcagggcagcagcgtggtgcccgtgaacagatag

SEQ ID NO: 22928 - DNA, 180 bp, Artificial Sequence
  Description of Artificial Sequence: Synthetic coding sequence
atggccagcgagggcctggccggcgccctggccagcgtgctggccggccagggcagcagcgtgcacagctgcgacagcgcccccgccggcgagccccccgcccccagagccggctgcggcagaacctgcgccacctggtgctggccctgcagcagcgccagcagaatgagatgctactag

SEQ ID NO: 22929 - DNA, 741 bp, Artificial Sequence
  Description of Artificial Sequence: Synthetic coding sequence
atggagcccggcgagaccatcgtggaggccctgcagagagaggtgaaggaggaggccggcctgcactgcgagcccgagaccctgctgagcgtggaggagagaggccccagctgggtgagattcgtgttcctggccagacccaccggcggcatcctgaagaccagcaaggaggccgacgccgagagcctgcaggccgcctggtaccccagaaccagcctgcccacccccctgagagcccacgacatcctgcacctggtggagctggccgcccagtacagacagcaggccagacaccccctgatcctgccccaggagctgccctgcgacctggtgtgccagagactggtggccaccttcaccagcgcccagaccgtgtgggtgctggtgggcaccgtgggcatgccccacctgcccgtgaccgcctgcggcctggaccccatggagcagagaggcggcatgaagatggccgtgctgagactgctgcaggagtgcctgaccctgcaccacctggtggtggagatcaagggcctgctgggcctgcagcacctgggcagagaccacagcgacggcatctgcctgaacgtgctggtgaccgtggccttcagaagccccggcatccaggacgagccccccaaggtgagaggcgagaacttcagctggtggaaggtgatggaggaggacctgcagagccagctgctgcagagactgcagggcagcagcgtggtgcccgtgaacagatag

SEQ ID NO: 22930 - DNA, 1128 bp, Artificial Sequence
  Description of Artificial Sequence: Synthetic coding sequence
atgagcagcagcctgagacccggccccagcagatggagaagagccgccagcatcgtgctggccgccggctggagcagacccgagaccgccaccccccccagcagacccccccccgccgagggcttcagactgctgctgctgcagagaagcccccaccagggcttcatgcccggcgcccacgtgttcagcggcggcgtgctggacgccgccgacagaagcgccgactggctgggcctgttcgccccccaccacggcccccccagattcggcctgggccccgcccccttcagcagaaccgccttccccagcctgcccgacaccgacgaccacaagaccgacaacaccggcaccctgcccgaggacgtggccttcagaatctgcgccgtgagagaggccttcgaggaggccggcgtgctgctgctgagacccagaaccagcccccccggccccgcccccggccccggcctggccctggagcccccccccggcctggccagctggagagacagagtgagacaggaccccagacacttcctgagactgtgcgcccacctggactgcacccccgacatctgggccctgcacaactggagcgcctggctgacccccttcctgagaggcaccaccagaagattcgacaccgccttcttcctgtgctgcctgagagagcccccccccgtgtaccccgacctggccgaggtggtgggctaccagtggagcagccccagcgaggccaccgagagcttcctgagcaaggagatctggctgccccccccccagttctacgaggtgagaagactggccaacttcgccagcctgagcgacctgcacaagttctgcctgggcagagccctggagggcctggagagatggctgcccatcatcctgctgaccgccgacggcatggtgcacctgctgcccggcgacgagctgtacctggaggacagcgacttcctggagaacctgatgagcaccgagaagaagaccgaggagatcatgaaggagggcaagcagttccacagaatcgtgacctaccacagacacctgtacgacatccacgtgaccgtgcagcccaagtacaagcacgtgtaccccaagaacagcgtggtgagaaagagccacctgtag

SEQ ID NO: 22931 - DNA, 912 bp, Artificial Sequence
  Description of Artificial Sequence: Synthetic coding sequence
atggaccccgaggtgaccctgctgctgcagtgccccggcggcggcctgccccaggagcagatccaggccgagctgagccccgcccacgacagaagacccctgcccggcggcgacgaggccatcaccgccatctgggagaccagactgaaggcccagccctggctgttcgacgcccccaagttcagactgcacagcgccaccctggcccccatcggcagcagaggcccccagctgctgctgagactgggcctgaccagctacagagacttcctgggcaccaactggagcagcagcgccgcctggctgagacagcagggcgccaccgactggggcgacacccaggcctacctggccgaccccctgggcgtgggcgccgccctggccaccgccgacgacttcctggtgttcctgagaagaagcagacaggtggccgaggcccccggcctggtggacgtgcccggcggccaccccgagccccaggccctgtgccccggcggcagcccccagcaccaggacctggccggccagctggtggtgcacgagctgttcagcagcgtgctgcaggagatctgcgacgaggtgaacctgcccctgctgaccctgagccagcccctgctgctgggcatcgccagaaacgagaccagcgccggcagagccagcgccgagttctacgtgcagtgcagcctgaccagcgagcaggtgagaaagcactacctgagcggcggccccgaggcccacgagagcaccggcatcttcttcgtggagacccagaacgtgcagagactgctggagaccgagatgtgggccgagctgtgccccagcgccaagggcgccatcatcctgtacaacagagtgcagggcagccccaccggcgccgccctgggcagccccgccctgctgccccccctgtag

SEQ ID NO: 22932 - DNA, 813 bp, Artificial Sequence
  Description of Artificial Sequence: Synthetic coding sequence
atggaccccgaggtgaccctgctgctgcagtgccccggcggcggcctgccccaggagcagatccaggccgagctgagccccgcccacgacagaagacccctgcccggcggcgacgaggccatcaccgccatctgggagaccagactgaaggcccagccctggctgttcgacgcccccaagttcagactgcacagcgccaccctggcccccatcggcagcagaggcccccagctgctgctgagactgggcctgaccagctacagagacttcctgggcaccaactggagcagcagcgccgcctggctgagacagcagggcgccaccgactggggcgacacccaggcctacctggccgaccccctgggcgtgggcgccgccctggccaccgccgacgacttcctggtgttcctgagaagaagcagacaggtggccgaggcccccggcctggtggacgtgcccggcggccaccccgagccccaggtgaacctgcccctgctgaccctgagccagcccctgctgctgggcatcgccagaaacgagaccagcgccggcagagccagcgccgagttctacgtgcagtgcagcctgaccagcgagcaggtgagaaagcactacctgagcggcggccccgaggcccacgagagcaccggcatcttcttcgtggagacccagaacgtgcagagactgctggagaccgagatgtgggccgagctgtgccccagcgccaagggcgccatcatcctgtacaacagagtgcagggcagccccaccggcgccgccctgggcagccccgccctgctgccccccctgtag

SEQ ID NO: 22933 - DNA, 639 bp, Artificial Sequence
  Description of Artificial Sequence: Synthetic coding sequence
atggaccccgaggtgaccctgctgctgcagtgccccggcggcggcctgccccaggagcagatccaggccgagctgagccccgcccacgacagaagacccctgcccggcggcgacgaggccatcaccgccatctgggagaccagactgaaggcccagccctggctgttcgacgcccccaagttcagactgcacagcgccaccctggcccccatcggcagcagaggcccccagctgctgctgagactgggcctgaccagctacagagacttcctgggcaccaactggagcagcagcgccgcctggctgagacagcagggcgccaccgactggggcgacacccaggcctacctggccgaccccctgggcgtgggcgccgccctggccaccgccgacgacttcctggtgttcctgagaagaagcagacaggtggccgaggcccccggcctggtggacgtgcccggcggccaccccgagccccaggtgagattccaggccggccacaaggaccccgacagcagcagagagctgcagctgagcaccctgcccatcctgcccgccctggtgagcagcctgaagggcaagctggcctggtacttcagcggcagcctgctgagagccgtgcacctgcccccccactag

SEQ ID NO: 22934 - DNA, 375 bp, Artificial Sequence
  Description of Artificial Sequence: Synthetic coding sequence
atggaccccgaggtgaccctgctgctgcagtgccccggcggcggcctgccccaggagcagatccaggccgagctgagccccgcccacgacagaagacccctgcccggcggcgacgaggccatcaccgccatctgggagaccagactgaaggcccagccctggctgttcgacgcccccaagttcagactgcacagcgccaccctggcccccatcggcagcagaggcccccagctgctgctgagactgggcctgaccagctacagagacttcctgggcaccaactggagcagcagcgccgcctggctgagacagcagggcgccaccgactggggcgacacccaggcctacctggccgaccccctgggcgtgggctag

SEQ ID NO: 22935 - DNA, 546 bp, Artificial Sequence
  Description of Artificial Sequence: Synthetic coding sequence
atgatgaagttcaagcccaaccagaccagaacctacgacagagagggcttcaagaagagagccgcctgcctgtgcttcagaagcgagcaggaggacgaggtgctgctggtgagcagcagcagataccccgaccagtggatcgtgcccggcggcggcatggagcccgaggaggagcccggcggcgccgccgtgagagaggtgtacgaggaggccggcgtgaagggcaagctgggcagactgctgggcatcttcgagcagaaccaggacagaaagcacagaacctacgtgtacgtgctgaccgtgaccgagatcctggaggactgggaggacagcgtgaacatcggcagaaagagagagtggttcaaggtggaggacgccatcaaggtgctgcagtgccacaagcccgtgcacgccgagtacctggagaagctgaagctgggctgcagccccgccaacggcaacagcaccgtgcccagcctgcccgacaacaacgccctgttcgtgaccgccgcccagaccagcggcctgcccagcagcgtgagatag

SEQ ID NO: 22936 - DNA, 543 bp, Artificial Sequence
  Description of Artificial Sequence: Synthetic coding sequence
atgatgaagttcaagcccaaccagaccagaacctacgacagagagggcttcaagaagagagccgcctgcctgtgcttcagaagcgagcaggaggacgaggtgctgctggtgagcagcagcagataccccgaccagtggatcgtgcccggcggcggcatggagcccgaggaggagcccggcggcgccgccgtgagagaggtgtacgaggaggccggcgtgaagggcaagctgggcagactgctgggcatcttcgagaaccaggacagaaagcacagaacctacgtgtacgtgctgaccgtgaccgagatcctggaggactgggaggacagcgtgaacatcggcagaaagagagagtggttcaaggtggaggacgccatcaaggtgctgcagtgccacaagcccgtgcacgccgagtacctggagaagctgaagctgggctgcagccccgccaacggcaacagcaccgtgcccagcctgcccgacaacaacgccctgttcgtgaccgccgcccagaccagcggcctgcccagcagcgtgagatag

SEQ ID NO: 22937 - DNA, 390 bp, Artificial Sequence
  Description of Artificial Sequence: Synthetic coding sequence
atggagcccgaggaggagcccggcggcgccgccgtgagagaggtgtacgaggaggccggcgtgaagggcaagctgggcagactgctgggcatcttcgagcagaaccaggacagaaagcacagaacctacgtgtacgtgctgaccgtgaccgagatcctggaggactgggaggacagcgtgaacatcggcagaaagagagagtggttcaaggtggaggacgccatcaaggtgctgcagtgccacaagcccgtgcacgccgagtacctggagaagctgaagctgggctgcagccccgccaacggcaacagcaccgtgcccagcctgcccgacaacaacgccctgttcgtgaccgccgcccagaccagcggcctgcccagcagcgtgagatag

SEQ ID NO: 22938 - DNA, 543 bp, Artificial Sequence
  Description of Artificial Sequence: Synthetic coding sequence
atggagagccaggagcccaccgagagcagccagaacggcaagcagtacatcatcagcgaggagctgatcagcgagggcaagtgggtgaagctggagaagaccacctacatggaccccaccggcaagaccagaacctgggagagcgtgaagagaaccaccagaaaggagcagaccgccgacggcgtggccgtgatccccgtgctgcagagaaccctgcactacgagtgcatcgtgctggtgaagcagttcagaccccccatgggcggctactgcatcgagttccccgccggcctgatcgacgacggcgagacccccgaggccgccgccctgagagagctggaggaggagaccggctacaagggcgacatcgccgagtgcagccccgccgtgtgcatggaccccggcctgagcaactgcaccatccacatcgtgaccgtgaccatcaacggcgacgacgccgagaacgccagacccaagcccaagcccggcgacggcggcatgttctgcaacagctggtggcccagcgtgtacgacctggtgtag

SEQ ID NO: 22939 - DNA, 699 bp, Artificial Sequence
  Description of Artificial Sequence: Synthetic coding sequence
atggagagccaggagcccaccgagagcagccagaacggcaagcagtacatcatcagcgaggagctgatcagcgagggcaagtgggtgaagctggagaagaccacctacatggaccccaccggcaagaccagaagaaacaaggagaagaccaccaccctgctgatcctgagaacctgggagagcgtgaagagaaccaccagaaaggagcagaccgccgacggcgtggccgtgatccccgtgctgcagagaaccctgcactacgagtgcatcgtgctggtgaagcagttcagaccccccatgggcggctactgcatcgagttccccgccggcctgatcgacgacggcgagacccccgaggccgccgccctgagagagctggaggaggagaccggctacaagggcgacatcgccgagtgcagccccgccgtgtgcatggaccccggcctgagcaactgcaccatccacatcgtgaccgtgaccatcaacggcgacgacgccgagaacgccagacccaagcccaagcccggcgacggcgagttcgtggaggtgatcagcctgcccaagaacgacctgctgcagagactggacgccctggtggccgaggagcacctgaccgtggacgccagagtgtacagctacgccctggccctgaagcacgccaacgccaagcccttcgaggtgcccttcctgaagttctag

SEQ ID NO: 22940 - DNA, 561 bp, Artificial Sequence
  Description of Artificial Sequence: Synthetic coding sequence
atggagagccaggagcccaccgagagcagccagaacggcaagcagtacatcatcagcgaggagctgatcagcgagggcaagtgggtgaagctggagaagaccacctacatggaccccaccggcaagaccagaacctgggagagcgtgaagagaaccaccagaaaggagcagaccgccgacggcgtggccgtgatccccgtgctgcagagaaccctgcactacgagtgcatcgtgctggtgaagcagttcagaccccccatgggcggctactgcatcgagttccccgccggcctgatcgacgacggcgagacccccgaggccgccgccctgagagagctggaggaggagaccggctacaagggcgacatcgccgagtgcagccccgccgtgtgcatggaccccggcctgagcaactgcaccatccacatcgtgaccgtgaccatcaacggcgacgacgccgagaacgccagacccaagcccaagcccggcgacggcgagttcgtggaggtgatcagcctgcccaagaacgacctgctgcagagactggacgagaccctgtag

SEQ ID NO: 22941 - DNA, 297 bp, Artificial Sequence
  Description of Artificial Sequence: Synthetic coding sequence
atggagagccaggagcccaccgagagcagccagaacggcaagcagtacatcatcagcgaggagctgatcagcgagggcaagtgggtgaagctggagaagaccacctacatggaccccaccggcaagaccagaacctgggagagcgtgaagagaaccaccagaaaggagcagaccgccgacggcagaagcgccaacctgttccagcccttcagaaaggaggtgagcacctgcgacagagtggccgtgatccccgtgctgcagagaaccctgcactacgagtgcatcgtgctggtgtag

SEQ ID NO: 22942 - DNA, 660 bp, Artificial Sequence
  Description of Artificial Sequence: Synthetic coding sequence
atggagagccaggagcccaccgagagcagccagaacggcaagcagtacatcatcagcgaggagctgatcagcgagggcaagtgggtgaagctggagaagaccacctacatggaccccaccggcaagaccagaacctgggagagcgtgaagagaaccaccagaaaggagcagaccgccgacggcgtggccgtgatccccgtgctgcagagaaccctgcactacgagtgcatcgtgctggtgaagcagttcagaccccccatgggcggctactgcatcgagttccccgccggcctgatcgacgacggcgagacccccgaggccgccgccctgagagagctggaggaggagaccggctacaagggcgacatcgccgagtgcagccccgccgtgtgcatggaccccggcctgagcaactgcaccatccacatcgtgaccgtgaccatcaacggcgacgacgccgagaacgccagacccaagcccaagcccggcgacggcgagttcgtggaggtgatcagcctgcccaagaacgacctgctgcagagactggacgccctggtggccgaggagcacctgaccgtggacgccagagtgtacagctacgccctggccctgaagcacgccaacgccaagcccttcgaggtgcccttcctgaagttctag

SEQ ID NO: 22943 - DNA, 660 bp, Artificial Sequence; identical to SEQ ID NO: 22942
  Description of Artificial Sequence: Synthetic coding sequence

SEQ ID NO: 22944 - DNA, 717 bp, Artificial Sequence
  Description of Artificial Sequence: Synthetic coding sequence
atgagcagactgggcctgcccgaggagcccgtgagaaacagcctgctggacgacgccaaggccagactgagaaagtacgacatcggcggcaagtacagccacctgccctacaacaagtacagcgtgctgctgcccctggtggccaaggagggcaagctgcacctgctgttcaccgtgagaagcgagaagctgagaagagcccccggcgaggtgtgcttccccggcggcaagagagaccccaccgacatggacgacgccgccaccgccctgagagaggcccaggaggaggtgggcctgagaccccaccaggtggaggtggtgtgctgcctggtgccctgcctgatcgacaccgacaccctgatcacccccttcgtgggcctgatcgaccacaacttccaggcccagcccaaccccgccgaggtgaaggacgtgttcctggtgcccctggcctacttcctgcacccccaggtgcacgaccagcactacgtgaccagactgggccacagattcatcaaccacatcttcgagtacaccaaccccgaggacggcgtgacctaccagatcaagggcatgaccgccaacctggccgtgctggtggccttcatcatcctggagaagaagcccaccttcgaggtgcagttcaacctgaacgacgtgctggccagcagcgaggagctgttcctgaaggtgcacaagaaggccaccagcagactgtag

SEQ ID NO: 22945 - DNA, 558 bp, Artificial Sequence
  Description of Artificial Sequence: Synthetic coding sequence
atgagcagactgggcctgcccgaggagcccgtgagaaacagcctgctggacgacgccaaggccagactgagaaagtacgacatcggcggcaagtacagccacctgccctacaacaagtacagcgtgctgctgcccctggtggccaaggagggcaagctgcacctgctgttcaccgtgagaagcgagaagaccgacaccctgatcacccccttcgtgggcctgatcgaccacaacttccaggcccagcccaaccccgccgaggtgaaggacgtgttcctggtgcccctggcctacttcctgcacccccaggtgcacgaccagcactacgtgaccagactgggccacagattcatcaaccacatcttcgagtacaccaaccccgaggacggcgtgacctaccagatcaagggcatgaccgccaacctggccgtgctggtggccttcatcatcctggagaagaagcccaccttcgaggtgcagttcaacctgaacgacgtgctggccagcagcgaggagctgttcctgaaggtgcacaagaaggccaccagcagactgtag

SEQ ID NO: 22946 - DNA, 513 bp, Artificial Sequence
  Description of Artificial Sequence: Synthetic coding sequence
atgagcagactgggcctgcccgaggagcccgtgagaaacagcctgctggacgacgccaaggccagactgagaaagtacgacatcggcggcaagtacagccacctgccctacaacaagtacagcgtgctgctgcccctggtggccaaggagggcaagctgcacctgctgttcaccgtgagaagcgagaagctgagaagagcccccggcgaggtgtgcttccccggcggcaagagagaccccaccgacatggacgacgccgccaccgccctgagagaggcccaggaggaggtgggcctgagaccccaccaggtggaggtggtgtgctgcctggtgccctgcctgatcgacagatggggcagcagatacgtggacgaggccggcctggagctgctggccagcagcgacccccccaccagcgccagccagagcgccggcatcaccgacagatacatcgacaacagcatctgcggcttcaacagaccccagctgcccggccccgccgagagctgctag

SEQ ID NO: 22947 - DNA, 822 bp, Artificial Sequence
  Description of Artificial Sequence: Synthetic coding sequence
atgagactgcccggcgtgcccctggccagacccgccctgctgctgctgctgcccctgctggcccccctgctgggcaccggcgcccccgccgagctgagagtgagagtgagactgcccgacggccaggtgaccgaggagagcctgcaggccgacagcgacgccgacagcatcagcctggagctgagaaagcccgacggcaccctggtgagcttcaccgccgacttcaagaaggacgtgaaggtgttcagagccctgatcctgggcgagctggagaagggccagagccagttccaggccctgtgcttcgtgacccagctgcagcacaacgagatcatccccagcgaggccatggccaagctgagacagaagaaccccagagccgtgagacaggccgaggaggtgagaggcctggagcacctgcacatggacgtggccgtgaacttcagccagggcgccctgctgagcccccacctgcacaacgtgtgcgccgaggccgtggacgccatctacaccagacaggaggacgtgagattctggctggagcagggcgtggacagcagcgtgttcgaggccctgcccaaggccagcgagcaggccgagctgcccagatgcagacaggtgggcgaccacggcaagccctgcgtgtgcagatacggcctgagcctggcctggtacccctgcatgctgaagtactgccacagcagagacagacccaccccctacaagtgcggcatcagaagctgccagaagagctacagcttcgacttctacgtgccccagagacagctgtgcctgtgggacgaggacccctaccccggctag

SEQ ID NO: 22948 - DNA, 2205 bp, Artificial Sequence
  Description of Artificial Sequence: Synthetic coding sequence
atgagacccgccgtgctgggcagccccgacagagccccccccgaggacgagggccccgtgatggtgaagctggaggacagcgaggaggagggcgaggccgccctgtgggaccccggccccgaggccgccagactgagattcagatgcttcagatacgaggaggccaccggcccccaggaggccctggcccagctgagagagctgtgcagacagtggctgagacccgaggtgagaagcaaggagcagatgctggagctgctggtgctggagcagttcctgggcgccctgccccccgagatccaggccagagtgcagggccagagacccggcagccccgaggaggccgccgccctggtggacggcctgagaagagagcccggcggccccagaagatgggtgaccgtgcaggtgcagggccaggaggtgctgagcgagaagatggagcccagcagcttccagcccctgcccgagaccgagccccccacccccgagcccggccccaagaccccccccagaaccatgcaggagagccccctgggcctgcaggtgaaggaggagagcgaggtgaccgaggacagcgacttcctggagagcggccccctggccgccacccaggagagcgtgcccaccctgctgcccgaggaggcccagagatgcggcaccgtgctggaccagatcttcccccacagcaagaccggccccgagggccccagctggagagagcaccccagagccctgtggcacgaggaggccggcggcatcttcagccccggcttcgccctgcagctgggcagcatcagcgccggccccggcagcgtgagcccccacctgcacgtgccctgggacctgggcatggccggcctgagcggccagatccagagccccagcagagagggcggcttcgcccacgccctgctgctgcccagcgacctgagaagcgagcaggaccccaccgacgaggacccctgcagaggcgtgggccccgccctgatcaccaccagatggagaagccccagaggcagaagcagaggcagacccagcaccggcggcggcgtggtgagaggcggcagatgcgacgtgtgcggcaaggtgttcagccagagaagcaacctgctgagacaccagaagatccacaccggcgagagacccttcgtgtgcagcgagtgcggcagaagcttcagcagaagcagccacctgctgagacaccagctgacccacaccgaggagagacccttcgtgtgcggcgactgcggccagggcttcgtgagaagcgccagactggaggagcacagaagagtgcacaccggcgagcagcccttcagatgcgccgagtgcggccagagcttcagacagagaagcaacctgctgcagcaccagagaatccacggcgacccccccggccccggcgccaagccccccgccccccccggcgcccccgagccccccggccccttcccctgcagcgagtgcagagagagcttcgccagaagagccgtgctgctggagcaccaggccgtgcacaccggcgacaagagcttcggctgcgtggagtgcggcgagagattcggcagaagaagcgtgctgctgcagcacagaagagtgcacagcggcgagagacccttcgcctgcgccgagtgcggccagagcttcagacagagaagcaacctgacccagcacagaagaatccacaccggcgagagacccttcgcctgcgccgagtgcggcaaggccttcagacagagacccaccctgacccagcacctgagagtgcacaccggcgagaagcccttcgcctgccccgagtgcggccagagattcagccagagactgaagctgaccagacaccagagaacccacaccggcgagaagccctaccactgcggcgagtgcggcctgggcttcacccaggtgagcagactgaccgagcaccagagaatccacaccggcgagagacccttcgcctgccccgagtgcggccagagcttcagacagcacgccaacctgacccagcacagaagaatccacaccggcgagagaccctacgcctgccccgagtgcggcaaggccttcagacagagacccaccctgacccagcacctgagaacccacagaagagagaagcccttcgcctgccaggactgcggcagaagattccaccagagcaccaagctgatccagcaccagagagtgcacagcgccgagtag

SEQ ID NO: 22949 - DNA, 135 bp, Artificial Sequence
  Description of Artificial Sequence: Synthetic coding sequence
atgggcatgtacccccccctgctgctgaagatctacctgagcagacacatcagcatcctgttctacctgaagatcctgtacaagagcggcatcatctggctgagctggtacagcttcatcctgctggtgctgtag

SEQ ID NO: 22950 - DNA, 957 bp, Artificial Sequence
  Description of Artificial Sequence: Synthetic coding sequence
atggagagaggcgaccagcccaagagaaccagaaacgagaacatcttcaactgcctgtacaagaaccccgaggccaccttcaagctgatctgcttcccctggatgggcggcggcagcacccacttcgccaagtggggccaggacacccacgacctgctggaggagaccgccagccaccacgtggccaaggccggcctgaagctgagaagaagcagcgacccccccgccagcgcctacccctgcgccggcgtgagccacagaagaagagagcccccctgcctggccaagatcctgggcctgttctggatcctgatcttcttcatgcacagcctgagactgcccggcagagagagcagagtggaggagcccctggagaacgacatcagccagctggtggacgaggtggtgtgcgccctgcagcccgtgatccaggacaagcccttcgccttcttcggccacagcatgggcagctacatcgccttcagaaccgccctgggcctgaaggagaacaaccagcccgagcccctgcacctgttcctgagcagcgccacccccgtgcacagcaaggcctggcacagaatccccaaggacgacgagctgagcgaggagcagatcagccactacctgatggagttcggcggcacccccaagcacttcgccgaggccaaggagttcgtgaagcagtgcagccccatcatcagagccgacctgaacatcgtgagaagctgcaccagcaacgtgcccagcaaggccgtgctgagctgcgacctgacctgcttcgtgggcagcgaggacatcgccaaggacatggaggcctggaaggacgtgaccagcggcaacgccaagatctaccagctgcccggcggccacttctacctgctggaccccgccaacgagaagctgatcaagaactacatcatcaagtgcctggaggtgagcagcatcagcaacttctag

SEQ ID NO: 22951 - DNA, 414 bp, Artificial Sequence
  Description of Artificial Sequence: Synthetic coding sequence
atggagagaggcgaccagcccaagagaaccagacaggccaccccctgcgccaccagactgttcctgcaccccagaggcagcgacaccctgcccctgaacgagaacatcttcaactgcctgtacaagaaccccgaggccaccttcaagctgatctgcttcccctggatgggcggcggcagcacccacttcgccaagtggggccaggacacccacgacctgctggaggtgcacagcctgagactgcccggcagagagagcagagtggaggagcccctggagaacgacatcagccagctggtggacgaggtggtgtgcgccctgcagcccgtgatccaggacaagcccttcgccttcttcggccacagatacctgatcagcgtgctgaaggacttcagaggcgtgagcagcatctag

SEQ ID NO: 22952 - DNA, 798 bp, Artificial Sequence
  Description of Artificial Sequence: Synthetic coding sequence
atggagagaggcgaccagcccaagagaaccagaaacgagaacatcttcaactgcctgtacaagaaccccgaggccaccttcaagctgatctgcttcccctggatgggcggcggcagcacccacttcgccaagtggggccaggacacccacgacctgctggaggtgcacagcctgagactgcccggcagagagagcagagtggaggagcccctggagaacgacatcagccagctggtggacgaggtggtgtgcgccctgcagcccgtgatccaggacaagcccttcgccttcttcggccacagcatgggcagctacatcgccttcagaaccgccctgggcctgaaggagaacaaccagcccgagcccctgcacctgttcctgagcagcgccacccccgtgcacagcaaggcctggcacagaatccccaaggacgacgagctgagcgaggagcagatcagccactacctgatggagttcggcggcacccccaagcacttcgccgaggccaaggagttcgtgaagcagtgcagccccatcatcagagccgacctgaacatcgtgagaagctgcaccagcaacgtgcccagcaaggccgtgctgagctgcgacctgacctgcttcgtgggcagcgaggacatcgccaaggacatggaggcctggaaggacgtgaccagcggcaacgccaagatctaccagctgcccggcggccacttctacctgctggaccccgccaacgagaagctgatcaagaactacatcatcaagtgcctggaggtgagcagcatcagcaacttctag

SEQ ID NO: 22953 - DNA, 291 bp, Artificial Sequence
  Description of Artificial Sequence: Synthetic coding sequence
atggagagaggcgaccagcccaagagaaccagaaacgagaacatcttcaactgcctgtacaagaaccccgaggccaccttcaagctgatctgcttcccctggatgggcggcggcagcacccacttcgccaagtggggccaggacacccacgacctgctggaggagaccgccagccaccacgtggccaaggccggcctgaagctgagaagaagcagcgacccccccgccagcgcctacccctgcgccggcgtgagccacagaagaagagagcccccctgcctggccaagtag

SEQ ID NO: 22954 - DNA, 432 bp, Artificial Sequence
  Description of Artificial Sequence: Synthetic coding sequence
atggagagaggcgaccagcccaagagaaccagaaacgagaacatcttcaactgcctgtacaagaaccccgaggccaccttcaagctgatctgcttcccctggatgggcggcggcagcacccacttcgccaagtggggccaggacacccacgacctgctggaggtgcacagcctgagactgcccggcagagagagcagagtggaggagcccctggagaacgacatcagccagctggtggacgaggtggtgtgcgccctgcagcccgtgatccaggacaagcccttcgccttcttcggccacagcatgggcagctacatcgccttcagaaccgccctgggcctgaaggagaacaaccagcccgagcccctgcacctgttcctgagcagcgccacccccgtgcacagcaaggcctggcacagaatccccaagtag

SEQ ID NO: 22955 - DNA, 546 bp, Artificial Sequence
  Description of Artificial Sequence: Synthetic coding sequence
atggagagaggcgaccagcccaagagaaccagaaacgagaacatcttcaactgcctgtacaagaaccccgaggccaccttcaagctgatctgcttcccctggatgggcggcggcagcacccacttcgccaagtggggccaggacacccacgacctgctggaggtgcacagcctgagactgcccggcagagagagcagagtggaggagcccctggagaacgacatcagccagctggtggacgaggtggtgtgcgccctgcagcccgtgatccaggacaagcccttcgccttcttcggccacagcatgggcagctacatcgccttcagaaccgccctgggcctgaaggagaacaaccagcccgagcccctgcacctgttcctgagcagcgccacccccgtgcacagcaaggcctggcacagaatccccaaggacgacgagctgagcgaggagcagatcagccactacctgatggagttcggcggcacccccaagcacttcgccgaggccaaggagttcgtgaagcagtgcagccccatcatcagatag

SEQ ID NO: 22956 - DNA, 957 bp, Artificial Sequence
  Description of Artificial Sequence: Synthetic coding sequence
atggccgccgccgccctgccccccagacccctgctgctgctgcccctggtgctgctgctgagcggcagacccaccagagccgacagcaaggtgttcggcgacctggaccaggtgagaatgaccagcgagggcagcgactgcagatgcaagtgcatcatgagacccctgagcaaggacgcctgcagcagagtgagaagcggcagagccagagtggaggacttctacaccgtggagaccgtgagcagcggcaccgactgcagatgcagctgcaccgccccccccagcagcctgaacccctgcgagaacgagtggaagatggagaagctgaagaagcaggcccccgagctgctgaagagcatcaaggccaacctgagcagagagaacgaggtggtgaaggacagcgtgagacacctgagcgagcagctgagacactacgagaaccacagcgccatcatgctgggcatcaagaaggagctgagcagactgggcctgcagctgctgcagaaggacgccgccgccgcccccgccacccccgccaccggcaccggcagcaaggcccaggacaccgccagaggcaagggcaaggacatcagcaagtacggcagcgtgcagaagagcttcgccgacagaggcctgcccaagccccccaaggagaagctgctgcaggtggagaagctgagaaaggagagcggcaagggcagcttcctgcagcccaccgccaagcccagagccctggcccagcagcaggccgtgatcagaggcttcacctactacaaggccggcaagcaggaggtgaccgaggccgtggccgacaacaccctgcagggcaccagctggctggagcagctgccccccaaggtggagggcagaagcaacagcgccgagcccaacagcgccgagcaggacgaggccgagcccagaagcagcgagagagtggacctggccagcggcacctag

SEQ ID NO: 22957 - DNA, 987 bp, Artificial Sequence
  Description of Artificial Sequence: Synthetic coding sequence
atgaagctgtggatggagagccacctgatcgtgcccgagaccagacccagccccagaatgatgagcaaccagaccctggtgaccgagttcatcctgcagggcttcagcgagcaccccgagtacagagtgttcctgttcagctgcttcctgttcctgtacagcggcgccctgaccggcaacgtgctgatcaccctggccatcaccttcaaccccggcctgcacgcccccatgtacttcttcctgctgaacctggccaccatggacatcatctgcaccagcagcatcatgcccaaggccctggccagcctggtgagcgaggagagcagcatcagctacggcggctgcatggcccagctgtacttcctgacctgggccgccagcagcgagctgctgctgctgaccgtgatggcctacgacagatacgccgccatctgccaccccctgcactacagcagcatgatgagcaaggtgttctgcagcggcctggccaccgccgtgtggctgctgtgcgccgtgaacaccgccatccacaccggcctgatgctgagactggacttctgcggccccaacgtgatcatccacttcttctgcgaggtgccccccctgctgctgctgagctgcagcagcacctacgtgaacggcgtgatgatcgtgctggccgacgccttctacggcatcgtgaacttcctgatgaccatcgccagctacggcttcatcgtgagcagcatcctgaaggtgaagaccgcctggggcagacagaaggccttcagcacctgcagcagccacctgaccgtggtgtgcatgtactacaccgccgtgttctacgcctacatcagccccgtgagcggctacagcgccggcaagagcaagctggccggcctgctgtacaccgtgctgagccccaccctgaaccccctgatctacaccctgagaaacaaggaggtgaaggccgccctgagaaagctgttccccttcttcagaaactag

SEQ ID NO: 22958 - DNA, 903 bp, Artificial Sequence
  Description of Artificial Sequence: Synthetic coding sequence
atgggccagaaccagaccagcatcagcgacttcctgctgctgggcctgcccatccagcccgagcagcagaacctgtgctacgccctgttcctggccatgtacctgaccaccctgctgggcaacctgctgatcatcgtgctgatcagactggacagccacctgcacacccccgtgtacctgttcctgagcaacctgagcttcagcgacctgtgcttcagcagcgtgaccatgcccaagctgctgcagaacatgcagaaccaggaccccagcatcccctacgccgactgcctgacccagatgtacttcttcctgtacttcagcgacctggagagcttcctgctggtggccatggcctacgacagatacgtggccatctgcttccccatgcactacaccgccatcatgagccccatgctgtgcctgagcgtggtggccctgagctgggtgctgaccaccttccacgccatgctgcacaccctgctgatggccagactgtgcttctgcgccgacaacgtgatcccccacttcttctgcgacatgagcgccctgctgaagctggcctgcagcgacaccagagtgaacgagtgggtgatcttcatcatgggcggcctgatcctggtgatccccttcctgctgatcctgggcagctacgccagaatcgtgagcagcatcctgaaggtgcccagcagcaagggcatctgcaaggccttcagcacctgcggcagccacctgagcgtggtgagcctgttctacggcaccgtgatcggcctgtacctgtgccccagcgccaacagcagcaccctgaaggacaccgtgatggccatgatgtacaccgtggtgacccccatgctgacccccttcatctacagcctgagaaacagagacatgaagggcgccctgtag

SEQ ID NO: 22959 - DNA, 948 bp, Artificial Sequence
  Description of Artificial Sequence: Synthetic coding sequence
atggagatcgtgagcaccggcaacgagaccatcaccgagttcgtgctgctgggcttctacgacatccccgagctgcacttcctgttcttcatcgtgttcaccgccgtgtacgtgttcatcatcatcggcaacatgctgatcatcgtggccgtggtgagcagccagagactgcacaagcccatgtacatcttcctggccaacctgagcttcctggacatcctgtacaccagcgccgtgatgcccaagatgctggagggcttcctgcaggaggccaccatcagcgtggccggctgcctgctgcagttcttcatcttcggcagcctggccaccgccgagtgcctgctgctggccgtgatggcctacgacagatacctggccatctgctaccccctgcactaccccctgctgatgggccccagaagatacatgggcctggtggtgaccacctggctgagcggcttcgtggtggacggcctggtggtggccctggtgacccagctgagattctgcggccccaaccacatcgaccagttctactgcgacttcatgctgttcgtgggcctggcctgcagcgaccccagagtggcccaggtgaccaccctgatcctgagcgtgttctgcctgaccatccccttcggcctgatcctgaccagctacgccagaatcgtggtggccgtgctgagagtgcccgccggcgccagcagaagaagagccttcagcacctgcagcagccacctggccgtggtgaccaccttctacggcaccctgatgatcttctacgtggcccccagcgccgtgcacagccagctgctgagcaaggtgttcagcctgctgtacaccgtggtgacccccctgttcaaccccgtgatctacaccatgagaaacaaggaggtgcaccaggccctgagaaagatcctgtgcatcaagcagaccgagaccctggactag

SEQ ID NO: 22960 - DNA, 948 bp, Artificial Sequence; identical to SEQ ID NO: 22959
  Description of Artificial Sequence: Synthetic coding sequence

SEQ ID NO: 22961 - DNA, 948 bp, Artificial Sequence; identical to SEQ ID NO: 22959
  Description of Artificial Sequence: Synthetic coding sequence

SEQ ID NO: 22962 - DNA, 924 bp, Artificial Sequence
  Description of Artificial Sequence: Synthetic coding sequence
atgctgaacaccaccagcgtgaccgagttcctgctgctgggcgtgaccgacatccaggagctgcagcccttcctgttcgtggtgttcctgaccatctacttcatcagcgtgaccggcaacggcgccgtgctgatgatcgtgatcagcgaccccagactgcacagcctgatgtacttcttcctgggcaacctgagctacctggacatctgctacagcaccgtgaccctgcccaagatgctgcagaacttcctgagcacccacaaggccatcagcttcctgggctgcatcagccagctgcacttcttccacttcctgggcagcaccgagagcatgctgttcgccgtgatggccttcgacctgagcgtggccatctgcaagcccctgagatacaccgtgatcatgaacccccagctgtgcacccagatggccatcaccatctgggtgatcggcttcttccacgccctgctgcacagcgtgatgaccagcagactgaacttctgcggcagcaacagaatccaccacttcctgtgcgacatcaagcccctgctgaagctggcctgcggcaacaccgagctgaaccagtggctgctgagcaccgtgaccggcaccatcgccatgggccccttcttcctgaccctgctgagctacttctacatcatcacctacctgttcttcaagaccagaagctgcagcatgctgtgcaaggccctgagcacctgcgccagccacttcatggtggtgatcctgttctacgcccccgtgctgttcacctacatccaccccgccctggagagcttcatggaccaggacagaatcgtggccatcatgtacaccgtggtgacccccgtgctgaaccccctgatctacaccctgagaaacaaggaggtgaagggcgccctgggcagagtgatcagaagactgtag

SEQ ID NO: 22963 - DNA, 924 bp, Artificial Sequence; identical to SEQ ID NO: 22962
  Description of Artificial Sequence: Synthetic coding sequence

SEQ ID NO: 22964 - DNA, 924 bp, Artificial Sequence; identical to SEQ ID NO: 22962
  Description of Artificial Sequence: Synthetic coding sequence

SEQ ID NO: 22965 - DNA, 951 bp, Artificial Sequence
  Description of Artificial Sequence: Synthetic coding sequence
atggagaacgtgaccaccatgaacgagttcctgctgctgggcctgaccggcgtgcaggagctgcagcccttcttcttcggcatcttcctgatcatctacctgatcaacctgatcggcaacggcagcatcctggtgatggtggtgctggagccccagctgcacagccccatgtacttcttcctgggcaacctgagctgcctggacatcagctacagcagcgtgaccctgcccaagctgctggtgaacctggtgtgcagcagaagagccatcagcttcctgggctgcatcatccagctgcacttcttccacttcctgggcagcaccgaggccatcctgctggccatcatggccttcgacagattcgtggccatctgcaaccccctgagatacaccgtgatcatgaacccccaggtgtgcatcctgctggccgccgccgcctggctgatcagcttcttctacgccctgatgcacagcgtgatgaccgcccacctgagcttctgcggcagccagaagctgaaccacttcttctacgacgtgaagcccctgctggagctggcctgcagcgacaccctgctgaaccagtggctgctgagcatcgtgaccggcagcatcagcatgggcgccttcttcctgaccctgctgagctgcttctacgtgatcggcttcctgctgttcaagaacagaagctgcagaatcctgcacaaggccctgagcacctgcgccagccacttcatggtggtgtgcctgttctacggccccgtgggcttcacctacatcagacccgccagcgccaccagcatgatccaggacagaatcatggccatcatgtacagcgccgtgacccccgtgctgaaccccctgatctacaccctgagaaacaaggaggtgatgatggccctgaagaagatcttcggcagaaagctgttcaaggactggcagcagcaccactag

SEQ ID NO: 22966 - DNA, 951 bp, Artificial Sequence; identical to SEQ ID NO: 22965
  Description of Artificial Sequence: Synthetic coding sequence

SEQ ID NO: 22967 - DNA, 951 bp, Artificial Sequence; identical to SEQ ID NO: 22965
  Description of Artificial Sequence: Synthetic coding sequence

SEQ ID NO: 22968 - DNA, 951 bp, Artificial Sequence; identical to SEQ ID NO: 22965
  Description of Artificial Sequence: Synthetic coding sequence

SEQ ID NO: 22969 - DNA, 936 bp, Artificial Sequence
  Description of Artificial Sequence: Synthetic coding sequence
atggacaacctgaccaaggtgaccgagttcctgctgatggagttcagcggcatctgggagctgcaggtgctgcacgccggcctgttcctgctgatctacctggccgtgctggtgggcaacctgctgatcatcgccgtgatcaccctggaccagcacctgcacacccccatgtacttcttcctgaagaacctgagcgtgctggacctgtgctacatcagcgtgaccgtgcccaagagcatcagaaacagcctgaccagaagaagcagcatcagctacctgggctgcgtggcccaggtgtacttcttcagcgccttcgccagcgccgagctggccttcctgaccgtgatgagctacgacagatacgtggccatctgccaccccctgcagtacagagccgtgatgaccagcggcggctgctaccagatggccgtgaccacctggctgagctgcttcagctacgccgccgtgcacaccggcaacatgttcagagagcacgtgtgcagaagcagcgtgatccaccagttcttcagagacatcccccacgtgctggccctggtgagctgcgaggtgttcttcgtggagttcctgaccctggccctgagcagctgcctggtgctgggctgcttcatcctgatgatgatcagctacttccagatcttcagcaccgtgctgagaatccccagcggccagagcagagccaaggccttcagcacctgcagcccccagctgatcgtgatcatgctgttcctgaccaccggcctgttcgccgccctgggccccatcgccaaggccctgagcatccaggacctggtgatcgccctgacctacaccgtgctgccccccttcctgaaccccatcatctacagcctgagaaacaaggagatcaagaccgccatgtggagactgttcgtgaagatctacttcctgcagaagtag

SEQ ID NO: 22970 - DNA, 966 bp, Artificial Sequence
  Description of Artificial Sequence: Synthetic coding sequence
atggtgaacctgaccagcaccagcggcttcctgctgatgggcttcagcgacgagagaaagctgcagatcctgcacgccctggtgttcctggtgacctacctgctggccctgaccggcaacctgctgatcatcaccatcatcaccgtggacagaagactgcacagccccatgtactacttcctgaagcacctgagcctgctggacctgtgcttcatcagcgtgaccgtgccccagagcatcgccaacagcctgatgggcaacggctacatcagcctggtgcagtgcatcctgcaggtgttcttcttcatcgccctggccagcagcgaggtggccatcctgaccgtgatgagctacgacagatacgccgccatctgccagcccctgcactacgagaccatcatggaccccagagcctgcagacacgccgtgatcgccgtgtggatcgccggcggcctgagcggcctgatgcacgccgccatcaacttcagcatccccctgtgcggcaagagagtgatccaccagttcttctgcgacgtgccccagatgctgaagctggcctgcagctacgagttcatcaacgagatcgccctggccgccttcaccaccagcgccgccttcatctgcctgatcagcatcgtgctgagctacatcagaatcttcagcaccgtgctgagaatccccagcgccgagggcagaaccaaggtgttcagcacctgcctgccccacctgttcgtggccaccttcttcctgagcgccgccggcttcgagttcctgagactgcccagcgacagcagcagcaccgtggacctggtgttcagcgtgttctacaccgtgatcccccccaccctgaaccccgtgatctacagcctgagaaacgacagcatgaaggccgccctgagaaagatgctgagcaaggaggagctgccccagagaaagatgtgcctgaaggccatgttcaagctgtag

SEQ ID NO: 22971 - DNA, 966 bp, Artificial Sequence; identical to SEQ ID NO: 22970
  Description of Artificial Sequence: Synthetic coding sequence

SEQ ID NO: 22972 - DNA, 966 bp, Artificial Sequence; identical to SEQ ID NO: 22970
  Description of Artificial Sequence: Synthetic coding sequence

SEQ ID NO: 22973 - DNA, 966 bp, Artificial Sequence; identical to SEQ ID NO: 22970
  Description of Artificial Sequence: Synthetic coding sequence

SEQ ID NO: 22974 - DNA, 939 bp, Artificial Sequence
  Description of Artificial Sequence: Synthetic coding sequence
atggtgaaccagagcagcacccccggcttcctgctgctgggcttcagcgagcaccccggcctggagagaaccctgttcgtggtggtgttcaccagctacctgctgaccctggtgggcaacaccctgatcatcctgctgagcgtgctggaccccaagctgcacagccccatgtacttcttcctgagcaacctgagcttcctggacctgtgcttcaccaccagctgcgtgccccagatgctggtgaacctgtggggccccaagaagaccatcagcttcctggactgcagcgtgcagatcttcatcttcctgagcctgggcaccaccgagtgcatcctgctgaccgtgatggccttcgacagatacgtggccgtgtgccagcccctgcactacgccaccatcatccaccccagactgtgctggcagctggccagcgtggcctgggtgatcggcctggtggagagcgtggtgcagacccccagcaccctgcacctgcccttctgccccgacagacaggtggacgacttcgtgtgcgaggtgcccgccctgatcagactgagctgcgaggacaccagctacaacgagatccaggtggccgtggccagcgtgttcatcctggtggtgcccctgagcctgatcctggtgagctacggcgccatcacctgggccgtgctgagaatcaacagcgccaagggcagaagaaaggccttcggcacctgcagcagccacctgaccgtggtgaccctgttctacagcagcgtgatcgccgtgtacctgcagcccaagaacccctacgcccaggagagaggcaagttcttcggcctgttctacgccgtgggcacccccagcctgaaccccctgatctacaccctgagaaacaaggaggtgaccagagccttcagaagactgctgggcaaggagatgggcctgacccagagctag

SEQ ID NO: 22975 - DNA, 939 bp, Artificial Sequence
  Description of Artificial Sequence: Synthetic coding sequence
atggtgaaccagagcagcacccccggcttcctgctgctgggcttcagcgagcaccccggcctggagagaaccctgttcgtggtggtgttcaccagctacctgctgaccctggtgggcaacaccctgatcatcctgctgagcgccctggaccccaagctgcacagccccatgtacttcttcctgagcaacctgagcttcctggacctgtgcttcaccaccagctgcgtgccccagatgctggtgaacctgtggggccccaagaagaccatcagcttcctggactgcagcgtgcagatcttcatcttcctgagcctgggcaccaccgagtgcatcctgctgaccgtgatggccttcgacagatacgtggccgtgtgccagcccctgcactacgccaccatcatccaccccagactgtgctggcagctggccagcgtggcctgggtgatcggcctggtggagagcgtggtgcagacccccagcaccctgcacctgcccttctgccccgacagacaggtggacgacttcgtgtgcgaggtgcccgccctgatcagactgagctgcgaggacaccagctacaacgagatccaggtggccgtggccagcgtgttcatcctggtggtgcccctgagcctgatcctggtgagctacggcgccatcacctgggccgtgctgagaatcaacagcgccaagggcagaagaaaggccttcggcacctgcagcagccacctgaccgtggtgaccctgttctacagcagcgtgatcgccgtgtacctgcagcccaagaacccctacgcccaggagagaggcaagttcttcggcctgttctacgccgtgggcacccccagcctgaaccccctgatctacaccctgagaaacaaggaggtgaccagagccttcagaagactgctgggcaaggagatgggcctgacccagagctag

SEQ ID NO: 22976 - DNA, 939 bp, Artificial Sequence; identical to SEQ ID NO: 22974
  Description of Artificial Sequence: Synthetic coding sequence

SEQ ID NO: 22977 - DNA, 939 bp, Artificial Sequence; identical to SEQ ID NO: 22974
  Description of Artificial Sequence: Synthetic coding sequence

SEQ ID NO: 22978 - DNA, 939 bp, Artificial Sequence
  Description of Artificial Sequence: Synthetic coding sequence
atgctgatgaagaagaacgccagcttcgaggacttcttcatcctgctgggcttcagcaactggccccacctggaggtggtgctgttcgtggtgatcctgatcttctacctgatcaccctgatcggcaacctgttcatcatcatcctgagctacctggacagccacctgcacacccccatgtacttcttcctgagcaacctgagcttcctggacctgtgctacaccaccagcagcatcccccagctgctggtgaacctgtggggccccgagaagaccatcagctacgccggctgcaccgtgcagctgtacttcgtgctggccctgggcaccgccgagtgcgtgctgctggtggtgatgagctacgacagatacgccgccgtgtgcagacccctgcactacaccgtgctgatgcaccccagattctgcagactgctggccgccgccagctgggtgagcggcttcaccaccagcgccctgcacagcagcttcaccttctggatccccctgtgcagacacagactggtggaccacttcttctgcgaggtgcccgccctgctgagactgagctgcgtggacacccaggccaacgagctgaccctgatggtgatgagcagcatcttcgtgctgatccccctgatcctgatcctgaccagctacggcgccatcgccagagccgtgctgagcatgcagagcaccaccggcctgcagaaggtgctgagaacctgcggcgcccacctgatggtggtgagcctgttcttcatccccgtgatgtgcatgtacctgcagccccccagcgagaacagccaggaccagggcaagttcatcgccctgttctacaccgtggtgacccccagcctgaaccccctgatctacaccttcagaaacaaggacgtgagaggcgccgtgaagagactgatgggctgggagtggggcatgtag

SEQ ID NO: 22979 - DNA, 939 bp, Artificial Sequence
  Description of Artificial Sequence: Synthetic coding sequence
atgatgatcaagaagaacgccagcagcgaggacttcttcatcctgctgggcttcagcaactggccccagctggaggtggtgctgttcgtggtgatcctgatcttctacctgatgaccctgaccggcaacctgttcatcatcatcctgagctacgtggacagccacctgcacacccccatgtacttcttcctgagcaacctgagcttcctggacctgtgctacaccaccagcagcatcccccagctgctggtgaacctgagaggccccgagaagaccatcagctacgccggctgcatggtgcagctgtacttcgtgctggccctgggcatcgccgagtgcgtgctgctggtggtgatgagctacgacagatacgtggccgtgtgcagacccctgcactacaccgtgctgatgcaccccagattctgccacctgctggtggccgccagctgggtgatcggcttcaccatcagcgccctgcacagcagcttcaccttctgggtgcccctgtgcggccacagactggtggaccacttcttctgcgaggtgcccgccctgctgagactgagctgcgtggacacccacgccaacgagctgaccctgatggtgatgagcagcatcttcgtgctgatccccctgatcctgatcctgaccacctacggcgccatcgccagagccgtgctgagcatgcagagcaccaccggcctgcagaaggtgttcagaacctgcggcgcccacctgatggtggtgagcctgttcttcatccccgtgatgtgcatgtacctgcagccccccagcgagaacagccccgaccagggcaagttcatcgccctgttctacaccgtggtgacccccagcctgaaccccctgatctacaccctgagaaacaagcacgtgaagggcgccgccaagagactgctgggctgggagtggggcaagtag

SEQ ID NO: 22980 - DNA, 939 bp, Artificial Sequence
  Description of Artificial Sequence: Synthetic coding sequence
atgatgatcaagaagaacgccagcagcgaggacttcttcatcctgctgggcttcagcaactggccccagctggaggtggtgctgttcgtggtgatcctgatcttctacctgatgaccctgaccggcaacctgttcatcatcatcctgagctacgtggacagccacctgcacacccccatgtacttcttcctgagcaacctgagcttcctggacctgtgctacaccaccagcagcatcccccagctgctggtgaacctgagaggccccgagaagaccatcagctacgccggctgcatggtgcagctgtacttcgtgctggccctgggcatcaccgagtgcgtgctgctggtggtgatgagctacgacagatacgtggccgtgtgcagacccctgcactacaccgtgctgatgcaccccagattctgccacctgctggtggccgccagctgggtgatcggcttcaccatcagcgccctgcacagcagcttcaccttctgggtgcccctgtgcggccacagactggtggaccacttcttctgcgaggtgcccgccctgctgagactgagctgcgtggacacccacgccaacgagctgaccctgatggtgatgagcagcatcttcgtgctgatccccctgatcctgatcctgaccacctacggcgccatcgccagagccgtgctgagcatgcagagcaccaccggcctgcagaaggtgttcagaacctgcggcgcccacctgatggtggtgagcctgttcttcatccccgtgatgtgcatgtacctgcagccccccagcgagaacagccccgaccagggcaagttcatcgccctgttctacaccgtggtgacccccagcctgaaccccctgatctacaccctgagaaacaagcacgtgaagggcgccgccaagagactgctgggctgggagtggggcaagtag

SEQ ID NO: 22981 - DNA, 939 bp, Artificial Sequence; identical to SEQ ID NO: 22979
  Description of Artificial Sequence: Synthetic coding sequence

SEQ ID NO: 22982 - DNA, 936 bp, Artificial Sequence
  Description of Artificial Sequence: Synthetic coding sequence
atgaacgacgacggcaaggtgaacgccagcagcgagggctacttcatcctggtgggcttcagcaactggccccacctggaggtggtgatcttcgtggtggtgctgatcttctacctgatgaccctgatcggcaacctgttcatcatcatcctgagctacctggacagccacctgcacacccccatgtacttcttcctgagcaacctgagcttcctggacctgtgctacaccaccagcagcatcccccagctgctggtgaacctgtggggccccgagaagaccatcagctacgccggctgcatgatccagctgtacttcgtgctggccctgggcaccaccgagtgcgtgctgctggtggtgatgagctacgacagatacgccgccgtgtgcagacccctgcactacaccgtgctgatgcaccccagattctgccacctgctggccgtggccagctgggtgagcggcttcaccaacagcgccctgcacagcagcttcaccttctgggtgcccctgtgcggccacagacaggtggaccacttcttctgcgaggtgcccgccctgctgagactgagctgcgtggacacccacgtgaacgagctgaccctgatgatcaccagcagcatcttcgtgctgatccccctgatcctgatcctgaccagctacggcgccatcgtgagagccatcctgagaatgcagagcaccaccggcctgcagaaggtgttcggcacctgcggcgcccacctgatggccgtgagcctgttcttcatccccgccatgtgcatgtacctgcagccccccagcggcaacagccaggaccagggcaagttcatcgccctgttctacaccgtggtgacccccagcctgaaccccctgatctacaccctgagaaacaaggtggtgagaggcgccgtgaagagactgatgggctgggagtag

SEQ ID NO: 22983 - DNA, 939 bp, Artificial Sequence
  Description of Artificial Sequence: Synthetic coding sequence
atggagaacggcagctacaccagctacttcatcctgctgggcctgttcaaccacaccagagcccaccaggtgctgttcatgatggtgctgagcatcgtgctgaccagcctgttcggcaacagcctgatgatcctgctgatccactgggaccacagactgcacacccccatgtacttcctgctgagccagctgagcctgatggacgtgatgctggtgagcaccaccgtgcccaagatggccgccgactacctgaccggcagcaaggccatcagcagagccggctgcggcgcccagatcttcttcctgcccaccctgggcggcggcgagtgcttcctgctggccgccatggcctacgacagatacgccgccgtgtgccaccccctgagataccccaccctgatgagctggcagctgtgcctgagaatgaacctgagctgctggctgctgggcgccgccgacggcctgctgcaggccgtggccaccctgagcttcccctactgcggcgcccacgagatcgaccacttcttctgcgagacccccgtgctggtgagactggcctgcgccgacaccagcgtgttcgagaacgccatgtacatctgctgcgtgctgatgctgctggtgcccttcagcctgatcctgagcagctacggcctgatcctggccgccgtgctgcacatgagaagcaccgaggccagaaagaaggccttcgccacctgcagcagccacgtggccgtggtgggcctgttctacggcgccgccatcttcacctacatgagacccaagagccacagaagcaccaaccacgacaaggtggtgagcgccttctacaccatgttcacccccctgctgaaccccctgatctacagcgtgaagaacagcgaggtgaagggcgccctgaccagatgcatgggcagatgcgtggccctgagcagagagtag

SEQ ID NO: 22984 - DNA, 930 bp, Artificial Sequence
  Description of Artificial Sequence: Synthetic coding sequence
atggagaacagcaccgaggtgaccgagttcatcctgctgggcctgaccgacgaccccaacctgcagatccccctgctgctggccttcctgttcatctacctgatcaccctgctgggcaacggcggcatgatggtgatcatccacagcgacagccacctgcacacccccatgtacttcttcctgagcaacctgagcctggtggacctgggctacagcagcgccgtggcccccaagaccgtggccgccctgagaagcggcgacaaggccatcagctacgacggctgcgccgcccagttcttcttcttcgtgggcttcgccaccgtggagtgctacctgctggccagcatggcctacgacagacacgccgccgtgtgcagacccctgcactacaccaccaccatgaccgccggcgtgtgcgccctgctggccaccggcagctacgtgagcggcttcctgaacgccagcatccacgccgccggcaccttcagactgagcttctgcggcagcaacgagatcaaccacttcttctgcgacatcccccccctgctggccctgagctgcagcgacaccagaatcagcaagctggtggtgttcgtggccggcttcaacgtgttcttcaccctgctggtgatcctgatcagctacttcttcatctgcatcaccatccagagaatgcacagcgccgagggccagaagaaggtgttcagcacctgcgccagccacctgaccgccctgagcatcttctacggcaccatcatcttcatgtacctgcagcccaacagcagccagagcgtggacaccgacaagatcgccagcgtgttctacaccgtggtgatccccatgctgaaccccctgatctacagcctgagaaacaaggaggtgaagagcgccctgtggaagatcctgaacaagctgtacccccagtactag

SEQ ID NO: 22985 - DNA, 942 bp, Artificial Sequence
  Description of Artificial Sequence: Synthetic coding sequence
atggaggaggagaacgccaccctgctgaccgagttcgtgctgaccggcttcctgtaccagccccagtggaagatccccctgttcctggccttcctggtgatctacctgatcaccatcatgggcaacctgggcctgatcgccgtgatctggaaggacccccacctgcacatccccatgtacctgctgctgggcaacctggccttcgtggacgcctggatcagcagcaccgtgacccccaagatgctgaacaacttcctggccaagagcaagatgatcagcctgagcgagtgcaagatccagttcttcagcttcgccatcagcgtgaccaccgagtgcttcctgctggccaccatggcctacgacagatacgtggccatctgcaagcccctgctgtaccccgccatcatgaccaacggcctgtgcatcagactgctgatcctgagctacgtgggcggcatcctgcacgccctgatccacgagggcttcctgttcagactgaccttctgcaacagcaacatcgtgcaccacatctactgcgacaccatccccctgagcaagatcagctgcaccgacagcagcatcaacttcctgatggtgttcatcttcagcggcagcatccaggtgttcagcatcgtgaccatcctggtgagctacaccttcgtgctgttcgccatcctgaagaagaagagcgacaagggcgtgagaaaggccttcagcacctgcggcgcccacctgttcagcgtgagcctgtactacggccccctgctgttcatctacgtgggccccgccagcccccaggccgacgaccaggacatggtggagcccctgttctacaccgtgatcatccccctgctgaaccccatcatctacagcctgagaaacaagcaggtgaccgtgagcttcaccaagatgctgaagaagcacgtgaaggtgagctactag

SEQ ID NO: 22986 - DNA, 942 bp, Artificial Sequence
  Description of Artificial Sequence: Synthetic coding sequence
atggaggaggagaacgccaccctgctgaccgagttcgtgctgaccggcttcctgtaccagccccagtggaagatccccctgttcctggccttcctggtgatctacctgatcaccatcatgggcaacctgggcctgatcgccgtgatctggaaggacccccacctgcacatccccatgtacctgctgctgggcaacctggccttcgtggacgcctggatcagcagcaccgtgacccccaagatgctgaacaacttcctggccaagagcaagatgatcagcctgagcgagtgcaagatccagttcttcagcatcgccatcggcgtgaccaccgagtgcttcctgctggccaccatggcctacgacagatacgtggccatctgcaagcccctgctgtaccccgccatcatgaccaacggcctgtgcatcagactgctgatcctgagctacatcgccggcatcctgcacgccctgatccacgagggcttcctgttcagactgaccttctgcaacagcaacatcgtgcaccacatctactgcgacaccatccccctgagcaagatcagctgcaccgacagcagcatcaacttcctgatggtgttcatcttcagcggcagcatccaggtgttcagcatcgtgaccatcctgatcagctacaccttcgtgctgttcaccgtgctggagaagaagagcgacaagggcgtgagaaaggccttcagcacctgcggcgcccacctgttcagcgtgtgcctgtactacggccccctgctgctgatgtacgtgggccccgccagcccccaggccgacggccagaacatggtggagcccctgttctacaccgtgatcatccccctgctgaaccccatcatctacagcctgagaaacaagcaggtgatcgtgagcttcatcaagatgctgaagagaaacgtgaaggtgagctactag

SEQ ID NO: 22987 - DNA, 933 bp, Artificial Sequence
  Description of Artificial Sequence: Synthetic coding sequence
atggaggaggagaacgccaccctgctgaccgagttcgtgctgaccggcttcctgtaccagccccagtggaagatccccctgttcctggccttcctggtgatctacctgatcaccatcatgggcaacctgggcctgatcgccgtgatctggaaggacccccacctgcacatccccatgtacctgctgctgggcaacctggccttcgtggacgcctggatcagcagcaccgtgacccccaagatgctgaacaacttcctggccaagagcaagatgatcagcctgagcgagtgcaagatccagttcttcagcatcgccatcggcgtgaccaccgagtgcttcctgctggccaccatggcctacgacagatacgtggccatctgcaagcccctgctgtaccccgccatcatgaccaacggcctgtgcatcagactgctgatcctgagctacatcgccggcatcctgcacgccctgatccacgagggcttcctgttcagactgaccttctgcaacagcaacatcgtgcaccacatctactgcgacaccatccccctgagcaagatcagctgcaccgacagcagcatcaacttcctgatggtgttcatcttcagcggcagcatccaggtgttcagcatcgtgaccatcctgatcagctacaccttcgtgctgttcaccgtgctggagaagaagagcgacaagggcgtgagaaaggccttcagcacctgcggcgcccacctgttcagcgtgtgcctgtactacggccccctgctgctgatgtacgtgggccccgccagcccccaggccgacggccagaacatggtggagcccctgttctacaccgtgatcatccccctgctgaaccccatcatctacagcctgagaaacaagcaggtgatcgtgagcttcatcaagatgctgaagagaaacggcatctag

SEQ ID NO: 22988 - DNA, 966 bp, Artificial Sequence
  Description of Artificial Sequence: Synthetic coding sequence
atgaacaaggagaaccacagcctgatcgccgagttcatcctgaccggcttcacctaccaccccaagctgaagaccgtgctgttcgtggtgttcttcgccatctacctgatcaccatggtgggcaacatcggcctggtggccctgatctacatcgagcagagactgcacacccccatgtacatcttcctgggcaacctggtgctgatggacagctgctgcagcagcgccatcacccccaagatgctggagaacttcttcagcgaggacaagagaatcaccctgtacgagtgcatggcccagttctacttcctgtgcctggccgagaccaccgactgcttcctgctggccgccatggcctacgactgctacgtggccatctgcaaccccctgcagtaccacaccatgatgagcaagaccctgtgcatccagatgaccgccggcgcctacctggccggcaacctgcaccccatgatcgaggtggagttcctgctgagactgaccttctgcggcagccaccagatcaaccacttcttctgcgacgtgctgcccctgtacagactgagctgcatcaacccctacatcaacgagctggtgctgttcatcctggccggcagcatccagatcttcaccatcgtgctggtgagctacttctacatcctgttcaccatcttcaccatgaagagcaaggagggcagaggcaaggccctgagcacctgcgccagccacttcctgagcgtgagcatcttctgcgacagcctgctgttcatgtacgccagacccggcgccgtgaacgagggcgacaaggacatccccgtggccatcttctacaccctggtgatccccctgctgaaccccttcatctacagcctgagaaacaaggaggtgatcaacatcatgaagaagatcatgaagaagagaaagttctgccacatcctgaagcagatgagcagccccctggccacctag

SEQ ID NO: 22989 - DNA, 966 bp, Artificial Sequence
  Description of Artificial Sequence: Synthetic coding sequence
atggtgaacctgaccagcatgagcggcttcctgctgatgggcttcagcgacgagagaaagctgcagatcctgcacgccctggtgttcctggtgacctacctgctggccctgaccggcaacctgctgatcatcaccatcatcaccgtggacagaagactgcacagccccatgtactacttcctgaagcacctgagcctgctggacctgtgcttcatcagcgtgaccgtgccccagagcatcgccaacagcctgatgggcaacggctacatcagcctggtgcagtgcatcctgcaggtgttcttcttcatcgccctggccagcagcgaggtggccatcctgaccgtgatgagctacgacagatacgccgccatctgccagcccctgcactacgagaccatcatggaccccagagcctgcagacacgccgtgatcgccgtgtggatcgccggcggcctgagcggcctgatgcacgccgccatcaacttcagcatccccctgtgcggcaagagagtgatccaccagttcttctgcgacgtgccccagatgctgaagctggcctgcagctacgagttcatcaacgagatcgccctggccgccttcaccaccagcgccgccttcatctgcctgatcagcatcgtgctgagctacatcagaatcttcagcaccgtgctgagaatccccagcgccgagggcagaaccaaggtgttcagcacctgcctgccccacctgttcgtggccaccttcttcctgagcgccgccggcttcgagttcctgagactgcccagcgacagcagcagcaccgtggacctggtgttcagcgtgttctacaccgtgatcccccccaccctgaaccccgtgatctacagcctgagaaacgacagcatgaaggccgccctgagaaagatgctgagcaaggaggagctgccccagagaaagatgtgcctgaaggccatgttcaagctgtag

SEQ ID NO: 22990 - DNA, 966 bp, Artificial Sequence
  Description of Artificial Sequence: Synthetic coding sequence
atggagagaaagaaccagaccgccatcaccgagttcatcatcctgggcttcagcaacctgaacgagtggcagttcctgctgttcaccatcttcttcctgacctacttctgcaccctgggcggcaacatcctgatcatcctgaccaccgtgaccgacccccacctgcacacccccatgtactacttcctgggcaacctggccttcatcgacatctgctacaccaccagcaacgtgccccagatgatggtgcacctgctgagcaagaagaagagcatcagctacgtgggctgcgtggtgcagctgttcgccttcgtgttcttcgtgggcagcgagtgcctgctgctggccgccatggcctacgacagatacatcgccatctgcaaccccctgagatacagcgtgatcctgagcaaggtgctgtgcaaccagctggccgccagctgctgggccgccggcttcctgaacagcgtggtgcacaccgtgctgaccttctgcctgcccttctgcggcaacaaccagatcaactacttcttctgcgacatcccccccctgctgatcctgagctgcggcaacaccagcgtgaacgagctggccctgctgagcaccggcgtgttcatcggctggacccccttcctgtgcatcgtgctgagctacatctgcatcatcagcaccatcctgagaatccagagcagcgagggcagaagaaaggccttcagcacctgcgccagccacctggccatcgtgttcctgttctacggcagcgccatcttcacctacgtgagacccatcagcacctacagcctgaagaaggacagactggtgagcgtgctgtacagcgtggtgacccccatgctgaaccccatcatctacaccctgagaaacaaggacatcaaggaggccgtgaagaccatcggcagcaagtggcagccccccatcagcagcctggacagcaagctgacctactag

SEQ ID NO: 22991 - DNA, 966 bp, Artificial Sequence
  Description of Artificial Sequence: Synthetic coding sequence
atggagagaaagaaccagaccgccatcaccgagttcatcatcctgggcttcagcaacctgaacgagctgcagttcctgctgttcaccatcttcttcctgacctacttctgcaccctgggcggcaacatcctgatgatcctgaccaccgtgaccgacccccacctgcacacccccatgtactacttcctgggcaacctggccttcatcgacatctgctacaccaccagcaacgtgccccagatgatggtgcacctgctgagcaagaagaagagcatcagctacgtgggctgcgtggtgcagctgttcgccttcgtgttcttcgtgggcagcgagtgcctgctgctggccgccatggcctacgacagatacatcgccatctgcaaccccctgagatacagcgtgatcctgagcaaggtgctgtgcaaccagctggccgccagctgctgggccgccggcttcctgaacagcgtggtgcacaccgtgctgaccttctgcctgcccttctgcggcaacaaccagatcaactacttcttctgcgacatcccccccctgctgatcctgagctgcggcaacaccagcgtgaacgagctggccctgctgagcaccggcgtgttcatcggctggacccccttcctgtgcatcgtgctgagctacatctgcatcatcagcaccatcctgagaatccagagcagcgagggcagaagaaaggccttcagcacctgcgccagccacctggccatcgtgttcctgttctacggcagcgccatcttcacctacgtgagacccatcagcacctacagcctgaagaaggacagactggtgagcgtgctgtacagcgtggtgacccccatgctgaaccccatcatctacaccctgagaaacaaggacatcaaggaggccgtgaagaccatcggcagcaagtggcagccccccatcagcagcctggacagcaagctgacctactag

SEQ ID NO: 22992 - DNA, 966 bp, Artificial Sequence; identical to SEQ ID NO: 22991
  Description of Artificial Sequence: Synthetic coding sequence

SEQ ID NO: 22993 - DNA, 966 bp, Artificial Sequence; identical to SEQ ID NO: 22991
  Description of Artificial Sequence: Synthetic coding sequence

SEQ ID NO: 22994 - DNA, 939 bp, Artificial Sequence
  Description of Artificial Sequence: Synthetic coding sequence
atggagatcctgagcaacagcaccagcaagttccccaccttcctgctgaccggcatccccggcctggagagcgcccacgtgtggatcagcatccccttctgctgcttctacgccatcgccctgagcggcaacagcgtgatcctgttcgtgatcatcacccagcagagcctgcacgagcccatgtactacttcctgttcagactgagcgccaccgacctgggcctgaccgtgagcagcctgagcaccaccctgggcatcctgtggttcgaggccagagagatcagcctgtacagctgcatcgtgcagatgttcttcctgcacggcttcaccttcatggagagcggcgtgctggtggccaccgccttcgacagatacgtggccatctgcgaccccctgagatacaccaccatcctgaccaacagcagaatcatccagatgggcctgctgatgatcaccagagccatcgtgctgatcctgcccctgctgctgctgctgaagcccctgtacttctgcagaatgaacgccctgagccacagctactgctaccaccccgacgtgatccagctggcctgcagcgacatcagagccaacagcatctgcggcctgatcgacctgatcctgaccaccggcatcgacaccccctgcatcgtgctgagctacatcctgatcatccacagcgtgctgagaatcgccagccccgaggagtggcacaaggtgttcagcacctgcgtgagccacgtgggcgccgtggccttcttctacatccacatgctgagcctgagcctggtgtacagatacggcagaagcgcccccagagtggtgcacagcgtgatggccaacgtgtacctgctgctgccccccgtgctgaaccccatcatcgacagcgtgaagaccaagcagatcagaaaggccatgctgagcctgctgctgaccaagtag

SEQ ID NO: 22995 - DNA, 960 bp, Artificial Sequence
  Description of Artificial Sequence: Synthetic coding sequence
atgctgcagaaccaggacaccatggagatcctgagcaacagcaccagcaagttccccaccttcctgctgaccggcatccccggcctggagagcgcccacgtgtggatcagcatccccttctgctgcttctacgccatcgccctgagcggcaacagcgtgatcctgttcgtgatcatcacccagcagagcctgcacgagcccatgtactacttcctgttcagactgagcgccaccgacctgggcctgaccgtgagcagcctgagcaccaccctgggcatcctgtggttcgaggccagagagatcagcctgtacagctgcatcgtgcagatgttcttcctgcacggcttcaccttcatggagagcggcgtgctggtggccaccgccttcgacagatacgtggccatctgcgaccccctgagatacaccaccatcctgaccaacagcagaatcatccagatgggcctgctgatgatcaccagagccatcgtgctgatcctgcccctgctgctgctgctgaagcccctgtacttctgcagaatgaacgccctgagccacagctactgctaccaccccgacgtgatccagctggcctgcagcgacatcagagccaacagcatctgcggcctgatcgacctgatcctgaccaccggcatcgacaccccctgcatcgtgctgagctacatcctgatcatccacagcgtgctgagaatcgccagccccgaggagtggcacaaggtgttcagcacctgcgtgagccacgtgggcgccgtggccttcttctacatccacatgctgagcctgagcctggtgtacagatacggcagaagcgcccccagagtggtgcacagcgtgatggccaacgtgtacctgctgctgccccccgtgctgaaccccatcatcgacagcgtgaagaccaagcagatcagaaaggccatgctgagcctgctgctgaccaagtag

SEQ ID NO: 22996 - DNA, 981 bp, Artificial Sequence
  Description of Artificial Sequence: Synthetic coding sequence
atgagcgtgcagtacagcctgagcccccagttcatgctgctgagcaacatcacccagttcagccccatcttctacctgaccagcttccccggcctggagggcatcaagcactggatcttcatccccttcttcttcatgtacatggtggccatcagcggcaactgcttcatcctgatcatcatcaagaccaaccccagactgcacacccccatgtactacctgctgagcctgctggccctgaccgacctgggcctgtgcgtgagcaccctgcccaccaccatgggcatcttctggttcaacagccacagcatctacttcggcgcctgccagatccagatgttctgcatccacagcttcagcttcatggagagcagcgtgctgctgatgatgagcttcgacagactggtggccatctgccaccccctgagatacagcgtgatcatcaccggccagcaggtggtgagagccggcctgatcgtgatcttcagaggccccgtggccaccatccccatcgtgctgctgctgaaggccttcccctactgcggcagcgtggtgctgagccacagcttctgcctgcaccaggaggtgatccagctggcctgcaccgacatcaccttcaacaacctgtacggcctgatggtggtggtgttcaccgtgatgctggacctggtgctgatcgccctgagctacggcctgatcctgcacaccgtggccggcctggccagccaggaggagcagagaagagccttccagacctgcaccgcccccctgtgcgccgtgctggtgttcttcgtgcccatgatgggcctgagcctggtgcacagattcggcaagcacgccccccccgccatccacctgctgatggccaacgtgtacctgttcgtgccccccatgctgaaccccatcatctacagcatcaagaccaaggagatccacagagccatcatcaagttcctgggcctgaagaaggccagcaagtag

SEQ ID NO: 22997 - DNA, 945 bp, Artificial Sequence
  Description of Artificial Sequence: Synthetic coding sequence
atgaagaacaagagcatggagatcgagttcatcctgctgggcctgaccgacgacccccagctgcagatcgtgatcttcctgttcctgttcctgaactacaccctgagcctgatgggcaacctgatcatcatcatcctgaccctgctggaccccagactgaagacccccatgtacttcttcctgagaaacttcagcttcctggaggtgatcttcaccaccgtgtgcatccccagattcctgatcaccatcgtgaccagagacaagaccatcagctacaacaactgcgccacccagctgttcttcatcctgctgcccggcgtgaccgagttctacctgctggccgccatgagctacgacagatacgtggccatctgcaagcccctgcactaccccatcatcatgagcagcaaggtgtgctaccagctggtgctgagcagctgggtgaccggcttcctgatcatcttcccccccctggtgatgggcctgaagctggacttctgcgccagcaagaccatcgaccacttcatgtgcgagaccagccccatcctgcagatcagctgcaccgacacccacgtgctggagctgatgagcttcaccctggccgtggtgaccctggtggtgaccctggtgctggtgatcctgagctacacctgcatcatcaagaccatcctgaagttcagcagcgcccagcagagaaacaaggccttcagcacctgcaccagccacatgatcgtggtgagcatgacctacggcagctgcatcttcatgtacatcaagcccagcgccaaggagagagtgaccgtgagcaagggcgtggccctgctgtacaccagcatcgcccccctgctgaaccccttcatctacaccctgagaaaccagcaggtgaaggaggtgttctgggacgtgctgcagaagaacctgtgcttcagcaagagacccttctag

SEQ ID NO: 22998 - DNA, 939 bp, Artificial Sequence
  Description of Artificial Sequence: Synthetic coding sequence
atgaagaacagaaccagcgtgaccgacttcatcctgctgggcctgaccgacaacccccagctgcaggtggtgatcttcagcttcctgttcctgacctacgtgctgagcgtgaccggcaacctgaccatcatcagcctgaccctgctggacagccacctgaagacccccatgtacttcttcctgagaaacttcagcctggagatcagcttcaccagcgtgtgcaaccccagattcctgatcagcatcctgaccggcgacaagagcatcagctacaacgcctgcgccgcccagctgttcttcttcatcttcctgggcagcaccgagttcttcctgctggccagcatgagctacgactgctacgtggccatctgcaagcccctgcactacaccaccatcatgagcgacagaatctgctaccagctgatcatcagcagctggctggccggcttcctggtgatcttcccccccctggccatgggcctgcagctggacttctgcgacagcaacgtgatcgaccacttcacctgcgacagcgcccccctgctgcagatcagctgcaccgacaccagcaccctggagctgatgagcttcatcctggccctgttcaccctgatcagcaccctgatcctggtgatcctgagctacacctacatcatcagaaccatcctgagaatccccagcgcccagcagagaaagaaggccttcagcacctgcagcagccacgtgatcgtggtgagcatcagctacggcagctgcatcttcatgtacgtgaagaccagcgccaaggagggcgtggccctgaccaagggcgtggccatcctgaacaccagcgtggcccccatgctgaaccccttcatctacaccctgagaaaccagcaggtgaagcaggccttcaaggacgtgctgagaaagatcagccacaagaagaagaagcactag

SEQ ID NO: 22999 - DNA, 114 bp, Artificial Sequence
  Description of Artificial Sequence: Synthetic coding sequence
atgatcaccgacgtgcagctggccatcttcgccaacatgctgggcgtgagcctgttcctgctggtggtgctgtaccactacgtggccgtgaacaaccccaagaagcaggagtag

SEQ ID NO: 23000 - DNA, 330 bp, Artificial Sequence
  Description of Artificial Sequence: Synthetic coding sequence
atgagcatcaccgacgtgctgagcgccgacgacatcgccgccgccctgcaggagtgccaggaccccgacaccttcgagccccagaagttcttccagaccagcggcctgagcaagatgagcgccagccaggtgaaggacgtgttcagattcatcgacaacgaccagagcggctacctggacgaggaggagctgaagttcttcctgcagaagttcgagagcggcgccagagagctgaccgagagcgagaccaagagcctgatggccgccgccgacaacgacggcgacggcaagatcggcgccgaggagttccaggagatggtgcacagctag

SEQ ID NO: 23001 - DNA, 372 bp, Artificial Sequence
  Description of Artificial Sequence: Synthetic coding sequence
atgaagaccatcctgggcttcaagggcctgttctacctgcacagcctgatctggacctgcgccggcgactggagcgccatccaggtgcactgcacccagttctggttcttcgccagaatcaagcccaccatcttctacaacctgtacgtgaaccccgacgaggtgttcctgggcgacggctgccacgtgacccacgtgctgcccaacgtgtactacgagttcttctaccacccccacgactgcggcatcgtgacccagcccctgcaggaggtgctgctgctgaagaccaagatcagatacatcagcagagacagcaccgtgagaagcgagatgcccctgagctgcgtggtgcacaagcagaagtgccagtag

SEQ ID NO: 23002 - DNA, 1356 bp, Artificial Sequence
  Description of Artificial Sequence: Synthetic coding sequence
atgggcaacctgctgggcggcgtgagcttcagagagcccaccaccgtggaggactgcgacagcacctggcagaccgacagcgagcccgagcccgaggagcccggccccggcggcggcagcgagggccccggccaggagagcgagcagcccgcccagccccccgagcaggccggcggcagacccggcgccagccccgcccccgacgaggacgccgaggccgccggcgccgagcagggcggcgacagcaccgaggccaccgccaagcccaagagaagcttctacgccgccagagacctgtacaagtacagacaccagtaccccaacttcaaggacatcagataccagaacgacctgagcaacctgagattctacaagaacaagatccccttcaagcccgacggcgtgtacatcgaggaggtgctgagcaagtggaagggcgactacgagaagctggagcacaaccacacctacatccagtggctgttccccctgagagagcagggcctgaacttctacgccaaggagctgaccacctacgagatcgaggagttcaagaagaccaaggaggccatcagaagattcctgctggcctacaagatgatgctggagttcttcggcatcaagctgaccgacaagaccggcaacgtggccagagccgtgaactggcaggagagattccagcacctgaacgagagccagcacaactacctgagaatcaccagaatcctgaagagcctgggcgagctgggctacgagagcttcaagagccccctggtgaagttcatcctgcacgaggccctggtggagaacaccatccccaacatcaagcagagcgccctggagtacttcgtgtacaccatcagagacagaagagagagaagaaagctgctgagattcgcccagaagcactacacccccagcgagaacttcatctggggcccccccagaaaggagcagagcgagggcagcaaggcccagaagatgagcagccccctggccagcagccacaacagccagaccagcatgcacaagaaggccaaggacagcaagaacagcagcagcgccgtgcacctgaacagcaagaccgccgaggacaagaaggtggcccccaaggagcccgtggaggagaccgacagacccagccccgagcccagcaacgaggccgccaagcccagaaacaccgagaaggacagcaacgccgagaacatgaacagccagcccgagaagaccgtgaccacccccaccgagaagaaggagagcgtgagccccgagaacaacgaggagggcggcaacgacaaccaggacaacgagaaccccggcaacaccaactgccacgacgtggtgctggtgcagtag

SEQ ID NO: 23003 - DNA, 570 bp, Artificial Sequence
  Description of Artificial Sequence: Synthetic coding sequence
atgatcaacacccaggacagcagcatcctgcccctgagcaactgcccccagctgcagtgctgcagacacatcgtgcccggccccctgtggtgcagcgacgccccccaccccctgagcaagatccccggcggcagaggcggcggcagagaccccagcctgagcgccctgatctacaaggacgagaagctgaccgtgacccaggacctgcccgtgaacgacggcaagccccacatcgtgcacttccagtacgaggtgaccgaggtgaaggtgagcagctgggacgccgtgctgagcagccagagcctgttcgtggagatccccgacggcctgctggccgacggcagcaaggagggcctgctggccctgctggagttcgccgaggagaagatgaaggtgaactacgtgttcatctgcttcagaaagggcagagaggacagagcccccctgctgaagaccttcagcttcctgggcttcgagatcgtgagacccggccacccctgcgtgcccagcagacccgacgtgatgttcatggtgtaccccctggaccagaacctgagcgacgaggactag

SEQ ID NO: 23004 - DNA, 7035 bp, Artificial Sequence
  Description of Artificial Sequence: Synthetic coding sequence
atgatcccctggagcatcttcctgctgcacgtgctgctgttcagcctgcaggagtacatctgcgccagcagcatcctgatgggcaccagcaagaacggcttcaacgagaacagacagaagagagccctgctggccgcccagttcgaggccaccagccccagatacttcttccacgacgccatcaactggggcgagagcaagatcaagggcagctgcccctacgagtgcctgaacggcgccttctgcagcaagaccggcacctgcgactgccagatcttccaggccctgggcaccagatgccagatcatccccaacatgggcaacggcagagacggcatctgcaagacctggggccagtaccacttcgagaccttcgacggcatctactactacttccccggcaactgcagctacatcttcgccaaggactgcggcgacctggagcccagatacaccgtgtgggtgcacaacagccccaagtgcctgggcagcgtgtacagctgctacagaagcatcagcctgttcttcagcaaccaggaggagatcagaatctacggccacgagatcaagaagaacggcatcagcctgaccctgccccagaccatcggccagatcttcatcgagaagctggccgactacatcctggtgaagaccaccttcggcttcagcctggcctgggacggcatcagcggcatctacctgaagctgagcgaggaccacaagggcaagagctgcggcctgtgcggcaactacaacgacatccagagcgacgacttcatcatcctgcaggaggactacaccgaggacatcgccatgttcgccaacagctggagcgtgcagacccccgacgacaccaagtgcgtgctgacccccagcgacttccccaacccctgcagcagcggcatgcccgccttcgaggccatcttcttcaagtgccagatcctgctgcagttccccttcctgagctgccacgagtacatcgacccctacctgtacatcgccagctgcgtgaacgacctgtgcaagaccgacgacgacgagacctactgcagagccgccaccgagtacgccagagcctgcagccacgccggctaccccatccaggactggagagacgacttccccgcctgcaccgacaagtgcgacgacagcttcgtgcacagagactgcatcagctgctgcccccccacctgcaccttcgagaagcagtgcctgggcagcaacctgcactgcctggacggctgctactgccccgacggcctggtgatggacaacggcacctgcatcagcctggagaactgcccctgcggcttccacggcctggcctacagcgtgggcagcaagatcgagcaggagtgcaccgagtgcgtgtgcgtgggcggcgtgtggaactgcaccgagcaggactgccccgtgcagtgcagcgtggtgggcgacagccacttcaccaccttcgacggcagacactacagcttcatcggcatgtgccagtacatcctggtgaagggcaccggcaaggacaagttcaccatcaccctgcagaaggccccctgcgagcagaacctgggcctggtgtgcctgcagagcatcaccctgatcctggaggacgacttcaacaagcaggtgaccctgggcagaggcggccagatcctgaccagccccaaccagggcttcaacctgaacggcatcgtggagatccagaccctgagcagcctgttcatcctgctgaagaccaccttcggcctgaagatcctgttcgccatcgacggcgagagaatctacatccagctgaccagcgcctggaagagaagaaccctgggcctgtgcggcaccttcaacggcaacatcagagacgacttcctgagccccagcggcatgatcgagggcaccccccagctgcacgccaacgcctggagagtgagcagcacctgcttcgcccccgtgcacgtgcccgtggtggacccctgcaacatcaaccagcagaacatcggctacgccgcccactgcgacgtgatccaccaggagctgttcgccccctgccacatctacatcagccccggcctgtactaccagctgtgcagacacgacgcctgcaagtgcggcagcagctgcctgtgcaacgccctggcccactacgcctacctgtgcggccagcacggcgtgcccatcgacttcagaacccagatcagcttctgcgccgtggtgtgccagaagggcatgctgtaccaccactgcagcagcttctgcctgcacagctgcatcagcctgagcagccccgagcagtgcagcgacgactgcgccgagggctgcaactgccccgagggcaagttctacgaggacaccctgaacttctgcgtgcccatcttccactgcagatgccactacagaggcagcgtgtaccagcccggcgagctgatccccacccccagcggcctgtgccagtgcagcaacggcaccgtgaagtgcgacgagctggccacccccagcgccgtgcacatctgccccgagggcaaggagtacttcgactgcagattccccgaccccgagctgcccgccggcggcgtgaactgcgagaccacctgcgccaacctggccatgaacttcacctgcacccccagcagcccctgcatcagcggctgcgtgtgcgcccccggcatggccgagcacagaggcaagtgctacgtgcccgagagctgcccctgcatctggaaggactgggagtacctgagcggcgaggtgatcgccaccccctgctacacctgcgtgtgcagaagaggcatgttcaactgcacctactacccctgccccgccgtgtgcaccatctacggcgacagacactactacagcttcgacggcctggagtacgactacatcagcgactgccaggtgttcctgatcaagagcgccgacgacagcgacatcagcgtgatcgcccagaacaagaagtgcttcgacaacgacatcgtgtgcagcaagagcgtgctgatcagcgtgggcgacaccgagatctacctgaacgacaccccctacaagcagaagcagagcggcttcttcctggagaacaagagcacctaccagctgtggaaggccggctactacatcgtggtgtacttccccgagaaggacatcaccatcctgtgggacagaaagaccaccatccacatcaaggtgggcccccagtggaagaacaagctgagcggcctgtgcggcaacttcgacaagtgcaccagcaacgacatgaccaccagcaacaacctggaggtgagaaacgccagagtgttcggcgacagctgggccctgggccagtgcgagagccccgacgagaccatcaagccctgcgaggcccaccagaacaagttcccctacgccaagaaggagtgcagcatcctgtacagcgacatcttcgccagctgcagaaacgtgatcgacgtgaccagcttcgccaagaactgccacgaggacacctgcaactgcaacctgggcggcgactgcgagtgcctgtgcaccagcatcgccgcctacgcctacaagtgctgccaggagggcatcagcatccactggagaagcagcaccgtgtgcagcctggactgcgagtactacaacgagggcctgggcgagggcccctacatgctggccagctacggccagagcggcctggtgctgggcgccaacatgaccagcagaagcgtgttctgcctgcccagaagcagcgtgcacaccagcctgttcttctacttcatgatcacccccggcctgttcaaggagaaggtgagcagcctggccctggtgagcctggagagcgccgagagacccaactacttcctgtacgtgcacgacaacgacaccctgagcctggagctgtgggaggccaacagcgccttccacagaagagccaccttcttccaccaccagggcctgtggatccccggctacagcgccttcgagctgtacagcaagaagggcttcttcatcatcttcaccgacagcagcgtgaaggccagcaagtacgacgacagcgaggagttcaagcacagcagcagcttcagcatcgaggagatccaggccgccgtgccctacagaaagatgtgcgagtggagatacgagccctgcgccaccccctgcttcaagacctgcagcgaccccgaggccctggcctgcaagttcctgccccccgtggagggctgcctgccctactgccccaagaacatgatcctggacgaggtgaccctgaagtgcgtgtaccccagagactgcatccccgtgatccccaccgagcccaccctgatgccccccgccaagcccaccgtgcccatgttcaccgtgtgggagatgatcacccccagcgacatcaccgtgttcgacatgctgacccccaccaccggcctggagtgcgagccccagaagttcgaccccgtgtacgactgcagccagtacatctgcctgaacatggagtggcagctgtacaactggagcctgaactgccccaaggacgtggagatgcccgactgcggcttcagaggcagacccgtgcaggtgaacagcgacatctgctgccccgagtgggagtgcccctgcagatgcagcatgctgagcgagctgagcatcatcaccttcgacggcaacaacgccgccctgtacagcatggccagctacatcctggtgagaatccccggcgagatcatcgtggcccacatcgagaagtgcagcatgaaccagaacggcaacagcctgaagaagctggcccccagcggcagaatcagcggcctgtgcttcaagaagctgaacgtgaccacccccatccacaagatcatcgtgaacagactggccagaaaggtggaggtggacagcatcgtggtgcccctgcccttcagcagccaggagctgagcatcgaggacagcggcagcatgtacgtgatcaccacccccgccggcctgatcatcaagtggagccacctgaccggcatcatcgacatccacttcggcttcagattcaacctgagcagctacaccgagggcctgtgcggcatctgcaacgaggaccccgacgacgacctgagaatgcagaacggcaccatcatcaccaacatggaggacatcggcctgttcatcgagagctgggagatcgagaagagcttcgaggtgaccatgagaagacccgtgagaaactgcaccgagcacgactgcagccagtgcatcgacctgctgaacagaagaatcttcatcccctgccacgacaaggtgagccccgaggacttctgcgagaagatgtggatcaactacacctacttctggaactacgagtgcgacgccctgagcgcctacgtggccctgtgcaacaagttcgacatctgcatccagtggagaacccccgactactgcagcctgagctgccccgagggcaaggagtaccagccctgcgtgagaccctgcgaggccagaacctgcctgaaccagtggttctacggccacaccagctgcctgaacctgagagaggactgcgtgtgcaaggtgggcaccatcctgcacagaccccacagcgcccagtgcatccccgagaaggagtgcgcctgcaccgacagcgaggaccagcccagaaccgccggcgagatctggaacggcggcatcgacgagtgcaccctgtacaagtgcctggagaacggcagcatcatccccatcgagcccgactgcgacgaggagcccacccccgtgtgcgagagagaggccgaggtggtgatgggcatcatcgacaagtggacctgctgcagcaaggaggtgtgcggctgcgacaccaccctgtgcgagaccagcatccccacctgcaccaacagccagaagctgatcgtgggccacagccccctgagctgctgcccccagtacaagtgcgagtgcgaccccctgaagtgccccagcatcagcacccccgagtgcagagaggaccagttcatgatccaggtgagacaggaggagccctgctgcttcagccccttctgcgtgtgcgagagctgcaccaagcccgtgcccctgtgccacgacggcgagttcctgaccgtggacctgaacagcacccacttctgctgcccccagtactactgcgtgtgcgagcccaacctgtgccccatgcccctgctgaactgcgccgaggacatgaacctggtgaaggagaacgtgagcggccagtgctgccccacctggcactgcgagtgcaactgcgagaacctgatcatgcccacctgcgaggtgggcgagttcaccgccatcgaccacaacttccagagcgactgcggctgcatccagtacctgtgcgagaaggacgacgtgtgcgtgttccaggaggtgagcgtgctgaaccccggccagagcatgatcaagtacctggaggaggacttctgctacgccatcgagtgcctggaggagaaggacaaccacaccggcttccacaccctgaacttcaccctggtgaactgcagcaagaagtgcgacgtgcaccaggtgtacacccccagccccagcgactacggctgctgcggcacctgcaagaacgtgagctgcaagttccacatggagaacggcaccagcgtggtgtacgccgtgggcagcacctggcactacaactgcaccacctacgagtgcgtgaagaccgacgagggcgccatcatcctgaactacaccatggtgtgcccccccttcaacgagaccgagtgcaagatgaacgagggcatcgtgaagctgtacaacgagggctgctgcaagatctgcaagagagaggagagaatctgccagaaggtgatcatcaagagcgtgatcagaaagcaggactgcatgagccagagccccatcaacgtggccagctgcgacggcaagtgccccagcgccaccatctacaacatcaacatcgagagccacctgagattctgcaagtgctgcagagagaacggcgtgagaaacctgagcgtgcccctgtactgcagcggcaacggcaccgagatcatgtacaccctgcaggagcccatcgactgcacctgccagtggaactag

SEQ ID NO: 23005 - DNA, 1434 bp, Artificial Sequence
  Description of Artificial Sequence: Synthetic coding sequence
atgtggatgttcagctggctgtgcgccatcctgatcatcctggccatcgccggcatgaacaccatcgccaagaccaccccccacaccaagttcaccaagaagagcgaggagagagagatgcccaagggcctgaagcccagcagcggccccccccccgaggaggaggagaccctgttcaccgagatggccgagatggccgagcccatcaccaagcccagcgccctggacagcgtgttcggcaccgccaccctgagccccttcgagaacttcaccctggaccccgccgacttcttcctgaactgctgcgactgctgcagccccgtgcccggccagaagggcgagcccggcgagaccggccagcccggccccaagggcgaggccggcaacctgggcatccccggcccccccggcgtggtgggcccccagggccccagaggctacaagggcgagaagggcctgaagggcgagagaggcgaccagggcgtgcccggctaccccggcaagcccggcgcccagggcgagcccggccccaagggcgacaagggcaacatcggcctgggcggcgtgaagggccagaagggcagcaagggcgacacctgcggcaactgcaccaagggcgagaagggcgaccagggcgccatgggcagccccggcctgcacggcggccccggcgccaagggcgagaagggcgagatgggcgagaagggcgagatgggcgacaagggctgctgcggcgacagcggcgagagaggcggcaagggccagaagggcgagggcggcatgaagggcgagaagggcagcaagggcgacagcggcatggagggcaagagcggcagaaacggcctgcccggcgccaagggcgaccccggcatcaagggcgagaagggcgagctgggcccccccggcctgctgggccccaccggccccaagggcgacatcggcaacaagggcgtgagaggccccaccggcaagaagggcagcagaggcttcaagggcagcaagggcgagctggccagagtgcccagaagcgccttcagcgccggcctgagcaagcccttccccccccccaacatccccatcaagttcgagaagatcctgtacaacgaccagggcaactacagccccgtgaccggcaagttcaactgcagcatccccggcacctacgtgttcagctaccacatcaccgtgagaggcagacccgccagaatcagcctggtggcccagaacaagaagcagttcaagagcagagagaccctgtacggccaggagatcgaccaggccagcctgctggtgatcctgaagctgagcgccggcgaccaggtgtggctggaggtgagcaaggactggaacggcgtgtacgtgagcgccgaggacgacagcatcttcaccggcttcctgctgtaccccgaggagaccagcggcatcagcccctag

SEQ ID NO: 23006 - DNA, 1716 bp, Artificial Sequence
  Description of Artificial Sequence: Synthetic coding sequence
atgaccatcctgcccaagaagaagccccccccccccgacgccgaccccgccaacgagccccccccccccggccccatgccccccgcccccagaagaggcggcggcgtgggcgtgggcggcggcggcaccggcgtgggcggcggcgacagagacagagacagcggcgtggtgggcgccagacccagagccagcccccccccccagggccccctgcccggcccccccggcgccctgcacagatgggccctggccgtgccccccggcgccgtggccggccccagaccccagcaggccagcccccccccctgcggcggccccggcggccccggcggcggccccggcgacgccctgggcgccgccgccgccggcgtgggcgccgccggcgtggtggtgggcgtgggcggcgccgtgggcgtgggcggctgctgcagcggccccggccacagcaagagaagaagacaggcccccggcgtgggcgccgtgggcggcggcagccccgagagagaggaggtgggcgccggctacaacagcgaggacgagtacgaggccgccgccgccagaatcgaggccatggaccccgccaccgtggagcagcaggagcactggttcgagaaggccctgagagacaagaagggcttcatcatcaagcagatgaaggaggacggcgcctgcctgttcagagccgtggccgaccaggtgtacggcgaccaggacatgcacgaggtggtgagaaagcactgcatggactacctgatgaagaacgccgactacttcagcaactacgtgaccgaggacttcaccacctacatcaacagaaagagaaagaacaactgccacggcaaccacatcgagatgcaggccatggccgagatgtacaacagacccgtggaggtgtaccagtacagcaccggcaccagcgccgtggagcccatcaacaccttccacggcatccaccagaacgaggacgagcccatcagagtgagctaccacagaaacatccactacaacagcgtggtgaaccccaacaaggccaccatcggcgtgggcctgggcctgcccagcttcaagcccggcttcgccgagcagagcctgatgaagaacgccatcaagaccagcgaggagagctggatcgagcagcagatgctggaggacaagaagagagccaccgactgggaggccaccaacgaggccatcgaggagcaggtggccagagagagctacctgcagtggctgagagaccaggagaagcaggccagacaggtgagaggccccagccagcccagaaaggccagcgccacctgcagcagcgccaccgccgccgccagcagcggcctggaggagtggaccagcagaagccccagacagagaagcagcgccagcagccccgagcaccccgagctgcacgccgagctgggcatgaagccccccagccccggcaccgtgctggccctggccaagccccccagcccctgcgcccccggcaccagcagccagttcagcgccggcgccgacagagccaccagccccctggtgagcctgtaccccgccctggagtgcagagccctgatccagcagatgagccccagcgccttcggcctgaacgactgggacgacgacgagatcctggccagcgtgctggccgtgagccagcaggagtacctggacagcatgaagaagaacaaggtgcacagagaccccccccccgacaagagctag

SEQ ID NO: 23007 - DNA, 1701 bp, Artificial Sequence
  Description of Artificial Sequence: Synthetic coding sequence
atgaccatcctgcccaagaagaagccccccccccccgacgccgaccccgccaacgagccccccccccccggccccatgccccccgcccccagaagaggcggcggcgtgggcgtgggcggcggcggcaccggcgtgggcggcggcgacagagacagagacagcggcgtggtgggcgccagacccagagccagcccccccccccagggccccctgcccggcccccccggcgccctgcacagatgggccctggccgtgccccccggcgccgtggccggccccagaccccagcaggccagcccccccccctgcggcggccccggcggccccggcggcggccccggcgacgccctgggcgccgccgccgccggcgtgggcgccgccggcgtggtggtgggcgtgggcggcgccgtgggcgtgggcggctgctgcagcggccccggccacagcaagagaagaagacaggcccccggcgtgggcgccgtgggcggcggcagccccgagagagaggaggtgggcgccggctacaacagcgaggacgagtacgaggccgccgccgccagaatcgaggccatggaccccgccaccgtggagcagcaggagcactggttcgagaaggccctgagagacaagaagggcttcatcatcaagcagatgaaggaggacggcgcctgcctgttcagagccgtggccgaccaggtgtacggcgaccaggacatgcacgaggtggtgagaaagcactgcatggactacctgatgaagaacgccgactacttcagcaactacgtgaccgaggacttcaccacctacatcaacagaaagagaaagaacaactgccacggcaaccacatcgagatgcaggccatggccgagatgtacaacagacccgtggaggtgtaccagtacagcaccgagcccatcaacaccttccacggcatccaccagaacgaggacgagcccatcagagtgagctaccacagaaacatccactacaacagcgtggtgaaccccaacaaggccaccatcggcgtgggcctgggcctgcccagcttcaagcccggcttcgccgagcagagcctgatgaagaacgccatcaagaccagcgaggagagctggatcgagcagcagatgctggaggacaagaagagagccaccgactgggaggccaccaacgaggccatcgaggagcaggtggccagagagagctacctgcagtggctgagagaccaggagaagcaggccagacaggtgagaggccccagccagcccagaaaggccagcgccacctgcagcagcgccaccgccgccgccagcagcggcctggaggagtggaccagcagaagccccagacagagaagcagcgccagcagccccgagcaccccgagctgcacgccgagctgggcatgaagccccccagccccggcaccgtgctggccctggccaagccccccagcccctgcgcccccggcaccagcagccagttcagcgccggcgccgacagagccaccagccccctggtgagcctgtaccccgccctggagtgcagagccctgatccagcagatgagccccagcgccttcggcctgaacgactgggacgacgacgagatcctggccagcgtgctggccgtgagccagcaggagtacctggacagcatgaagaagaacaaggtgcacagagaccccccccccgacaagagctag

SEQ ID NO: 23008 - DNA, 762 bp, Artificial Sequence
  Description of Artificial Sequence: Synthetic coding sequence
atgggcagcgacgcctgggtgggcctgtggagaccccacagacccagaggccccatcgccgcccactacggcggccccggccccaagtacaagctgccccccaacaccggctacgccctgcacgaccccagcagacccagagcccccgccttcaccttcggcgccagattccccacccagcagaccacctgcggccccggccccggccacctggtgcccgccagaatgaccgtgagaggcaccgacggcgcccccgcctacagcatctacggcagacccagaagaagcgcccccttcctgacccccggccccggcagatacttccccgagagagccggcaacgccacctaccccagcgcccccagacacaccatcgcccccagaaactggggcgtgcaggccgagcagcagagccccggccccgccgcctacaccgtgcccagcctgctgggccccagagtgatcggcaaggtgagcgcccccacctgcagcatctacggcagaagagccgccggcagcttcttcgaggacctgagcaagacccccggcccctgcgcctaccaggtggtgagccccggcgtgtacaagagcagagccccccagttcaccatcctggccagaaccagcctgccccaggacaacaccagaaagcccggccccgccgcctacaacgtggaccagcacagaaagcccagaggctggagcttcggcatcagacacagcgactacctggcccccctggtgaccgacgccgacaactag

SEQ ID NO: 23009 - DNA, 762 bp, Artificial Sequence; identical to SEQ ID NO: 23008
  Description of Artificial Sequence: Synthetic coding sequence

SEQ ID NO: 23010 - DNA, 465 bp, Artificial Sequence
  Description of Artificial Sequence: Synthetic coding sequence
atgctgcccggctacgccctgcaccccgtggccgccgccagacccagactgcacctgagaagagccctgccccacgccgccgacgacgtgagacccagagccagaccccccggcgccagaagccacgacagagccagacacagaagaagacccagactgctgcacctgagaccccccacccccctgagcgccctgccccacagcggcacctggagcggcccccccggcccctggcccccccagagaagaaccgccagcagagaggcccacctgggcacccccgacctgaaccccgagagccccagcgacaccctgacctacagcgtgcccccctaccccgacctgaagagccagaccccccccagaggcttcgacaagagctggctgagactgcccaccagccccagaacccccagcagagtgcccaccagactgcccagaagcagcagccccccccacccctag

SEQ ID NO: 23011 - DNA, 825 bp, Artificial Sequence
  Description of Artificial Sequence: Synthetic coding sequence
atgaagctgcccaagggcaccagaagcagcgtgtacttcgcccagcaccccgagaaggagcccctgcccagcagacaggaggtgaagcagacccccgtgatcatggccaagatcaagggccccggccccgccaagtacctgagacccagctgcaccggctacatcgaccacgacatcagcatgttcaaggcccccgcctacaccctgcacagcagacacagcgagaagagaatggtgtgccacagcagccccggcccctgctacctgctggaccccaagatcaccagattcggcatgagcagctgcccccaggtgcccatggaggagagaatcagcaacctgagactgaaccccaccctggccagctgccagtactacttcgagaagatccacccccccggcgagagaagagccccccagtacaccttcggctacagaagaccctacagagtgatggacctgaaccccgcccccaaccagtaccagatgcccctgctgctgggccccaacacccccgtgagcagagccgccccctgctacagcctggccagcagagacaagaactggttctacaaggaggacgtggccggcggccccggccccaccacctacgccagacccgagcccagcatctaccagaacagaagccccacctacagcatggccaagagattcgcctaccccctggacctgacccccagacccggccccggcagccacgaggtgcagcaggtgaccgtgcacaagccccacatccccgccttcaccatgggcatcaagcacagcctgcacctgtgccccctggtgatcgacatcagagactag

SEQ ID NO: 23012 - DNA, 870 bp, Artificial Sequence
  Description of Artificial Sequence: Synthetic coding sequence
atgggcaccctgagctgcgacagcacccccagactggccaccgcccccctgggcagaagagtgaccgagggccagatccccgagaccggcctgagaaagagctgcggcaccgccaccctggagaacggcagcggccccggcctgtacgtgctgcccagcaccgtgggcttcatcaaccacgactgcaccagagtggccagccccgcctacagcctggtgagaagacccagcgaggcccccccccaggacaccagccccggccccatctacttcctggaccccaaggtgaccagattcggcagaagctgcacccccgcctacagcatgcagggcagagccaagagcagaggccccgaggtgacccccggccccggcgcctacagccccgagaaggtgccccccgtgagacacagaaccccccccgccttcaccctgggctgcagactgcccctgaagcccctggacaccagcgcccccgcccccaacgcctacaccatgccccccctgtggggcagccagatcttcaccaagcccagcagccccagctacaccgtggtgggcagaaccccccccgccagacccccccaggaccccgccgagatccccggccccggccagtacgacagccccgacgccaacacctacagacagagactgcccgccttcaccatgctgggcagacccagagcccccagacccctggaggagacccccggccccggcgcccactgccccgagcaggtgaccgtgaacaaggccagagcccccgccttcagcatgggcatcagacacagcaagagagccagcaccatggccgccaccacccccagcagacccgccggccacagactgcccggcagatgctgctag

SEQ ID NO: 23013 - DNA, 762 bp, Artificial Sequence
  Description of Artificial Sequence: Synthetic coding sequence
atgggcaccctgagctgcgacagcacccccagactggccaccgcccccctgggcagaagagtgaccgagggccagatccccgagaccggcctgagaaagagctgcggcaccgccaccctggagaacgcccccccccaggacaccagccccggccccatctacttcctggaccccaaggtgaccagattcggcagaagctgcacccccgcctacagcatgcagggcagagccaagagcagaggccccgaggtgacccccggccccggcgcctacagccccgagaaggtgccccccgtgagacacagaaccccccccgccttcaccctgggctgcagactgcccctgaagcccctggacaccagcgcccccgcccccaacgcctacaccatgccccccctgtggggcagccagatcttcaccaagcccagcagccccagctacaccgtggtgggcagaaccccccccgccagacccccccaggaccccgccgagatccccggccccggccagtacgacagccccgacgccaacacctacagacagagactgcccgccttcaccatgctgggcagacccagagcccccagacccctggaggagacccccggccccggcgcccactgccccgagcaggtgaccgtgaacaaggccagagcccccgccttcagcatgggcatcagacacagcaagagagccagcaccatggccgccaccacccccagcagacccgccggccacagactgcccggcagatgctgctag

SEQ ID NO: 23014 - DNA, 3405 bp, Artificial Sequence
  Description of Artificial Sequence: Synthetic coding sequence
atgggcctgctggccagcgccggcctgctgctgctgctggtgatcggccaccccagaagcctgggcctgaagtgcggcatcagaatggtgaacatgaagagcaaggagcccgccgtgggcagcagattcttcagcagaatcagcagctggagaaacagcaccgtgaccggccacccctggcaggtgagcctgaagagcgacgagcaccacttctgcggcggcagcctgatccaggaggacagagtggtgaccgccgcccactgcctggacagcctgagcgagaagcagctgaagaacatcaccgtgaccagcggcgagtacagcctgttccagaaggacaagcaggagcagaacatccccgtgagcaagatcatcacccaccccgagtacaacagcagagagtacatgagccccgacatcgccctgctgtacctgaagcacaaggtgaagttcggcaacgccgtgcagcccatctgcctgcccgacagcgacgacaaggtggagcccggcatcctgtgcctgagcagcggctggggcaagatcagcaagaccagcgagtacagcaacgtgctgcaggagatggagctgcccatcatggacgacagagcctgcaacaccgtgctgaagagcatgaacctgccccccctgggcagaaccatgctgtgcgccggcttccccgactggggcatggacgcctgccagggcgacagcggcggccccctggtgtgcagaagaggcggcggcatctggatcctggccggcatcaccagctgggtggccggctgcgccggcggcagcgtgcccgtgagaaacaaccacgtgaaggccagcctgggcatcttcagcaaggtgagcgagctgatggacttcatcacccagaacctgttcaccggcctggacagaggccagcccctgagcaaggtgggcagcagatacatcaccaaggccctgagcagcgtgcaggaggtgaacggcagccagagaggcaagggcatcctggacatggagaagcaggtgggctgcgaccacgactacgtgagcctgagaagcagcagcggcgtgctgttcaaccagagaagcctgatggaggacgacggcaagcagaacaagagagtgtgcggcaagatcctgcccagccccctgctggccgagaccagcgaggccatggtgcccttcgtgagcgacaccgaggacagcggcagcggcttcgagctgaccgtgaccgccgtgcagaagagcgaggccggcagcggctgcggcagcctggccatcctggtggaggagggcaccaaccacagcgccaagtaccccgacctgtaccccagcaacaccagatgccactggttcatctgcgcccccgagaagcacatcatcaagctgaccttcgaggacttcgccgtgaagttcagccccaactgcatctacgacgccgtggtgatctacggcgacagcgaggagaagcacaagctggccaagctgtgcggcatgctgaccatcaccagcatcttcagcagcagcaacatgaccgtgatctacttcaagagcgacggcaagaacagactgcagggcttcaaggccagattcaccatcctgcccagcgagagcctgaacaagttcgagcccaagctgcccccccagaacaaccccgtgagcaccgtgaaggccatcctgcacgacgtgtgcggcatcccccccttcagcccccagtggctgagcagaagaatcgccggcggcgaggaggcctgcccccactgctggccctggcaggtgggcctgagattcctgggcgactaccagtgcggcggcgccatcatcaaccccgtgtggatcctgaccgccgcccactgcgtgcagctgaagaacaaccccctgagctggaccatcatcgccggcgaccacgacagaaacctgaaggagagcaccgagcaggtgagaagagccaagcacatcatcgtgcacgaggacttcaacaccctgagctacgacagcgacatcgccctgatccagctgagcagccccctggagtacaacagcgtggtgagacccgtgtgcctgccccacagcgccgagcccctgttcagcagcgagatctgcgccgtgaccggctggggcagcatcagcgccgacggcggcctggccagcagactgcagcagatccaggtgcacgtgctggagagagaggtgtgcgagcacacctactacagcgcccaccccggcggcatcaccgagaagatgatctgcgccggcttcgccgccagcggcgagaaggacttctgccagggcgacagcggcggccccctggtgtgcagacacgagaacggccccttcgtgctgtacggcatcgtgagctggggcgccggctgcgtgcagccctggaagcccggcgtgttcgccagagtgatgatcttcctggactggatccagagcaagatcaacggccccgccagcctgcagaccaacaacaagtgcaagaccctgaagcagcagctgcccccccccacccccagccccgacagcgccagctggcccggctgctgcagcgaggccgagctggagaagcccagaggcttcttccccacccccagatacctgctggactacagaggcagactggagtgcagctgggtgctgagagtgagcgccagcagcatggccaagttcaccatcgagtacctgagcctgctgggcagccccgtgtgccaggacagcgtgctgatcatctacgaggagagacacagcaagagaaagaccgccggcggcctgcacggcagaagactgtacagcatgaccttcatgagccccggccccctggtgagagtgaccttccacgccctggtgagaggcgccttcggcatcagctacatcgtgctgaaggtgctgggccccaaggacagcaagatcaccagactgagccagagcagcaacagagagcacctggtgccctgcgaggacgtgctgctgaccaagcccgagggcatcatgcagatccccagaaacagccacagaaccaccatgggctgccagtggagactggtggcccccctgaaccacatcatccagctgaacatcatcaacttccccatgaagcccaccaccttcgtgtgccacggccacctgagagtgtacgagggcttcggccccggcaagaagctgatcgccagcttcgccggcaccctggccatgatcctgaccaaggacatcctgaagagagagaagctgaacttcatcaacacctacatcatgcacatctgggagaacagcgtgtacgacaacgtgagaagcgtgggcaagagaaagcagaagaagttcgccagcaacctgagctacagcatggaggccgagaagagcagaatccaggtgcccgccgacctggtgcccgccaagggcagcctgagcggcagctag

SEQ ID NO: 23015 - DNA, 1695 bp, Artificial Sequence
  Description of Artificial Sequence: Synthetic coding sequence
atgctgatcagcagaaacaagctgatcctgctgctgggcatcgtgttcttcgagagaggcaagagcgccaccctgagcctgcccaaggcccccagctgcggccagagcctggtgaaggtgcagccctggaactacttcaacatcttcagcagaatcctgggcggcagccaggtggagaagggcagctacccctggcaggtgagcctgaagcagagacagaagcacatctgcggcggcagcatcgtgagcccccagtgggtgatcaccgccgcccactgcatcgccaacagaaacatcgtgagcaccctgaacgtgaccgccggcgagtacgacctgagccagaccgaccccggcgagcagaccctgaccatcgagaccgtgatcatccacccccacttcagcaccaagaagcccatggactacgacatcgccctgctgaagatggccggcgccttccagttcggccacttcgtgggccccatctgcctgcccgagctgagagagcagttcgaggccggcttcatctgcaccaccgccggctggggcagactgaccgagggcggcgtgctgagccaggtgctgcaggaggtgaacctgcccatcctgacctgggaggagtgcgtggccgccctgctgaccctgaagagacccatcagcggcaagaccttcctgtgcaccggcttccccgacggcggcagagacgcctgccagggcgacagcggcggcagcctgatgtgcagaaacaagaagggcgcctggaccctggccggcgtgaccagctggggcctgggctgcggcagaggctggagaaacaacgtgagaaagagcgaccagggcagccccggcatcttcaccgacatcagcaaggtgctgccctggatccacgagcacatccagaccggcaacagaagaaagagcagcagagcctggtgcagcgagcaggacgtgatcgtgagcggcgccgagggcaagctgcacttccccgagagcctgcacctgtactacgagagcaagcagagatgcgtgtggaccctgctggtgcccgaggagatgcacgtgctgctgagcttcagccacctggacgtggagagctgccaccacagctacctgagcatgtacagcctggaggacagacccatcggcaagttctgcggcgagagcctgcccagcagcatcctgatcggcagcaacagcctgagactgaagttcgtgagcgacgccaccgacaacgccgccggcttcaacctgacctacaaggccctgaagcccaactacatccccgacagcggctgcagctacctgaccgtgctgttcgaggagggcctgatccagagcctgaactaccccgagaactacagcgacaaggccaactgcgactggatcttccaggccagcaagcaccacctgatcaagctgagcttccagagcctggagatcgaggagagcggcgactgcaccagcgactacgtgaccgtgcacagcgacgtggagagaaagaaggagatcgccagactgtgcggctacgacgtgcccacccccgtgctgagccccagcagcatcatgctgatcagcttccagagcgacgagaacggcacctgcagaggcttccaggccaccgtgagcttcatccccaaggccggcaagaagatcgagctgcccaccctgtggttccccgtgctgatcctggtgatgtag

SEQ ID NO: 23016 - DNA, 756 bp, Artificial Sequence
  Description of Artificial Sequence: Synthetic coding sequence
atgcccagagccttcctggtgagaagcagaagaccccagccccccaactggggccacctgcccgaccagctgagaggcgacgcctacatccccgactgcagcagcctgggcggcccccccgcccagcagagcagcagcgtgagagacccctggaccgccgtgagcgtgctgggcacctgcccccccctgctgctgtgcgtgggcaacgccagccccttcctggtggcccccggccccgccgccaccggcatcagcagcagcggcgcccaggacagcagcccccacgtggacgaccccctgtacctgtgcatgcactggagaaaggagagcgccagcagaaaccagcccacccagggcaacctgaccagcgcccccagaggccccggcaccctgggctgccccctgtgccccaaggccttccccctgcagagaatgctgaccagacacctgaagtgccacagccccgtgagaagacacctgtgcagatgctgcggcaagggcttccacgacgccttcgacctgaagagacacatgagaacccacaccggcatcagacccttcagatgcagcgcctgcggcaaggccttcacccagagatgcagcctggaggcccacctggccaaggtgcacggccagcccgccagctacgcctacagagagagaagagagaagctgcacgtgtgcgaggactgcggcttcaccagcagcagacccgacacctacgcccagcacagagccctgcacagagccgcctag

SEQ ID NO: 23017 - DNA, 1683 bp, Artificial Sequence
  Description of Artificial Sequence: Synthetic coding sequence
atgggcaagtggagacccagaggctgctgcagaggcaacatgcagtgcagacaggaggtgcccgccaccctgaccagcagcgagctgttcagcaccagaaaccagccccagccccagccccagcccctgctggccgacgcccccgtgccctgggccgtggccagcagaatgtgcctgacccccggccagggctgcggccaccagggccaggacgagggccccctgcccgcccccagccccccccccgccatgagcagcagcagaaaggaccacctgggcgccagcagcagcgagcccctgcccgtgatcatcgtgggcaacggccccagcggcatctgcctgagctacctgctgagcggctacaccccctacaccaagcccgacgccatccacccccaccccctgctgcagagaaagctgaccgaggcccccggcgtgagcatcctggaccaggacctggactacctgagcgagggcctggagggcagaagccagagccccgtggccctgctgttcgacgccctgctgagacccgacaccgacttcggcggcaacatgaagagcgtgctgacctggaagcacagaaaggagcacgccatcccccacgtggtgctgggcagaaacctgcccggcggcgcctggcacagcatcgagggcagcatggtgatcctgagccagggccagtggatgggcctgcccgacctggaggtgaaggactggatgcagaagaagagaagaggcctgagaaacagcagagccaccgccggcgacatcgcccactactacagagactacgtggtgaagaagggcctgggccacaacttcgtgagcggcgccgtggtgaccgccgtggagtggggcacccccgaccccagcagctgcggcgcccaggacagcagccccctgttccaggtgagcggcttcctgaccagaaaccaggcccagcagcccttcagcctgtgggccagaaacgtggtgctggccaccggcaccttcgacagccccgccagactgggcatccccggcgaggccctgcccttcatccaccacgagctgagcgccctggaggccgccaccagagtgggcgccgtgacccccgccagcgaccccgtgctgatcatcggcgccggcctgagcgccgccgacgccgtgctgtacgccagacactacaacatccccgtgatccacgccttcagaagagccgtggacgaccccggcctggtgttcaaccagctgcccaagatgctgtaccccgagtaccacaaggtgcaccagatgatgagagagcagagcatcctgagccccagcccctacgagggctacagaagcctgcccagacaccagctgctgtgcttcaaggaggactgccaggccgtgttccaggacctggagggcgtggagaaggtgttcggcgtgagcctggtgctggtgctgatcggcagccaccccgacctgagcttcctgcccggcgccggcgccgacttcgccgtggaccccgaccagcccctgagcgccaagagaaaccccatcgacgtggaccccttcacctaccagagcaccagacaggagggcctgtacgccatgggccccctggccggcgacaacttcgtgagattcgtgcagggcggcgccctggccgtggccagcagcctgctgagaaaggagaccagaaagcccccctag

SEQ ID NO: 23018 - DNA, 1434 bp, Artificial Sequence
  Description of Artificial Sequence: Synthetic coding sequence
atgagcagcagcagaaaggaccacctgggcgccagcagcagcgagcccctgcccgtgatcatcgtgggcaacggccccagcggcatctgcctgagctacctgctgagcggctacaccccctacaccaagcccgacgccatccacccccaccccctgctgcagagaaagctgaccgaggcccccggcgtgagcatcctggaccaggacctggactacctgagcgagggcctggagggcagaagccagagccccgtggccctgctgttcgacgccctgctgagacccgacaccgacttcggcggcaacatgaagagcgtgctgacctggaagcacagaaaggagcacgccatcccccacgtggtgctgggcagaaacctgcccggcggcgcctggcacagcatcgagggcagcatggtgatcctgagccagggccagtggatgggcctgcccgacctggaggtgaaggactggatgcagaagaagagaagaggcctgagaaacagcagagccaccgccggcgacatcgcccactactacagagactacgtggtgaagaagggcctgggccacaacttcgtgagcggcgccgtggtgaccgccgtggagtggggcacccccgaccccagcagctgcggcgcccaggacagcagccccctgttccaggtgagcggcttcctgaccagaaaccaggcccagcagcccttcagcctgtgggccagaaacgtggtgctggccaccggcaccttcgacagccccgccagactgggcatccccggcgaggccctgcccttcatccaccacgagctgagcgccctggaggccgccaccagagtgggcgccgtgacccccgccagcgaccccgtgctgatcatcggcgccggcctgagcgccgccgacgccgtgctgtacgccagacactacaacatccccgtgatccacgccttcagaagagccgtggacgaccccggcctggtgttcaaccagctgcccaagatgctgtaccccgagtaccacaaggtgcaccagatgatgagagagcagagcatcctgagccccagcccctacgagggctacagaagcctgcccagacaccagctgctgtgcttcaaggaggactgccaggccgtgttccaggacctggagggcgtggagaaggtgttcggcgtgagcctggtgctggtgctgatcggcagccaccccgacctgagcttcctgcccggcgccggcgccgacttcgccgtggaccccgaccagcccctgagcgccaagagaaaccccatcgacgtggaccccttcacctaccagagcaccagacaggagggcctgtacgccatgggccccctggccggcgacaacttcgtgagattcgtgcagggcggcgccctggccgtggccagcagcctgctgagaaaggagaccagaaagcccccctag

SEQ ID NO: 23019 - DNA, 1434 bp, Artificial Sequence; identical to SEQ ID NO: 23018
  Description of Artificial Sequence: Synthetic coding sequence

SEQ ID NO: 23020 - DNA, 1518 bp, Artificial Sequence
  Description of Artificial Sequence: Synthetic coding sequence
atgcccctggtggaggagaccagcctgctggaggacagcagcgtgaccttccccgtggtgatcatcggcaacggccccagcggcatctgcctgagctacatgctgagcggctacagaccctacctgagcagcgaggccatccaccccaacaccatcctgaacagcaagctggaggaggccagacacctgagcatcgtggaccaggacctggagtacctgagcgagggcctggagggcagaagcagcaaccccgtggccgtgctgttcgacaccctgctgcaccccgacgccgacttcggctacgactaccccagcgtgctgcactggaagctggagcagcaccactacatcccccacgtggtgctgggcaagggcccccccggcggcgcctggcacaacatggagggcagcatgctgaccatcagcttcggcagctggatggagctgcccggcctgaagttcaaggactgggtgagcagcaagagaagaagcctgaagggcgacagagtgatgcccgaggagatcgccagatactacaagcactacgtgaaggtgatgggcctgcagaagaacttcagagagaacacctacatcaccagcgtgagcagactgtacagagaccaggacgacgacgacatccaggacagagacatcagcaccaagcacctgcagatcgagaagagcaacttcatcaagagaaactgggagatcagaggctaccagagaatcgccgacggcagccacgtgcccttctgcctgttcgccgagaacgtggccctggccaccggcaccctggacagccccgcccacctggagatcgagggcgaggacttccccttcgtgttccacagcatgcccgagttcggcgccgccatcaacaagggcaagctgagaggcaaggtggaccccgtgctgatcgtgggcagcggcctgaccgccgccgacgccgtgctgtgcgcctacaacagcaacatccccgtgatccacgtgttcagaagaagagtgaccgaccccagcctgatcttcaagcagctgcccaagaagctgtaccccgagtaccacaaggtgtaccacatgatgtgcacccagagctacagcgtggacagcaacctgctgagcgactacaccagcttccccgagcacagagtgctgagcttcaagagcgacatgaagtgcgtgctgcagagcgtgagcggcctgaagaagatcttcaagctgagcgccgccgtggtgctgatcggcagccaccccaacctgagcttcctgaaggaccagggctgctacctgggccacaagagcagccagcccatcacctgcaagggcaaccccgtggagatcgacacctacacctacgagtgcatcaaggaggccaacctgttcgccctgggccccctggtgggcgacaacttcgtgagattcctgaagggcggcgccctgggcgtgaccagatgcctggccaccagacagaagaagaagcacctgttcgtggagagaggcggcggcgacggcatcgcctag

SEQ ID NO: 23021 - DNA, 1650 bp, Artificial Sequence
  Description of Artificial Sequence: Synthetic coding sequence
atgcccgtgtggtgctgcagatgcagcctggccggccacttcagaaactacagcgacaccgagaccgagggcgagatcttcaacagcctggtgcagtacttcggcgacaacctgggcagaaaggtgaaggccatgcccctggtggaggagaccagcctgctggaggacagcagcgtgaccttccccgtggtgatcatcggcaacggccccagcggcatctgcctgagctacatgctgagcggctacagaccctacctgagcagcgaggccatccaccccaacaccatcctgaacagcaagctggaggaggccagacacctgagcatcgtggaccaggacctggagtacctgagcgagggcctggagggcagaagcagcaaccccgtggccgtgctgttcgacaccctgctgcaccccgacgccgacttcggctacgactaccccagcgtgctgcactggaagctggagcagcaccactacatcccccacgtggtgctgggcaagggcccccccggcggcgcctggcacaacatggagggcagcatgctgaccatcagcttcggcagctggatggagctgcccggcctgaagttcaaggactgggtgagcagcaagagaagaagcctgaagggcgacagagtgatgcccgaggagatcgccagatactacaagcactacgtgaaggtgatgggcctgcagaagaacttcagagagaacacctacatcaccagcgtgagcagactgtacagagaccaggacgacgacgacatccaggacagagacatcagcaccaagcacctgcagatcgagaagagcaacttcatcaagagaaactgggagatcagaggctaccagagaatcgccgacggcagccacgtgcccttctgcctgttcgccgagaacgtggccctggccaccggcaccctggacagccccgcccacctggagatcgagggcgaggacttccccttcgtgttccacagcatgcccgagttcggcgccgccatcaacaagggcaagctgagaggcaaggtggaccccgtgctgatcgtgggcagcggcctgaccgccgccgacgccgtgctgtgcgcctacaacagcaacatccccgtgatccacgtgttcagaagaagagtgaccgaccccagcctgatcttcaagcagctgcccaagaagctgtaccccgagtaccacaaggtgtaccacatgatgtgcacccagagctacagcgtggacagcaacctgctgagcgactacaccagcttccccgagcacagagtgctgagcttcaagagcgacatgaagtgcgtgctgcagagcgtgagcggcctgaagaagatcttcaagctgagcgccgccgtggtgctgatcggcagccaccccaacctgagcttcctgaaggaccagggctgctacctgggccacaagagcagccagcccatcacctgcaagggcaaccccgtggagatcgacacctacacctacgagtgcatcaaggaggccaacctgttcgccctgggccccctggtgggcgacaacttcgtgagattcctgaagggcggcgccctgggcgtgaccagatgcctggccaccagacagaagaagaagcacctgttcgtggagagaggcggcggcgacggcatcgcctag

SEQ ID NO: 23022 - DNA, 1584 bp, Artificial Sequence
  Description of Artificial Sequence: Synthetic coding sequence
atgagcgaggacagcagcgccctgccctggagcatcaacagagacgactacgagctgcaggaggtgatcggcagcggcgccaccgccgtggtgcaggccgcctactgcgcccccaagaaggagaaggtggccatcaagagaatcaacctggagaagtgccagaccagcatggacgagctgctgaaggagatccaggccatgagccagtgccaccaccccaacatcgtgagctactacaccagcttcgtggtgaaggacgagctgtggctggtgatgaagctgctgagcggcggcagcgtgctggacatcatcaagcacatcgtggccaagggcgagcacaagagcggcgtgctggacgagagcaccatcgccaccatcctgagagaggtgctggagggcctggagtacctgcacaagaacggccagatccacagagacgtgaaggccggcaacatcctgctgggcgaggacggcagcgtgcagatcgccgacttcggcgtgagcgccttcctggccaccggcggcgacatcaccagaaacaaggtgagaaagaccttcgtgggcaccccctgctggatggcccccgaggtgatggagcaggtgagaggctacgacttcaaggccgacatctggagcttcggcatcaccgccatcgagctggccaccggcgccgccccctaccacaagtacccccccatgaaggtgctgatgctgaccctgcagaacgacccccccagcctggagaccggcgtgcaggacaaggagatgctgaagaagtacggcaagagcttcagaaagatgatcagcctgtgcctgcagaaggaccccgagaagagacccaccgccgccgagctgctgagacacaagttcttccagaaggccaagaacaaggagttcctgcaggagaagaccctgcagagagcccccaccatcagcgagagagccaagaaggtgagaagagtgcccggcagcagcggcagactgcacaagaccgaggacggcggctgggagtggagcgacgacgagttcgacgaggagagcgaggagggcaaggccgccatcagccagctgagaagccccagagtgaaggagagcatcagcaacagcgagctgttccccaccaccgaccccgtgggcaccctgctgcaggtgcccgagcagatcagcgcccacctgccccagcccgccggccagatcgccacccagcccacccaggtgagcctgccccccaccgccgagcccgccaagaccgcccaggccctgagcagcggcagcggcagccaggagaccaagatccccatcagcctggtgctgagactgagaaacagcaagaaggagctgaacgacatcagattcgagttcacccccggcagagacaccgccgagggcgtgagccaggagctgatcagcgccggcctggtggacggcagagacctggtgatcgtggccgccaacctgcagaagatcgtggaggagccccagagcaacagaagcgtgaccttcaagctggccagcggcgtggagggcagcgacatccccgacgacggcaagctgatcggcttcgcccagctgagcatcagctag

SEQ ID NO: 23023 - DNA, 309 bp, Artificial Sequence
  Description of Artificial Sequence: Synthetic coding sequence
atgagcgccagagtgagaagcagaagcagaggcagaggcgacggccaggaggcccccgacgtggtggccttcgtggcccccggcgagagccagcaggaggagccccccaccgacaaccaggacatcgagcccggccaggagagagagggcaccccccccatcgaggagagaaaggtggagggcgactgccaggagatggacctggagaagaccagaagcgagagaggcgacggcagcgacgtgaaggagaagaccccccccaaccccaagcacgccaagaccaaggaggccggcgacggccagccctag

SEQ ID NO: 23024 - DNA, 336 bp, Artificial Sequence
  Description of Artificial Sequence: Synthetic coding sequence
atgagcgagcacgtgagaaccagaagccagagcagcgagagaggcaacgaccaggagagcagccagcccgtgggcagcgtgatcgtgcaggagcccaccgaggagaagagacaggaggaggagccccccaccgacaaccagggcatcgcccccagcggcgagatcgagaacgagggcgcccccgccgtgcagggccccgacatggaggccttccagcaggagctggccctgctgaagatcgaggacgagcccggcgacggccccgacgtgagagagggcatcatgcccaccttcgacctgaccaaggtgctggaggccggcgacgcccagccctag

SEQ ID NO: 23025 - DNA, 285 bp, Artificial Sequence
  Description of Artificial Sequence: Synthetic coding sequence
atgagcgagcacgtgagaaccagaagccagagcagcgagagaggcaacgaccaggagagcagccagcccgtgggcagcgtgatcgtgcaggagcccaccgaggagaagagacaggaggaggagccccccaccgacaaccagggccccgacatggaggccttccagcaggagctggccctgctgaagatcgaggacgagcccggcgacggccccgacgtgagagagggcatcatgcccaccttcgacctgaccaaggtgctggaggccggcgacgcccagccctag

SEQ ID NO: 23026 - DNA, 393 bp, Artificial Sequence
  Description of Artificial Sequence: Synthetic coding sequence
atgcaggccccctgggccggcaacagaggctgggccggcaccagagaggaggtgagagacatgagcgagcacgtgaccagaagccagagcagcgagagaggcaacgaccaggagagcagccagcccgtgggccccgtgatcgtgcagcagcccaccgaggagaagagacaggaggaggagccccccaccgacaaccagggcatcgcccccagcggcgagatcaagaacgagggcgcccccgccgtgcagggcaccgacgtggaggccttccagcaggagctggccctgctgaagatcgaggacgcccccggcgacggccccgacgtgagagagggcaccctgcccaccttcgaccccaccaaggtgctggaggccggcgagggccagctgtag

SEQ ID NO: 23027 - DNA, 282 bp, Artificial Sequence
  Description of Artificial Sequence: Synthetic coding sequence
atgagcgagcacgtgaccagaagccagagcagcgagagaggcaacgaccaggagagcagccagcccgtgggccccgtgatcgtgcagcagcccaccgaggagaagagacaggaggaggagccccccaccgacaaccagggcaccgacgtggaggccttccagcaggagctggccctgctgaagatcgaggacgcccccggcgacggccccgacgtgagagagggcaccctgcccaccttcgaccccaccaaggtgctggaggccggcgagggccagctgtag

SEQ ID NO: 23028 - DNA, 333 bp, Artificial Sequence
  Description of Artificial Sequence: Synthetic coding sequence
atgagcgagcacgtgaccagaagccagagcagcgagagaggcaacgaccaggagagcagccagcccgtgggccccgtgatcgtgcagcagcccaccgaggagaagagacaggaggaggagccccccaccgacaaccagggcatcgcccccagcggcgagatcaagaacgagggcgcccccgccgtgcagggcaccgacgtggaggccttccagcaggagctggccctgctgaagatcgaggacgcccccggcgacggccccgacgtgagagagggcaccctgcccaccttcgaccccaccaaggtgctggaggccggcgagggccagctgtag

SEQ ID NO: 23029 - DNA, 3273 bp, Artificial Sequence
  Description of Artificial Sequence: Synthetic coding sequence
atggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgacgccgtgaactacatcagcagccagctgcccgacctgcccatcctgtgcagcagaaccgccgagcccagccccggccaggacggcaccagcagagccgccggcgtgggctgggagaacgtgctgctgaaggagggcgagagcgccagcaacgccaccgagaccagcggccccgacatgaccatcaagaagcccccccagctgagcgaggacgacatctggctgaagagcgagggcgacaactacagcgccaccctgctggagcccgccgccagcagcctgagccccgaccacaagaacatggagatcgaggtgagcgtggccgagtgcaagagcgtgcccggcatcaccagcaccccccaccccatggaccaccccagcgccttctacagccccccccacaacggcctgctgaccgaccaccacgagagcctggacaacgacgtggccagagagatcagatacctggacgaggtgctggaggccaactgctgcgacagcgccgtggacggcacctacaacggcaccagcagccccgagcccggcgccgtggtgctggtgggcggcctgagcccccccgtgcacgaggccacccagcccgagcccaccgagagaaccgccagcagacaggcccccccccacatcgagctgagcaacagcagccccgaccccatggccgaggccgagagaaccaacggccacagccccagccagcccagagacgccctgggcgacagcctgcaggtgcccgtgagccccagcagcaccaccagcagcagatgcagcagcagagacggcgagttcaccctgaccaccctgaagaaggaggccaagttcgagctgagagccttccacgaggacaagaagcccagcaagctgttcgaggacgacgagcacgagaaggagcagtactgcatcagaaaggtgagacccagcgaggagatgctggagctggagaaggagagaagagagctgatcagaagccaggccgtgaagaagaaccccggcatcgccgccaagtggtggaaccccccccaggagaagaccatcgaggagcagctggacgaggagcacctggagagccacaagaagtacaaggagagaaaggagagaagagcccagcaggagcagctgctgctgcagaagcagctgcagcagcagcagcagcagccccccagccagctgtgcaccgcccccgccagcagccacgagagagccagcatgatcgacaaggccaaggaggacatcgtgaccgagcagatcgacttcagcgccgccagaaagcagttccagctgatggagaacagcagacaggccgtggccaagggccagagcacccccagactgttcagcatcaagcccttctacagacccctgggcagcgtgaacagcgacaagcccctgaccaaccccagaccccccagcgtgggcggcccccccgaggacagcggcgccagcgccgccaagggccagaagagccccggcgccctggagacccccagcgccgccggcagccagggcaacaccgccagccagggcaaggagggcccctacagcgagcccagcaagagaggccccctgagcaagctgtgggccgaggacggcgagttcaccagcgccagagccgtgctgaccgtggtgaaggacgacgaccacggcatcctggaccagttcagcagaagcgtgaacgtgagcctgacccaggaggagctggacagcggcctggacgagctgagcgtgagaagccaggacaccaccgtgctggagaccctgagcaacgacttcagcatggacaacatcagcgacagcggcgccagcaacgagaccaccaacgccctgcaggagaacagcctggccgacttcagcctgccccagaccccccagaccgacaaccccagcgagggcagaggcgagggcgtgagcaagagcttcagcgaccacggcttctacagccccagcagcaccctgggcgacagccccctggtggacgaccccctggagtaccaggccggcctgctggtgcagaacgccatccagcaggccatcgccgagcaggtggacaaggccgtgagcaagaccagcagagacggcgccgagcagcagggccccgaggccaccgtggaggaggccgaggccgccgccttcggcagcgagaagccccagagcatgttcgagcccccccaggtgagcagccccgtgcaggagaagagagacgtgctgcccaagatcctgcccgccgaggacagagccctgagagagagaggccccccccagcccctgcccgccgtgcagcccagcggccccatcaacatggaggagaccagacccgagggcagctacttcagcaagtacagcgaggccgccgagctgagaagcaccgccagcctgctggccacccaggagagcgacgtgatggtgggccccttcaagctgagaagcagaaagcagagaaccctgagcatgatcgaggaggagatcagagccgcccaggagagagaggaggagctgaagagacagagacaggtgctgcagagcacccagagccccagaaccaagaacgcccccagcctgcccagcagaacctgctacaagaccgcccccggcaagatcgagaaggtgaagcccccccccagccccaccaccgagggccccagcctgcagcccgacctggcccccgaggaggccgccggcacccagagacccaagaacctgatgcagaccctgatggaggactacgagacccacaagagcaagagaagagagagaatggacgacagcagcgtgctggaggccaccagagtgaacagaagaaagagcgccctggccctgagatgggaggccggcatctacgccaaccaggaggaggaggacaacgagtag

SEQ ID NO: 23030 - DNA, 3312 bp, Artificial Sequence
  Description of Artificial Sequence: Synthetic coding sequence
atggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgacgccgtgaactacatcagcagccagctgcccgacctgcccatcctgtgcagcagaaccgccgagcccagccccggccaggacggcaccagcagagccgccggcgtgggctgggagaacgtgctgctgaaggagggcgagagcgccagcaacgccaccgagaccagcggccccgacatgaccatcaagaagcccccccagctgagcgaggacgacatctggctgaagagcgagggcgacaactacagcgccaccctgctggagcccgccgccagcagcctgagccccgaccacaagaacatggagatcgaggtgagcgtggccgagtgcaagagcgtgcccggcatcaccagcaccccccaccccatggaccaccccagcgccttctacagccccccccacaacggcctgctgaccgaccaccacgagagcctggacaacgacgtggccagagagatcagatacctggacgaggtgctggaggccaactgctgcgacagcgccgtggacggcacctacaacggcaccagcagccccgagcccggcgccgtggtgctggtgggcggcctgagcccccccgtgcacgaggccacccagcccgagcccaccgagagaaccgccagcagacaggcccccccccacatcgagctgagcaacagcagccccgaccccatggccgaggccgagagaaccaacggccacagccccagccagcccagagacgccctgggcgacagcctgcaggtgcccgtgagccccagcagcaccaccagcagcagatgcagcagcagagacggcgagttcaccctgaccaccctgaagaaggaggccaagttcgagctgagagccttccacgaggacaagaagcccagcaagctgttcgaggacgacgagcacgagaaggagcagtactgcatcagaaaggtgagacccagcgaggagatgctggagctggagaaggagagaagagagctgatcagaagccaggccgtgaagaagaaccccggcatcgccgccaagtggtggaaccccccccaggagaagaccatcgaggagcagctggacgaggagcacctggagagccacaagaagtacaaggagagaaaggagagaagagcccagcaggagcagctgctgctgcagaagcagctgcagcagcagcagcagcagccccccagccagctgtgcaccgcccccgccagcagccacgagagagccagcatgatcgacaaggccaaggaggacatcgtgaccgagcagatcgacttcagcgccgccagaaagcagttccagctgatggagaacagcagacaggccgtggccaagggccagagcacccccagactgttcagcatcaagcccttctacagacccctgggcagcgtgaacagcgacaagcccctgaccaaccccagaccccccagcgtgggcggcccccccgaggacagcggcgccagcgccgccaagggccagaagagccccggcgccctggagacccccagcgccgccggcagccagggcaacaccgccagccagggcaaggagggcccctacagcgagcccagcaagagaggccccctgagcaagctgtgggccgaggacggcgagttcaccagcgccagagccgtgctgaccgtggtgaaggacgacgaccacggcatcctggaccagttcagcagaagcgtgaacgtgagcctgacccaggaggagctggacagcggcctggacgagctgagcgtgagaagccaggacaccaccgtgctggagaccctgagcaacgacttcagcatggacaacatcagcgacagcggcgccagcaacgagaccaccaacgccctgcaggagaacagcctggccgacttcagcctgccccagaccccccagaccgacaaccccagcgagggcagaggcgagggcgtgagcaagagcttcagcgaccacggcttctacagccccagcagcaccctgggcgacagccccctggtggacgaccccctggagtaccaggccggcctgctggtgcagaacgccatccagcaggccatcgccgagcaggtggacaaggccgtgagcaagaccagcagagacggcgccgagcagcagggccccgaggccaccgtggaggaggccgaggccgccgccttcggcagcgagaagccccagagcatgttcgagcccccccaggtgagcagccccgtgcaggagaagagagacgtgctgcccaagatcctgcccgccgaggacagagccctgagagagagaggccccccccagcccctgcccgccgtgcagcccagcggccccatcaacatggaggagaccagacccgagggcagctacttcagcaagtacagcgaggccgccgagctgagaagcaccgccagcctgctggccacccaggagagcgacgtgatggtgggccccttcaagctgagaagcagaaagcagagaaccctgagcatgatcgaggaggagatcagagccgcccaggagagagaggaggagctgaagagacagagacaggtgctgcagagcacccagagccccagaaccaagaacgcccccagcctgcccagcagaacctgctacaagaccgcccccggcaagatcgagaaggtgaagcccccccccagccccaccaccgagggccccagcctgcagcccgacctggcccccgaggaggccgccggcacccagagacccaagaacctgatgcagaccctgatggaggactacgagacccacaagagcaagagaagagagagaatggacgacagcagctacaccagcaagctgctgagctgcaaggtgaccagcgaggtgctggaggccaccagagtgaacagaagaaagagcgccctggccctgagatgggaggccggcatctacgccaaccaggaggaggaggacaacgagtag

SEQ ID NO: 23031 - DNA, 1302 bp, Artificial Sequence
  Description of Artificial Sequence: Synthetic coding sequence
atggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgacgccgtgaactacatcagcagccagctgcccgacctgcccatcctgtgcagcagaaccgccgagcccagccccggccaggacggcaccagcagagccgccgccgtgtacgccatggagatcaacgtggagaaggacaagcagaccggcgagaccaagatcctgagcaccagcaccatcggccccgagggcgtgcaccagaagggcgtgaaggtgtacgacgacggcaccaaggtggtgtacgaggtgagaagcggcggcaccgtggtggagaacggcgtgcacaagctgagcaccaaggacgtggaggagctgatccagaaggccggccagagcagcctgggcggcggccacgtgagcgagagaaccgtgatcgccgacggcagcctgagccaccccaaggagcacatgctgtgcaaggaggccaagctggagatggtgcacaagagcagaaaggaccacagcagcggcaaccccggccagcaggcccaggcccccagcgccgccggccccgaggccaacctggaccagcccgtgaccatgatcttcatgggctaccagaacatcgaggacgaggaggagaccaagaaggtgctgggctacgacgagaccatcaaggccgagctggtgctgatcgacgaggacgacgagaagagcctgagagagaagaccgtgaccgacgtgagcaccatcgacggcaacgccgccgagctggtgagcggcagacccgtgagcgacaccaccgagcccagcagccccgagggcaaggaggagagcctggccaccgagcccgcccccggcgtgggctgggagaacgtgctgctgaaggagggcgagagcgccagcaacgccaccgagaccagcggccccgacatgaccatcaagaagcccccccagctgagcgagtag

SEQ ID NO: 23032 - DNA, 1404 bp, Artificial Sequence
  Description of Artificial Sequence: Synthetic coding sequence
atgctgatcttctggaccatcaccctgttcctgctgggcgccgccaagggcaaggaggtgtgctacgaggacctgggctgcttcagcgacaccgagccctggggcggcaccgccatcagacccctgaagatcctgccctggagccccgagaagatcggcaccagattcctgctgtacaccaacgagaaccccaacaacttccagatcctgctgctgagcgaccccagcaccatcgaggccagcaacttccagatggacagaaagaccagattcatcatccacggcttcatcgacaagggcgacgagagctgggtgaccgacatgtgcaagaagctgttcgaggtggaggaggtgaactgcatctgcgtggactggaagaagggcagccaggccacctacacccaggccgccaacaacgtgagagtggtgggcgcccaggtggcccagatgctggacatcctgctgaccgagtacagctacccccccagcaaggtgcacctgatcggccacagcctgggcgcccacgtggccggcgaggccggcagcaagacccccggcctgagcagaatcaccggcctggaccccgtggaggccagcttcgagagcacccccgaggaggtgagactggaccccagcgacgccgacttcgtggacgtgatccacaccgacgccgcccccctgatccccttcctgggcttcggcaccaaccagcagatgggccacctggacttcttccccaacggcggcgagagcatgcccggctgcaagaagaacgccctgagccagatcgtggacctggacggcatctgggccggcaccagagacttcgtggcctgcaaccacctgagaagctacaagtactacctggagagcatcctgaaccccgacggcttcgccgcctacccctgcaccagctacaagagcttcgagagcgacaagtgcttcccctgccccgaccagggctgcccccagatgggccactacgccgacaagttcgccggcagaaccagcgaggagcagcagaagttcttcctgaacaccggcgaggccagcaacttcgccagatggagatacggcgtgagcatcaccctgagcggcagaaccgccaccggccagatcaaggtggccctgttcggcaacaagggcaacacccaccagtacagcatcttcagaggcatcctgaagcccggcagcacccacagctacgagttcgacgccaagctggacgtgggcaccatcgagaaggtgaagttcctgtggaacaacaacgtgatcaaccccaccctgcccaaggtgggcgccaccaagatcaccgtgcagaagggcgaggagaagaccgtgtacaacttctgcagcgaggacaccgtgagagaggacaccctgctgaccctgaccccctgctag

SEQ ID NO: 23033 - DNA, 1407 bp, Artificial Sequence
  Description of Artificial Sequence: Synthetic coding sequence
atgctgcccccctggaccctgggcctgctgctgctggccaccgtgagaggcagaaaggtgtgctacggccagctgggctgcttcagcgacgagaagccctgggccggcaccctgcagagacccgtgaagctgctgccctggagccccgaggacatcgacaccagattcctgctgtacaccaacgagaaccccaacaacttccagctgatcaccggcaccgagcccgacaccatcgaggccagcaacttccagctggacagaaagaccagattcatcatccacggcttcctggacaaggccgaggacagctggcccagcgacatgtgcaagaagatgttcgaggtggagaaggtgaactgcatctgcgtggactggagacacggcagcagagccatgtacacccaggccgtgcagaacatcagagtggtgggcgccgagaccgccttcctgatccaggccctgagcacccagctgggctacagcctggaggacgtgcacgtgatcggccacagcctgggcgcccacaccgccgccgaggccggcagaagactgggcggcagagtgggcagaatcaccggcctggaccccgccggcccctgcttccaggacgagcccgaggaggtgagactggaccccagcgacgccgtgttcgtggacgtgatccacaccgacagcagccccatcgtgcccagcctgggcttcggcatgagccagaaggtgggccacctggacttcttccccaacggcggcaaggagatgcccggctgcaagaagaacgtgctgagcaccatcaccgacatcgacggcatctgggagggcatcggcggcttcgtgagctgcaaccacctgagaagcttcgagtactacagcagcagcgtgctgaaccccgacggcttcctgggctacccctgcgccagctacgacgagttccaggagagcaagtgcttcccctgccccgccgagggctgccccaagatgggccactacgccgaccagttcaagggcaagaccagcgccgtggagcagaccttcttcctgaacaccggcgagagcggcaacttcaccagcaagtacaagatcagcgtgaccctgagcggcaaggagaaggtgaacggctacatcagaatcgccctgtacggcagcaacgagaacagcaagcagtacgagatcttcaagggcagcctgaagcccgacgccagccacacctgcgccatcgacgtggacttcaacgtgggcaagatccagaaggtgaagttcctgtggaacaagagaggcatcaacctgagcgagcccaagctgggcgccagccagatcaccgtgcagagcggcgaggacggcaccgagtacaacttctgcagcagcgacaccgtggaggagaacgtgctgcagagcctgtacccctgctag

SEQ ID NO: 23034 - DNA, 423 bp, Artificial Sequence
  Description of Artificial Sequence: Synthetic coding sequence
atggccgccatccccagcagcggcagcctggtggccacccacgactactacagaagaagactgggcagcaccagcagcaacagcagctgcagcagcaccgagtgccccggcgaggccatcccccacccccccggcgagtgcagaatcgcccccttcagccccagaagcagcagaagctggcagcaccaggaccccaccagcctgctgagcggcctgcccaaggccgaccccggccactggtgggccagcttcttcttcggcaagagcaccctgcccttcatggccaccgtgctggagagcgccgagcacagcgagcccccccaggccagcagcagcatgaccgcctgcggcctggccagagacgcccccagaaagcagcccggcggccagagcagcaccgccagcgccggcccccccagctag

SEQ ID NO: 23035 - DNA, 213 bp, Artificial Sequence
  Description of Artificial Sequence: Synthetic coding sequence
atggccgccatccccagcagcggcagcctggtggccacccacgactactacagaagaagactgggcagcaccagcagcaacagcagctgcagcagcaccgagtgccccggcgaggccatcccccacccccccggcctgcccaaggccgaccccggccactggtgggccagcttcttcttcggcaagagcaccctgcccccccccaccctgtag

SEQ ID NO: 23036 - DNA, 345 bp, Artificial Sequence
  Description of Artificial Sequence: Synthetic coding sequence
atggccgccatccccagcagcggcagcctggtggccacccacgactactacagaagaagactgggcagcaccagcagcaacagcagctgcagcagcaccgagtgccccggcgaggccatcccccacccccccggcctgcccaaggccgaccccggccactggtgggccagcttcttcttcggcaagagcaccctgcccttcatggccaccgtgctggagagcgccgagcacagcgagcccccccaggccagcagcagcatgaccgcctgcggcctggccagagacgcccccagaaagcagcccggcggccagagcagcaccgccagcgccggcccccccagctag

SEQ ID NO: 23037 - DNA, 1860 bp, Artificial Sequence
  Description of Artificial Sequence: Synthetic coding sequence
atgtacagaagcggcgagagactgctgggcagccacgccctgcccgccgagcagagagacttcctgcccctggagaccaccaacaacaacaacaaccaccaccagcccggcgcctgggccagaagagccggcagcagcgccagcagcccccccagcgccagcagcagcccccaccccagcgccgccgtgcccgccgccgaccccgccgacagcgccagcggcagcagcaacaagagaaagagagacaacaagcccagcggcggcagagccgccggcggcggcagagccgacggcggcggcgtggtgtacagcggcaccccctggaagagaagaaactacaaccagggcgtggtgggcctgcacgaggagatcagcgacttctacgagtacatgagccccagacccgaggaggagaagatgagaatggaggtggtgaacagaatcgagagcgtgatcaaggagctgtggcccagcgccgacgtgcagatcttcggcagcttcaagaccggcctgtacctgcccaccagcgacatcgacctggtggtgttcggcaagtgggagaacctgcccctgtggaccctggaggaggccctgagaaagcacaaggtggccgacgaggacagcgtgaaggtgctggacaaggccaccgtgcccatcatcaagctgaccgacagcttcaccgaggtgaaggtggacatcagcttcaacgtgcagaacggcgtgagagccgccgacctgatcaaggacttcaccaagaagtaccccgtgctgccctacctggtgctggtgctgaagcagttcctgctgcagagagacctgaacgaggtgttcaccggcggcatcggcagctacagcctgttcctgatggccgtgagcttcctgcagctgcaccccagagaggacgcctgcatccccaacaccaactacggcgtgctgctgatcgagttcttcgagctgtacggcagacacttcaactacctgaagaccggcatcagaatcaaggacggcggcagctacgtggccaaggacgaggtgcagaagaacatgctggacggctacagacccagcatgctgtacatcgaggaccccctgcagcccggcaacgacgtgggcagaagcagctacggcgccatgcaggtgaagcaggccttcgactacgcctacgtggtgctgagccacgccgtgagccccatcgccaagtactaccccaacaacgagaccgagagcatcctgggcagaatcatcagagtgaccgacgaggtggccacctacagagactggatcagcaagcagtggggcctgaagaacagacccgagcccagctgcaacggcaacggcgtgaccctgatcgtggacacccagcagctggacaagtgcaacaacaacctgagcgaggagaacgaggccctgggcaagtgcagaagcaagaccagcgagagcctgagcaagcacagcagcaacagcagcagcggccccgtgagcagcagcagcgccacccagagcagcagcagcgacgtggacagcgacgccaccccctgcaagacccccaagcagctgctgtgcagacccagcaccggcaacagagtgggcagccaggacgtgagcctggagagcagccaggccgtgggcaagatgcagagcacccagaccaccaacaccagcaacagcaccaacaagagccagcacggcagcgccagactgttcagaagcagcagcaagggcttccagggcaccacccagaccagccacggcagcctgatgaccaacaagcagcaccagggcaagagcaacaaccagtactaccacggcaagaagagaaagcacaagagagacgcccccctgagcgacctgtgcagatag

SEQ ID NO: 23038 - DNA, 2097 bp, Artificial Sequence
  Description of Artificial Sequence: Synthetic coding sequence
atgagacccagacccagaagcgcccccggcaagcccagaagaagaagcagagccagactgagaagcagcagaacccccagcggcggcgccagcggcggcggcggcagcagcagcagcagcagcaccgccaccggcggcagcggcagcagcaccggcagccccggcggcgccgccagcgcccccgcccccgcccccgccggcatgtacagaagcggcgagagactgctgggcagccacgccctgcccgccgagcagagagacttcctgcccctggagaccaccaacaacaacaacaaccaccaccagcccggcgcctgggccagaagagccggcagcagcgccagcagcccccccagcgccagcagcagcccccaccccagcgccgccgtgcccgccgccgaccccgccgacagcgccagcggcagcagcaacaagagaaagagagacaacaaggccagcacctacggcctgaactacagcctgctgcagcccagcggcggcagagccgccggcggcggcagagccgacggcggcggcgtggtgtacagcggcaccccctggaagagaagaaactacaaccagggcgtggtgggcctgcacgaggagatcagcgacttctacgagtacatgagccccagacccgaggaggagaagatgagaatggaggtggtgaacagaatcgagagcgtgatcaaggagctgtggcccagcgccgacgtgcagatcttcggcagcttcaagaccggcctgtacctgcccaccagcgacatcgacctggtggtgttcggcaagtgggagaacctgcccctgtggaccctggaggaggccctgagaaagcacaaggtggccgacgaggacagcgtgaaggtgctggacaaggccaccgtgcccatcatcaagctgaccgacagcttcaccgaggtgaaggtggacatcagcttcaacgtgcagaacggcgtgagagccgccgacctgatcaaggacttcaccaagaagtaccccgtgctgccctacctggtgctggtgctgaagcagttcctgctgcagagagacctgaacgaggtgttcaccggcggcatcggcagctacagcctgttcctgatggccgtgagcttcctgcagctgcaccccagagaggacgcctgcatccccaacaccaactacggcgtgctgctgatcgagttcttcgagctgtacggcagacacttcaactacctgaagaccggcatcagaatcaaggacggcggcagctacgtggccaaggacgaggtgcagaagaacatgctggacggctacagacccagcatgctgtacatcgaggaccccctgcagcccggcaacgacgtgggcagaagcagctacggcgccatgcaggtgaagcaggccttcgactacgcctacgtggtgctgagccacgccgtgagccccatcgccaagtactaccccaacaacgagaccgagagcatcctgggcagaatcatcagagtgaccgacgaggtggccacctacagagactggatcagcaagcagtggggcctgaagaacagacccgagcccagctgcaacggcaacggcgtgaccctgatcgtggacacccagcagctggacaagtgcaacaacaacctgagcgaggagaacgaggccctgggcaagtgcagaagcaagaccagcgagagcctgagcaagcacagcagcaacagcagcagcggccccgtgagcagcagcagcgccacccagagcagcagcagcgacgtggacagcgacgccaccccctgcaagacccccaagcagctgctgtgcagacccagcaccggcaacagagtgggcagccaggacgtgagcctggagagcagccaggccgtgggcaagatgcagagcacccagaccaccaacaccagcaacagcaccaacaagagccagcacggcagcgccagactgttcagaagcagcagcaagggcttccagggcaccacccagaccagccacggcagcctgatgaccaacaagcagcaccagggcaagagcaacaaccagtactaccacggcaagaagagaaagcacaagagagacgcccccctgagcgacctgtgcagatag

SEQ ID NO: 23039 - DNA, 522 bp, Artificial Sequence
  Description of Artificial Sequence: Synthetic coding sequence
atggacatcgagaaggtgaacagcatggacctgggcgagttcgtggacgtgttcggcaacgccaccgagagatgccccctgatcgccgccgccgtgtggagccagagacccttcagcgacctggaggacctggagaagcacttcttcgccttcatcgacgccctggcccagagcggccaggagggcatcctgagatgccaccccgacctggccggcagcgagctgcagagaggcaccctgaccgccgagagccagagagagcagagcggcgccggcctgagaagcctgggcgccgacgagagactgagactggccgagctgaacgcccagtacagagccagattcggcttccccttcgtgctggccgccagattcagcgacagaaccgccgtgcccagagagctggccagaagactgctgtgccccagcgcccaggagctgagaaccgccctgggcgaggtgaagaagatcggcagcctgagactggccgacctgctgagagccgaccccgccaagctgtag

SEQ ID NO: 23040 - DNA, 2022 bp, Artificial Sequence
  Description of Artificial Sequence: Synthetic coding sequence
atggccgagagcagcctgtacagacagagactggaggtgatcgccgagaagagaagactgcaggaggagatcagagccgccagaagagaggtggaggaggagaagctgagagtggagagactgaagagaaagagcctgagagagagatggctgatggacggcgccgccgccgtgcccgagcccagcgaggaccccaccagcaaggacccccagagccccgagggccaggcccaggccagaatcagaaacctggaggacagcctgttcaccctgcagagccagctgcagctgctgcagagcgccagcaccggcgcccagcacaagcccagcggcagacccagctggagaagacagggccacagacccctgagccagagcatcgtggaggccggcagcgtgggccagaccgacctgaacaagagagccagcctgcccgccggcctggtgggcaccccccccgagagccccagcgagcccagagaggacgtgctgggcttcctgcccggccccagacaggtgcccggcgccgccggcgacagcagcgaggccaacggcccctgccccagccccatccccacccccgagcagggcctgagccagagagccgtgcccagcgagggcagagtgggcgaggccaagggcggcggcgtggtgagcgtggtgtgggagggcctgagagccaccgaggactgcgccaccggcgccaccggccccgagctggaggccaaggtggaggaggtggtgctggaggccatcggcgacagaaagggcgccggcagcctggagctgcccgcctgggtgaaggaggacagaggcatcgtggaggtggtgtgggagggcgtgggcggcagcgacgccgaggccatgggcgagatcggcagagtgcccgaggtggtgcagaccagcagccccagactgcaggagagactggaggccgccgccagcatcgagggcgaggacgtgccccagggcagccccgagggcgacggccagggcggcagcggcggcgaggagggcagcttcatctgggtggagagagtgaccctgagcgaggagtgggaggagctgctggtggagggcctggagggccccgaggtggccggcagagagagaggcgacgagagccccctgggcgccgagggcgccaagaccggcggcggcgaggagacctgggaggccgagaagagaaaggccgaggagagcatgggcatcggcagcgaggagaagcccggcaccggcagagacgaggccgagatgagccccgtggtggagagaaagggcggcgagaagaagctggagctggagagcagaggcagcgccgagaagctgggcaccgagagagagggcggcgaggagcccctgggcatcgagagaaaggtggagggccacctgagagccgagaaggagggcgacgaggagaagagaggcgccgaggaggaggaggtggaggagcccctgggcgtggagaagaagggcggcgaggaggagcccgaggccaccaaggagcccctggaggccgagagaaagggcggcgaggagaccctggaggccgagaagagaggcggcgaggagagcctggagaccgagaagacccagggcaccgagggcgacctgaacctggagcagggcagcagagagggcagcgagagccaggccgaggagatgaacgaggccggcccccccctggaggccaacaccgagaccagacccgagaaggagggcccccagccccaggagaagcccgtgggcgccctggaggaggagggcgtgaagccccagaccgccgccgagggccagggccccctgggcgacgccacccccctgctggccgagacccccgcccccgagcagcccgccgagtgccagcccctgctgcagggcgagggccccagcgccaaccccagcgcccaccccgtgcccacctacgcccccgccagacagcccgagcccagcgcccccaccgagggcgaggaggccagcggccccaagcagaagacctgccagtgctgcgccgtgatgtag

SEQ ID NO: 23041 - DNA, 1347 bp, Artificial Sequence
  Description of Artificial Sequence: Synthetic coding sequence
atggccctgaccctgctggaggactggtgcaagggcatggacatggaccccagaaaggccctgctgatcgtgggcatccccatggagtgcagcgaggtggagatccaggacaccgtgaaggccggcctgcagcccctgtgcgcctacagagtgctgggcagaatgttcagaagagaggacaacgccaaggccgtgttcatcgagctggccgacaccgtgaactacaccaccctgcccagccacatccccggcaagggcggcagctgggaggtggtggtgaagcccagaaaccccgacgacgagttcctgagcagactgaactacttcctgaaggacgagggcagaagcatgaccgacgtggccagagccctgggctgctgcagcctgcccgccgagagcctggacgccgaggtgatgccccaggtgagaagcccccccctggagccccccaaggagagcatgtggtacagaaagctgaaggtgttcagcggcaccgccagccccagccccggcgaggagaccttcgaggactggctggagcaggtgaccgagatcatgcccatctggcaggtgagcgaggtggagaagagaagaagactgctggagagcctgagaggccccgccctgagcatcatgagagtgctgcaggccaacaacgacagcatcaccgtggagcagtgcctggacgccctgaagcagatcttcggcgacaaggaggacttcagagccagccagttcagattcctgcagaccagccccaagatcggcgagaaggtgagcaccttcctgctgagactggagcccctgctgcagaaggccgtgcacaagagccccctgagcgtgagaagcaccgacatgatcagactgaagcacctgctggccagagtggccatgacccccgccctgagaggcaagctggagctgctggaccagagaggctgcccccccaacttcctggagctgatgaagctgatcagagacgaggaggagtgggagaacaccgaggccgtgatgaagaacaaggagaagcccagcggcagaggcagaggcgccagcggcagacaggccagagccgaggccagcgtgagcgccccccaggccaccgtgcaggccagaagcttcagcgacagcagcccccagaccatccagggcggcctgccccccctggtgaagagaagaagactgctgggcagcgagagcaccagaggcgaggaccacggccaggccacctaccccaaggccgagaaccagacccccggcagagagggcccccaggccgccggcgaggagctgggcaacgaggccggcgccggcgccatgagccaccccaagccctgggagacctag

SEQ ID NO: 23042 - DNA, 423 bp, Artificial Sequence
  Description of Artificial Sequence: Synthetic coding sequence
atggccctgaccctgctggaggactggtgcaagggcatggacatggaccccagaaaggccctgctgatcgtgggcatccccatggagtgcagcgaggtggagatccaggacaccgtgaaggccggcctgcagcccctgtgcgcctacagagtgctgggcagaatgttcagaagagaggacaacgccaaggccgtgttcatcgagctggccgacaccgtgaactacaccaccctgcccagccacatccccggcaagggcggcagctgggaggtggtggtgaagcccagaaaccccgacgacgagttcctgagcagactgaactacttcctgaaggacgagggcagaagcatgaccgacgtggccagagccctgggctgctgcagcctgcccgccgagagcctggacgccgaggtgatgccctag

SEQ ID NO: 23043 - DNA, 1347 bp, Artificial Sequence; identical to SEQ ID NO: 23041
  Description of Artificial Sequence: Synthetic coding sequence

SEQ ID NO: 23044 - DNA, 1347 bp, Artificial Sequence; identical to SEQ ID NO: 23041
  Description of Artificial Sequence: Synthetic coding sequence

SEQ ID NO: 23045 - DNA, 1347 bp, Artificial Sequence; identical to SEQ ID NO: 23041
  Description of Artificial Sequence: Synthetic coding sequence

SEQ ID NO: 23046 - DNA, 1200 bp, Artificial Sequence
  Description of Artificial Sequence: Synthetic coding sequence
atggccgtgaccatgctgcaggactggtgcagatggatgggcgtgaacgccagaagaggcctgctgatcctgggcatccccgaggactgcgacgacgccgagttccaggagagcctggaggccgccctgagacccatgggccacttcaccgtgctgggcaaggtgttcagagaggaggacaacgccaccgccgccctggtggagctggacagagaggtgaactacgccctggtgcccagagagatccccggcaccggcggcccctggaacgtggtgttcgtgcccagatgcagcggcgaggagttcctgggcctgggcagagtgttccacttccccgagcaggagggccagatggtggagagcgtggccggcgccctgggcgtgggcctgagaagagtgtgctggctgagaagcatcggccaggccgtgcagccctgggtggaggccgtgagataccagagcctgggcgtgttcagcggcagagaccagcccgcccccggcgaggagagcttcgaggtgtggctggaccacaccaccgagatgctgcacgtgtggcagggcgtgagcgagagagagagaagaagaagactgctggagggcctgagaggcaccgccctgcagctggtgcacgccctgctggccgagaaccccgccagaaccgcccaggactgcctggccgccctggcccaggtgttcggcgacaacgagagccaggccaccatcagagtgaagtgcctgaccgcccagcagcagagcggcgagagactgagcgccttcgtgctgagactggaggtgctgctgcagaaggccatggagaaggaggccctggccagagccagcgccgacagagtgagactgagacagatgctgaccagagcccacctgaccgagcccctggacgaggccctgagaaagctgagaatggccggcagaagccccagcttcctggagatgctgggcctggtgagagagagcgaggcctgggaggccagcctggccagaagcgtgagagcccagacccaggagggcgccggcgccagagccggcgcccaggccgtggccagagccagcaccaaggtggaggccgtgcccggcggccccggcagagagcccgagggcctgagacaggccggcggccaggaggccgaggagctgctgcaggagggcctgaagcccgtgctggaggagtgcgacaactag

SEQ ID NO: 23047 - DNA, 1200 bp, Artificial Sequence; identical to SEQ ID NO: 23046
  Description of Artificial Sequence: Synthetic coding sequence

SEQ ID NO: 23048 - DNA, 1200 bp, Artificial Sequence; identical to SEQ ID NO: 23046
  Description of Artificial Sequence: Synthetic coding sequence

SEQ ID NO: 23049 - DNA, 1200 bp, Artificial Sequence
  Description of Artificial Sequence: Synthetic coding sequence
atggccgtgaccatgctgcaggactggtgcagatggatgggcgtgaacgccagaagaggcctgctgatcctgggcatccccgaggactgcgacgacgccgagttccaggagagcctggaggccgccctgagacccatgggccacttcaccgtgctgggcaaggccttcagagaggaggacaacgccaccgccgccctggtggagctggacagagaggtgaactacgccctggtgcccagagagatccccggcaccggcggcccctggaacgtggtgttcgtgcccagatgcagcggcgaggagttcctgggcctgggcagagtgttccacttccccgagcaggagggccagatggtggagagcgtggccggcgccctgggcgtgggcctgagaagagtgtgctggctgagaagcatcggccaggccgtgcagccctgggtggaggccgtgagatgccagagcctgggcgtgttcagcggcagagaccagcccgcccccggcgaggagagcttcgaggtgtggctggaccacaccaccgagatgctgcacgtgtggcagggcgtgagcgagagagagagaagaagaagactgctggagggcctgagaggcaccgccctgcagctggtgcacgccctgctggccgagaaccccgccagaaccgcccaggactgcctggccgccctggcccaggtgttcggcgacaacgagagccaggccaccatcagagtgaagtgcctgaccgcccagcagcagagcggcgagagactgagcgccttcgtgctgagactggaggtgctgctgcagaaggccatggagaaggaggccctggccagagccagcgccgacagagtgagactgagacagatgctgaccagagcccacctgaccgagcccctggacgaggccctgagaaagctgagaatggccggcagaagccccagcttcctggagatgctgggcctggtgagagagagcgaggcctgggaggccagcctggccagaagcgtgagagcccagacccaggagggcgccggcgccagagccggcgcccaggccgtggccagagccagcaccaaggtggaggccgtgcccggcggccccggcagagagcccgagggcctgctgcaggccggcggccaggaggccgaggagctgctgcaggagggcctgaagcccgtgctggaggagtgcgacaactag

SEQ ID NO: 23050 - DNA, 1200 bp, Artificial Sequence; identical to SEQ ID NO: 23049
  Description of Artificial Sequence: Synthetic coding sequence

SEQ ID NO: 23051 - DNA, 1347 bp, Artificial Sequence; identical to SEQ ID NO: 23041
  Description of Artificial Sequence: Synthetic coding sequence

SEQ ID NO: 23052 - DNA, 1347 bp, Artificial Sequence; identical to SEQ ID NO: 23041
  Description of Artificial Sequence: Synthetic coding sequence

SEQ ID NO: 23053 - DNA, 1347 bp, Artificial Sequence; identical to SEQ ID NO: 23041
  Description of Artificial Sequence: Synthetic coding sequence

SEQ ID NO: 23054 - DNA, 1347 bp, Artificial Sequence; identical to SEQ ID NO: 23041
  Description of Artificial Sequence: Synthetic coding sequence

SEQ ID NO: 23055 - DNA, 1908 bp, Artificial Sequence
  Description of Artificial Sequence: Synthetic coding sequence
atggccatgagcctgctgcaggactggtgcagaagcctggacgtggacgcccacagagccctgctggtgaccggcatccccgagggcctggagcaggccgacgtggaggccgtgctgcagcccaccctgctgcccctgggcaccttcagactgagacacatgaaggccctgatgaacgagaaggcccaggccgccctggtggagttcgtggaggacgtgaaccacgccgccatccccagagagatccccggcaaggacggcgtgtggagagtgctgtggaaggacagagcccaggacaccagagtgctgagacagatgagaagactgctgctggacgacggccccacccaggccgccgaggccggcacccccggcgaggcccccaccccccccgccagcgagacccaggcccaggacagcggcgaggtgaccggccaggccggcagcctgctgggcgccgccagaaaccccagaagaggcagaagaggcagaagaaacagaaccagaagaaacagactgacccagaagggcaagaagagaagcagaggcggcagacccagcgcccccgccagaagcgaggccgaggacagcagcgacgagagcctgggcatcgtgatcgaggagatcgaccagggcgacctgagcggcgaggaggaccagagcgccctgtacgccaccctgcaggccgccgccagagagctggtgagacagtgggccccctgcaacagcgagggcgaggaggacggccccagagagttcctggccctggtgaccgtgaccgacaagagcaagaaggaggaggccgagaaggagcccgccggcgccgagagcatcagactgaacaccaaggaggacaagaacggcgtgcccgacctggtggccctgctggccgtgagagacacccccgacgaggagcccgtggacagcgacaccagcgagagcgacagccaggagagcggcgaccaggagaccgaggagctggacaaccccgagttcgtggccatcgtggcctacaccgaccccagcgacccctgggccagagaggagatgctgaagatcgccagcgtgatcgagagcctgggctggagcgacgagaaggacaagagagaccccctgagacaggtgctgagcgtgatgagcaaggacaccaacggcaccagagtgaaggtggaggaggccggcagagaggtggacgccgtggtgctgagaaaggccggcgacgacggcgacctgagagagtgcatcagcaccctggcccagcccgacctgcccccccaggccaagaaggccggcagaggcctgttcggcggctggagcgagcacagagaggacgagggcggcctgctggagctggtggccctgctggccgcccaggacatggccgaggtgatgaaggaggagaaggagaacgcctgggagggcggcaagtacaagtaccccaagggcaagctgggcgaggtgctggccctgctggccgccagagagaacatgggcagcaacgagggcagcgaggaggccagcgacgagcagagcgaggaggagagcgaggacaccgagagcgaggccagcgagcccgaggacagagccagcagaaagcccagagccaagagagccagaaccgcccccagaggcctgacccccgccggcgccccccccaccgccagcggcgccagaaagaccagagccggcggcagaggcagaggcagaggcgtgacccccgagaagaaggccggcagcagaggcagcgcccaggacgacgccgccggcagcagaaagaagaagggcagcgccggcgccggcgcccacgccagagccggcgaggccaagggccaggcccccaccggcagcaaggccgccagaggcaagaaggccagaagaggcagaagactgccccccaagtgcagatag

SEQ ID NO: 23056 - DNA, 666 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagcaagggcggcatcccctgcagactggtgcacggcagcgtgaagcacagactgcagtgggagtgcccccccgagagcctgagcttcgaccccctgctgatcaccctggccgagggcctgagagagaccaagcacccctacaccttcgtgagcaaggagggcttcagagagctgctgctggtgaagggcgcccccgagaaggccatccccctgctgcccagactgatccccgtgctgaaggccgccctggtgcacagcgacgacgaggtgttcgagagaggcctgaacgccctggtgcagctgagcgtggtggtgggccccagcctgaacgaccacctgaagcacctgctgaccagcggcagcctgagcatcatcaagagcaagatccccacctactgcagcatctgctgctag

SEQ ID NO: 23057 - DNA, 666 bp, Artificial Sequence; identical to SEQ ID NO: 23056
  Description of Artificial Sequence: Synthetic coding sequence

SEQ ID NO: 23058 - DNA, 747 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagcaagggcggcatcccctgcagactggtgcacggcagcgtgaagcacagactgcagtgggagtgcccccccgagagcctgagcttcgaccccctgctgatcaccctggccgagggcctgagagagaccaagcacccctacaccttcgtgagcaaggagggcttcagagagctgctgctggtgaagggcgcccccgagaaggccatccccctgctgcccagactgatccccgtgctgaaggccgccctggtgcacagcgacgacgaggtgttcgagagaggcctgaacgccctggtgcagctgagcgtggtggtgggccccagcctgaacgaccacctgaagcacctgctgaccagcctgagcaagagactgatggacaagaagttcaaggagcccatcaccagcgccctgcagaagctggagcagcacggcggcagcggcagcctgagcatcatcaagagcaagatccccacctactgcagcatctgctgctag

SEQ ID NO: 23059 - DNA, 276 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagcaagggcggcatcccctgctag

SEQ ID NO: 23060 - DNA, 258 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagctag

SEQ ID NO: 23061 - DNA, 666 bp, Artificial Sequence; identical to SEQ ID NO: 23056
  Description of Artificial Sequence: Synthetic coding sequence

SEQ ID NO: 23062 - DNA, 411 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagcaagggcggcatcccctgcagactggtgcacggcagcgtgaagcacagactgcagtgggagtgcccccccgagagcctgagcttcgaccccctgctgatcaccctggccgagggcctgagagagaccaagcacccctacaccttcgtgagcaagtag

SEQ ID NO: 23063 - DNA, 612 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagcaagggcggcatcccctgcagactggtgcacggcagcgtgaagcacagactgcagtgggagtgcccccccgagagcctgagcttcgaccccctgctgatcaccctggccgagggcctgagagagaccaagcacccctacaccttcgtgagcaaggagggcttcagagagctgctgctggtgaagggcgcccccgagaaggccatccccctgctgcccagactgatccccgtgctgaaggccgccctggtgcacagcgacgacgaggtgttcgagagaggcctgaacgccctggtgcagctgagcgtggtggtgggccccagcctgaacgaccacctgaagcacctgctgaccagctag

SEQ ID NO: 23064 - DNA, 369 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagcaagggcggcatcccctgcagactggtgcacggcagcgtgaagcacagactgcagtgggagtgcccccccgagagcctgagcttcgaccccctgctgatcaccctggccgagtag

SEQ ID NO: 23065 - DNA, 309 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccttcggcgagcagagcagagtgcccagcgccttcgccgccatctacagcaagggcggcatcccctgcagactggtgcacggcagcgtgaagcacagactgtag

SEQ ID NO: 23066 - DNA, 372 bp, Artificial Sequence
  Description of Artificial Sequence: Synthetic coding sequence
atgcagaagagcgagggcagcggcggcacccagctgaagaacagagccaccggcaactacgaccagagaaccagcagcagcacccagctgaagcacagaaacgccgtgcagggcagcaagagcagcctgagcaccagcagccccgagagcgccagaaagctgcaccccagacccagcgacaagctgaaccccaagaccatcaaccccgtgcacagcgacgacgaggtgttcgagagaggcctgaacgccctggtgcagctgagcgtggtggtgggccccagcctgaacgaccacctgaagcacctgctgaccagcggcagcctgagcatcatcaagagcaagatccccacctactgcagcatctgctgctag

SEQ ID NO: 23067 - DNA, 372 bp, Artificial Sequence; identical to SEQ ID NO: 23066
  Description of Artificial Sequence: Synthetic coding sequence

SEQ ID NO: 23068 - DNA, 762 bp, Artificial Sequence
  Description of Artificial Sequence: Synthetic coding sequence
atgaagcacatcaacctgagcttcgccgcctgcggcttcctgggcatctaccacctgggcgccgccagcgccctgtgcagacacggcaagaagctggtgaaggacgtgaaggccttcgccggcgccagcgccggcagcctggtggccagcgtgctgctgaccgcccccgagaagatcgaggagtgcaaccagttcacctacaagttcgccgaggagatcagaagacagagcttcggcgccgtgacccccggctacgacttcatggccagactgagaagcggcatggagagcatcctgccccccagcgcccacgagctggcccagaacagactgcacgtgagcatcaccaacgccaagaccagagagaaccacctggtgagcaccttcagcagcagagaggacctgatcaaggtgctgctggccagcagcttcgtgcccatctacgccggcctgaagctggtggagtacaagggccagaagtgggtggacggcggcctgaccaacgccctgcccatcctgcccgtgggcagaaccgtgaccatcagccccttcagcggcagactggacatcagcccccaggacaagggccagctggacctgtacgtgaacatcgccaagcaggacatcatgctgagcctggccaacctggtgagactgaaccaggccctgttcccccccagcaagagaaagatggagagcctgtaccagtgcggcttcgacgacaccgtgaagttcctgctgaaggagaactggttcgagtag

SEQ ID NO: 23069 - DNA, 573 bp, Artificial Sequence
  Description of Artificial Sequence: Synthetic coding sequence
atgaagcacatcaacctgagcttcgccgcctgcggcttcctgggcatctaccacctgggcgccgccagcgccctgtgcagacacggcaagaagctggtgaaggacgtgaaggccttcgccggcgccagcgccggcagcctggtggccagcgtgctgctgaccgcccccgagaagatcgaggagtgcaaccagttcacctacaagttcgccgaggagatcagaagacagagcttcggcgccgtgacccccggctacgacttcatggccagactgagaagcggcatggagagcatcctgccccccagcgcccacgagctggcccagaacagactgcacgtgagcatcaccaacgccaagaccagagagaaccacctggtgagcaccttcagcagcagagaggacctgatcaaggtgctgctggccagcagcttcgtgcccatctacgccggcctgaagctggtggagtacaagggccagaagtgggtggacggcggcctgaccaacgccctgcccatcctgcccgtgggcagaaccgtgaccatcagccccttcagcggcagactggacatctag

SEQ ID NO: 23070 - DNA, 762 bp, Artificial Sequence; identical to SEQ ID NO: 23068
  Description of Artificial Sequence: Synthetic coding sequence

SEQ ID NO: 23071 - DNA, 501 bp, Artificial Sequence
  Description of Artificial Sequence: Synthetic coding sequence
atggccagactgagaagcggcatggagagcatcctgccccccagcgcccacgagctggcccagaacagactgcacgtgagcatcaccaacgccaagaccagagagaaccacctggtgagcaccttcagcagcagagaggacctgatcaaggtgctgctggccagcagcttcgtgcccatctacgccggcctgaagctggtggagtacaagggccagaagtgggtggacggcggcctgaccaacgccctgcccatcctgcccgtgggcagaaccgtgaccatcagccccttcagcggcagactggacatcagcccccaggacaagggccagctggacctgtacgtgaacatcgccaagcaggacatcatgctgagcctggccaacctggtgagactgaaccaggccctgttcccccccagcaagagaaagatggagagcctgtaccagtgcggcttcgacgacaccgtgaagttcctgctgaaggagaactggttcgagtag

SEQ ID NO: 23072 - DNA, 969 bp, Artificial Sequence
  Description of Artificial Sequence: Synthetic coding sequence
atggagggcatcagcaacttcaagacccccagcaagctgagcgagaagaagaagagcgtgctgtgcagcacccccaccatcaacatccccgccagccccttcatgcagaagctgggcttcggcaccggcgtgaacgtgtacctgatgaagagaagccccagaggcctgagccacagcccctgggccgtgaagaagatcaaccccatctgcaacgaccactacagaagcgtgtaccagaagagactgatggacgaggccaagatcctgaagagcctgcaccaccccaacatcgtgggctacagagccttcaccgaggccaacgacggcagcctgtgcctggccatggagtacggcggcgagaagagcctgaacgacctgatcgaggagagatacaaggccagccaggaccccttccccgccgccatcatcctgaaggtggccctgaacatggccagaggcctgaagtacctgcaccaggagaagaagctgctgcacggcgacatcaagagcagcaacgtggtgatcaagggcgacttcgagaccatcaagatctgcgacgtgggcgtgagcctgcccctggacgagaacatgaccgtgaccgaccccgaggcctgctacatcggcaccgagccctggaagcccaaggaggccgtggaggagaacggcgtgatcaccgacaaggccgacatcttcgccttcggcctgaccctgtgggagatgatgaccctgagcatcccccacatcaacctgagcaacgacgacgacgacgaggacaagaccttcgacgagagcgacttcgacgacgaggcctactacgccgccctgggcaccagaccccccatcaacatggaggagctggacgagagctaccagaaggtgatcgagctgttcagcgtgtgcaccaacgaggaccccaaggacagacccagcgccgcccacatcgtggaggccctggagaccgacgtgtag

SEQ ID NO: 23073 - DNA, 1560 bp, Artificial Sequence
  Description of Artificial Sequence: Synthetic coding sequence
atgaccagcaccttcaaccccagagagtgcaagctgagcaagcaggagggccagaactacggcttcttcctgagaatcgagaaggacaccgagggccacctggtgagagtggtggagaagtgcagccccgccgagaaggccggcctgcaggacggcgacagagtgctgagaatcaacggcgtgttcgtggacaaggaggagcacatgcaggtggtggacctggtgagaaagagcggcaacagcgtgaccctgctggtgctggacggcgacagctacgagaaggccgtgaagaccagagtggacctgaaggagctgggccagagccagaaggagcagggcctgagcgacaacatcctgagccccgtgatgaacggcggcgtgcagacctggacccagcccagactgtgctacctggtgaaggagggcggcagctacggcttcagcctgaagaccgtgcagggcaagaagggcgtgtacatgaccgacatcaccccccagggcgtggccatgagagccggcgtgctggccgacgaccacctgatcgaggtgaacggcgagaacgtggaggacgccagccacgaggaggtggtggagaaggtgaagaagagcggcagcagagtgatgttcctgctggtggacaaggagaccgacaagagacacgtggagcagaagatccagttcaagagagagaccgccagcctgaagctgctgccccaccagcccagaatcgtggagatgaagaagggcagcaacggctacggcttctacctgagagccggcagcgagcagaagggccagatcatcaaggacatcgacagcggcagccccgccgaggaggccggcctgaagaacaacgacctggtggtggccgtgaacggcgagagcgtggagaccctggaccacgacagcgtggtggagatgatcagaaagggcggcgaccagaccagcctgctggtggtggacaaggagaccgacaacatgtacagactggcccacttcagccccttcctgtactaccagagccaggagctgcccaacggcagcgtgaaggaggcccccgcccccacccccaccagcctggaggtgagcagcccccccgacaccaccgaggaggtggaccacaagcccaagctgtgcagactggccaagggcgagaacggctacggcttccacctgaacgccatcagaggcctgcccggcagcttcatcaaggaggtgcagaagggcggccccgccgacctggccggcctggaggacgaggacgtgatcatcgaggtgaacggcgtgaacgtgctggacgagccctacgagaaggtggtggacagaatccagagcagcggcaagaacgtgaccctgctggtgtgcggcaagaaggcctacgactacttccaggccaagaagatccccatcgtgagcagcctggccgaccccctggacaccccccccgacagcaaggagggcatcgtggtggagagcaaccacgacagccacatggccaaggagagagcccacagcaccgccagccacagcagcagcaacagcgaggacaccgagatgtag

SEQ ID NO: 23074 - DNA, 1560 bp, Artificial Sequence; identical to SEQ ID NO: 23073
  Description of Artificial Sequence: Synthetic coding sequence

SEQ ID NO: 23075 - DNA, 609 bp, Artificial Sequence
  Description of Artificial Sequence: Synthetic coding sequence
atggccgagggcgaggaggagggcggcgacgtgctgatcagcgtgggccacgccaacgtgctgggctacaccctgagagagttcctgcagctgctgcagcacatcaccatcggcaccgtgctgcagatcaaggtgtacagagacttcatcaacatccccgaggagtggcaggagatctacgacctgatccccgaggccaagttccccgtgaccagcacccccaagaagatcgagctggccaaggacgagagcttcaccagcagcgacgacaacgagaacgtggacctggacaagagactgcagtactacagatacccctggagcaccgtgcaccaccccgccagaagacccatcagcatcagcagagactggcacggctacaagaagaagaaccacaccatcagcgtgggcaaggacatcaactgcgacgtgatgatccacagagacgacaagaaggaggtgagagcccccagcccctactggatcatggtgaagcaggacaacgagagcagcagcagcagcaccagcagcaccagcgacgccttctggctggaggactgcgcccaggtggaggagggcaaggcccagctggtgagcaaggtgggctag

SEQ ID NO: 23076 - DNA, 795 bp, Artificial Sequence
  Description of Artificial Sequence: Synthetic coding sequence
atgcagaaggccagccacaagaacaagaaggagagaggcgtgagcaacaaggtgaagaccagcgtgcacaacctgagcaagacccagcagaccaagctgaccgtgggcagcctgggcctgggcctgatcatcatccagcacggcccctacctgcagatcacccacctgatcagaaagggcgccgccgccaacgacggcaagctgcagcccggcgacgtgctgatcagcgtgggccacgccaacgtgctgggctacaccctgagagagttcctgcagctgctgcagcacatcaccatcggcaccgtgctgcagatcaaggtgtacagagacttcatcaacatccccgaggagtggcaggagatctacgacctgatccccgaggccaagttccccgtgaccagcacccccaagaagatcgagctggccaaggacgagagcttcaccagcagcgacgacaacgagaacgtggacctggacaagagactgcagtactacagatacccctggagcaccgtgcaccaccccgccagaagacccatcagcatcagcagagactggcacggctacaagaagaagaaccacaccatcagcgtgggcaaggacatcaactgcgacgtgatgatccacagagacgacaagaaggaggtgagagcccccagcccctactggatcatggtgaagcaggacaacgagagcagcagcagcagcaccagcagcaccagcgacgccttctggctggaggactgcgcccaggtggaggagggcaaggcccagctggtgagcaaggtgggctag

SEQ ID NO: 23077 - DNA, 615 bp, Artificial Sequence
  Description of Artificial Sequence: Synthetic coding sequence
atgcagaaggccagccacaagaacaagaagggcgacgtgctgatcagcgtgggccacgccaacgtgctgggctacaccctgagagagttcctgcagctgctgcagcacatcaccatcggcaccgtgctgcagatcaaggtgtacagagacttcatcaacatccccgaggagtggcaggagatctacgacctgatccccgaggccaagttccccgtgaccagcacccccaagaagatcgagctggccaaggacgagagcttcaccagcagcgacgacaacgagaacgtggacctggacaagagactgcagtactacagatacccctggagcaccgtgcaccaccccgccagaagacccatcagcatcagcagagactggcacggctacaagaagaagaaccacaccatcagcgtgggcaaggacatcaactgcgacgtgatgatccacagagacgacaagaaggaggtgagagcccccagcccctactggatcatggtgaagcaggacaacgagagcagcagcagcagcaccagcagcaccagcgacgccttctggctggaggactgcgcccaggtggaggagggcaaggcccagctggtgagcaaggtgggctag

SEQ ID NO: 23078 - DNA, 2103 bp, Artificial Sequence
  Description of Artificial Sequence: Synthetic coding sequence
atggacttcgtgagactggccagactgttcgccagagccagacccatgggcctgttcatcctgcagcacctggacccctgcagagccagatgggccggcggcagagagggcctgatgagacccatgtgggcccccttcagcagcagcagcagccagctgcccctgggccaggagagacaggagaacaccggcagcctgggcagcgaccccagccacagcaacagcaccgccacccaggaggaggacgaggaggaggaggagagcttcggcaccctgagcgacaagtacagcagcagaagactgttcagaaagagcgccgcccagttccacaacctgagattcggcgagagaagagacgagcagatggagcccgagcccaagctgtggagaggcagaagaaacaccccctactggtacttcctgcagtgcaagcacctgatcaaggagggcaagctggtggaggccctggacctgttcgagagacagatgctgaaggaggagagactgcagcccatggagagcaactacaccgtgctgatcggcggctgcggcagagtgggctacctgaagaaggccttcaacctgtacaaccagatgaagaagagagacctggagcccagcgacgccacctacaccgccctgttcaacgtgtgcgccgagagcccctggaaggacagcgccctgcagagcgccctgaagctgagacagcagctgcaggccaagaacttcgagctgaacctgaagacctaccacgccctgctgaagatggccgccaagtgcgccgacctgagaatgtgcctggacgtgttcaaggagatcatccacaagggccacgtggtgaccgaggagaccttcagcttcctgctgatgggctgcatccaggacaagaagaccggcttcagatacgccctgcaggtgtggagactgatgctgagcctgggcctgcagcccagcagagacagctacaacctgctgctggtggccgccagagactgcggcctgggcgacccccaggtggccagcgagctgctgctgaagcccagagaggaggccaccgtgctgcagccccccgtgagcagacagagacccagaagaaccgcccaggccaaggccggcaacctgatgagcgccatgctgcacgtggaggccctggagagacagctgttcctggagcccagccaggccctgggcccccccgagccccccgaggccagagtgcccggcaaggcccagcccgaggtggacaccaaggccgagcccagccacaccgccgccctgaccgccgtggccctgaagcccccccccgtggagctggaggtgaacctgctgacccccggcgccgtgccccccaccgtggtgagcttcggcaccgtgaccacccccgccgacagactggccctgatcggcggcctggagggcttcctgagcaagatggccgagcacagacagcagcccgacatcagaaccctgaccctgctggccgaggtggtggagagcggcagccccgccgagagcctgctgctggccctgctggacgagcaccaggtggaggccgacctgaccttcttcaacaccctggtgagaaagaagagcaagctgggcgacctggagggcgccaaggccctgctgcccgtgctggccaagagaggcctggtgcccaacctgcagaccttctgcaacctggccatcggctgccacagacccaaggacggcctgcagctgctgaccgacatgaagaagagccaggtgacccccaacacccacatctacagcgccctgatcaacgccgccatcagaaagctgaactacacctacctgatcagcatcctgaaggacatgaagcagaacagagtgcccgtgaacgaggtggtgatcagacagctggagttcgccgcccagtacccccccaccttcgacagataccagggcaagaacacctacctggagaagatcgacggcttcagagcctactacaagcagtggctgaccgtgatgcccgccgaggagaccccccacccctggcagaagttcagaaccaagccccagggcgaccaggacaccggcaaggaggccgacgacggctgcgccctgggcggcagatag

SEQ ID NO: 23079 - DNA, 321 bp, Artificial Sequence
  Description of Artificial Sequence: Synthetic coding sequence
atggacttcgtgagactggccagactgttcgccagagccagacccatgggcctgttcatcctgcagcacctggacccctgcagagccagatgggccggcggcagagagggcctgatgagacccatgtgggcccccttcagcagcagcagcagccagctgcccctgggccaggagagacaggagaacaccggcagcctgggcagcgaccccagccacagcaacagcaccgccacccaggaggaggacgaggaggaggaggagagcttcggcaccctgagcgacaagtacagcagcagaagactgttcagaaagagcgcctag

SEQ ID NO: 23080 - DNA, 435 bp, Artificial Sequence
  Description of Artificial Sequence: Synthetic coding sequence
atggacttcgtgagactggccagactgttcgccagagccagacccatgggcctgttcatcctgcagcacctggacccctgcagagccagatgggccggcggcagagagggcctgatgagacccatgtgggcccccttcagcagcagcagcagccagctgcccctgggccaggagagacaggagaacaccggcagcctgggcagcgaccccagccacagcaacagcaccgccacccaggaggaggacgaggaggaggaggagagcttcggcaccctgagcgacaagtacagcagcagaagactgttcagaaagagcgccgcccagttccacaacctgagattcggcgagagaagagacgagcagatggagcccgagcccaagctgtggagaggcagaagaaacaccccctactggtacttcctgcagtgcaagtag

SEQ ID NO: 23081 - DNA, 495 bp, Artificial Sequence
  Description of Artificial Sequence: Synthetic coding sequence
atggacttcgtgagactggccagactgttcgccagagccagacccatgggcctgttcatcctgcagcacctggacccctgcagagccagatgggccggcggcagagagggcctgatgagacccatgtgggcccccttcagcagcagcagcagccagctgcccctgggccaggagagacaggagaacaccggcagcctgggcagcgaccccagccacagcaacagcaccgccacccaggaggaggacgaggaggaggaggagagcttcggcaccctgagcgacaagtacagcagcagaagactgttcagaaagagcgccgcccagttccacaacctgagattcggcgagagaagagacgagcagatggagcccgagcccaagctgtggagaggcagaagaaacaccccctactggtacttcctgcagtgcaagcacctgatcaaggagggcaagctggtggaggccctggacctgttcgagagacagatgctgtag

SEQ ID NO: 23082 - DNA, 213 bp, Artificial Sequence
  Description of Artificial Sequence: Synthetic coding sequence
atggacttcgtgagactggccagactgttcgccagagccagacccatgggcctgttcatcctgcagcacctggacccctgcagagccagatgggccggcggcagagagggcctgatgagacccatgtgggcccccttcagcagcagcagcagccagctgcccctgggccaggagagacaggagaacaccggcagcctgggcagcgacccctag

SEQ ID NO: 23083 - DNA, 1449 bp, Artificial Sequence
  Description of Artificial Sequence: Synthetic coding sequence
agaaagagactggtgagaagaggcgacagagccggcctgcccgtgggcgtgcaccagctgcaggccaagaacttcgagctgaacctgaagacctaccacgccctgctgaagatggccgccaagtgcgccgacctgagaatgtgcctggacgtgttcaaggagatcatccacaagggccacgtggtgaccgaggagaccttcagcttcctgctgatgggctgcatccaggacaagaagaccggcttcagatacgccctgcaggtgtggagactgatgctgagcctgggcctgcagcccagcagagacagctacaacctgctgctggtggccgccagagactgcggcctgggcgacccccaggtggccagcgagctgctgctgaagcccagagaggaggccaccgtgctgcagccccccgtgagcagacagagacccagaagaaccgcccaggccaaggccggcaacctgatgagcgccatgctgcacgtggaggccctggagagacagctgttcctggagcccagccaggccctgggcccccccgagccccccgaggccagagtgcccggcaaggcccagcccgaggtggacaccaaggccgagcccagccacaccgccgccctgaccgccgtggccctgaagcccccccccgtggagctggaggtgaacctgctgacccccggcgccgtgccccccaccgtggtgagcttcggcaccgtgaccacccccgccgacagactggccctgatcggcggcctggagggcttcctgagcaagatggccgagcacagacagcagcccgacatcagaaccctgaccctgctggccgaggtggtggagagcggcagccccgccgagagcctgctgctggccctgctggacgagcaccaggtggaggccgacctgaccttcttcaacaccctggtgagaaagaagagcaagctgggcgacctggagggcgccaaggccctgctgcccgtgctggccaagagaggcctggtgcccaacctgcagaccttctgcaacctggccatcggctgccacagacccaaggacggcctgcagctgctgaccgacatgaagaagagccaggtgacccccaacacccacatctacagcgccctgatcaacgccgccatcagaaagctgaactacacctacctgatcagcatcctgaaggacatgaagcagaacagagtgcccgtgaacgaggtggtgatcagacagctggagttcgccgcccagtacccccccaccttcgacagataccagggcaagaacacctacctggagaagatcgacggcttcagagcctactacaagcagtggctgaccgtgatgcccgccgaggagaccccccacccctggcagaagttcagaaccaagccccagggcgaccaggacaccggcaaggaggccgacgacggctgcgccctgggcggcagatag

SEQ ID NO: 23084 - DNA, 2250 bp, Artificial Sequence
  Description of Artificial Sequence: Synthetic coding sequence
atggccagcgtggtgcccgtgaaggacaagaagctgctggaggtgaagctgggcgagctgcccagctggatcctgatgagagacttcagccccagcggcatcttcggcgccttccagagaggccccggcggcaccggcaagcccgagatggacttcgtgagactggccagactgttcgccagagccagacccatgggcctgttcatcctgcagcacctggacccctgcagagccagatgggccggcggcagagagggcctgatgagacccatgtgggcccccttcagcagcagcagcagccagctgcccctgggccaggagagacaggagaacaccggcagcctgggcagcgaccccagccacagcaacagcaccgccacccaggaggaggacgaggaggaggaggagagcttcggcaccctgagcgacaagtacagcagcagaagactgttcagaaagagcgccgcccagttccacaacctgagattcggcgagagaagagacgagcagatggagcccgagcccaagctgtggagaggcagaagaaacaccccctactggtacttcctgcagtgcaagcacctgatcaaggagggcaagctggtggaggccctggacctgttcgagagacagatgctgaaggaggagagactgcagcccatggagagcaactacaccgtgctgatcggcggctgcggcagagtgggctacctgaagaaggccttcaacctgtacaaccagatgaagaagagagacctggagcccagcgacgccacctacaccgccctgttcaacgtgtgcgccgagagcccctggaaggacagcgccctgcagagcgccctgaagctgagacagcagctgcaggccaagaacttcgagctgaacctgaagacctaccacgccctgctgaagatggccgccaagtgcgccgacctgagaatgtgcctggacgtgttcaaggagatcatccacaagggccacgtggtgaccgaggagaccttcagcttcctgctgatgggctgcatccaggacaagaagaccggcttcagatacgccctgcaggtgtggagactgatgctgagcctgggcctgcagcccagcagagacagctacaacctgctgctggtggccgccagagactgcggcctgggcgacccccaggtggccagcgagctgctgctgaagcccagagaggaggccaccgtgctgcagccccccgtgagcagacagagacccagaagaaccgcccaggccaaggccggcaacctgatgagcgccatgctgcacgtggaggccctggagagacagctgttcctggagcccagccaggccctgggcccccccgagccccccgaggccagagtgcccggcaaggcccagcccgaggtggacaccaaggccgagcccagccacaccgccgccctgaccgccgtggccctgaagcccccccccgtggagctggaggtgaacctgctgacccccggcgccgtgccccccaccgtggtgagcttcggcaccgtgaccacccccgccgacagactggccctgatcggcggcctggagggcttcctgagcaagatggccgagcacagacagcagcccgacatcagaaccctgaccctgctggccgaggtggtggagagcggcagccccgccgagagcctgctgctggccctgctggacgagcaccaggtggaggccgacctgaccttcttcaacaccctggtgagaaagaagagcaagctgggcgacctggagggcgccaaggccctgctgcccgtgctggccaagagaggcctggtgcccaacctgcagaccttctgcaacctggccatcggctgccacagacccaaggacggcctgcagctgctgaccgacatgaagaagagccaggtgacccccaacacccacatctacagcgccctgatcaacgccgccatcagaaagctgaactacacctacctgatcagcatcctgaaggacatgaagcagaacagagtgcccgtgaacgaggtggtgatcagacagctggagttcgccgcccagtacccccccaccttcgacagataccagggcaagaacacctacctggagaagatcgacggcttcagagcctactacaagcagtggctgaccgtgatgcccgccgaggagaccccccacccctggcagaagttcagaaccaagccccagggcgaccaggacaccggcaaggaggccgacgacggctgcgccctgggcggcagatag

SEQ ID NO: 23085 - DNA, 1311 bp, Artificial Sequence
  Description of Artificial Sequence: Synthetic coding sequence
atgagacccggcggcgagagacccgtggagggcggcgcctgcaacggcagaagcgagctggagctgctgaagctgagaagcgccgagtgcatcgacgaggccgccgagagactgggcgccctgagcagagccatctggagccagcccgagctggcctacgaggagcaccacgcccacagagtgctgacccacttcttcgagagagagccccccgccgccagctgggccgtgcagccccactaccagctgcccaccgccttcagagccgagtgggagccccccgaggccagagcccccagcgccacccccagacccctgcacctgggcttcctgtgcgagtacgacgccctgcccggcatcggccacgcctgcggccacaacctgatcgccgaggtgggcgccgccgccgccctgggcgtgagaggcgccctggagggcctgcccagaccccccccccccgtgaaggtggtggtgctgggcacccccgccgaggaggacggcggcggcaagatcgacctgatcgaggccggcgccttcaccaacctggacgtggtgttcatggcccaccccagccaggagaacgccgcctacctgcccgacatggccgagcacgacgtgaccgtgaagtactacggcaaggccagccacagcgccagctacccctgggagggcctgaacgccctggacgccgccgtgctggcctacaacaacctgagcgtgttcagacagcagatgaagcccacctggagagtgcacggcatcatcaagaacggcggcgtgaagcccaacatcatccccagctacagcgagctgatctactacttcagagcccccagcatgaaggagctgcaggtgctgaccaagaaggccgaggactgcttcagagccgccgccctggccagcggctgcaccgtggagatcaagggcggcgcccacgactactacaacgtgctgcccaacaagagcctgtggaaggcctacatggagaacggcagaaagctgggcatcgagttcatcagcgaggacaccatgctgaacggccccagcggcagcaccgacttcggcaacgtgagcttcgtggtgcccggcatccacccctacttccacatcggcagcaacgccctgaaccacaccgagcagtacaccgaggccgccggcagccaggaggcccagttctacaccctgagaaccgccaaggccctggccatgaccgccctggacgtgatcttcaagcccgagctgctggagggcatcagagaggacttcaagctgaagctgcaggaggagcagttcgtgaacgccgtggagtag

SEQ ID NO: 23086 - DNA, 840 bp, Artificial Sequence
  Description of Artificial Sequence: Synthetic coding sequence
atggccagaccccagccctgcggccccccccacgccagatgcggcagccccagcctgcccgagagacccctgcaggtgaaggtggtgggcctgttcagctgccccaacttccagatcgccaagagcgccgccgaggagctgaagaacgagacctgggagtacagcagcagcgtgatcagcttcgtgaacggccagttcctgggcgacgccctggacctgcagaagtgggcccacgaggtgtgggacatcgtggacatcaagcccagcgccctgtacgacgccctgaccgaggacttcagcgccaagttcctgagagacaccaagcacgacttcgtgttcctggacatctgcatcgacagcagccccatcggcagactgatcttcgagctgtactgcgacgtgtgccccaagacctgcaagaacttccaggtgctgtgcaccggcaaggccggcttcagccagagaggcatcagactgcactacaagaacagcatcttccacagaatcgtgcagaacggctggatccagggcggcgacatcgtgtacggcaagggcgacaacggcgagagcatctacggccccaccttcgaggacgagaacttcagcgtgccccacaacaagagaggcgtgctgggcatggccaacaagggcagacacagcaacggcagccagttctacatcaccctgcaggccaccccctacctggacagaaagttcgtggccttcggccagctgatcgagggcaccgaggtgctgaagcagctggagctggtgcccacccagaacgagagacccatccacatgtgcagaatcaccgacagcggcgacccctacgcctag

SEQ ID NO: 23087 - DNA, 936 bp, Artificial Sequence
  Description of Artificial Sequence: Synthetic coding sequence
atggccagaccccagccctgcggccccccccacgccagatgcggcagccccagcctgcccgagagacccctgcaggtgaaggtggtgggcctgttcagctgccccaacttccagatcgccaagagcgccgccgagaacctgaagaacaaccaccccagcaagttcgaggaccccatcctggtgcccctgcaggagttcgcctggcaccagtacctgcaggagaagaagagagagctgaagaacgagacctgggagtacagcagcagcgtgatcagcttcgtgaacggccagttcctgggcgacgccctggacctgcagaagtgggcccacgaggtgtgggacatcgtggacatcaagcccagcgccctgtacgacgccctgaccgaggacttcagcgccaagttcctgagagacaccaagcacgacttcgtgttcctggacatctgcatcgacagcagccccatcggcagactgatcttcgagctgtactgcgacgtgtgccccaagacctgcaagaacttccaggtgctgtgcaccggcaaggccggcttcagccagagaggcatcagactgcactacaagaacagcatcttccacagaatcgtgcagaacggctggatccagggcggcgacatcgtgtacggcaagggcgacaacggcgagagcatctacggccccaccttcgaggacgagaacttcagcgtgccccacaacaagagaggcgtgctgggcatggccaacaagggcagacacagcaacggcagccagttctacatcaccctgcaggccaccccctacctggacagaaagttcgtggccttcggccagctgatcgagggcaccgaggtgctgaagcagctggagctggtgcccacccagaacgagagacccatccacatgtgcagaatcaccgacagcggcgacccctacgcctag

SEQ ID NO: 23088 - DNA, 1014 bp, Artificial Sequence
  Description of Artificial Sequence: Synthetic coding sequence
atggccagaccccagccctgcggccccccccacgccagatgcggcagccccagcctgcccgagagacccctgcaggtgaaggtggtgggcctgttcagctgccccaacttccagatcgccaagagcgccgccgagaacctgaagaacaaccaccccagcaagttcgaggaccccatcctggtgcccctgcaggagttcgcctggcaccagtacctgcaggagaagaagagagagctgaagaacgagacctgggagtacagcagcagcgtgatcagcttcgtgaacggccagttcctgggcgacgccctggacctgcagaagtgggcccacgaggtgtgggacatcgtggacatcaagcccagcgccctgtacgacgccctgaccgaggacttcagcgccaagttcctgagagacaccaagcacgacttcgtgttcctggacatctgcatcgacagcagccccatcggcagactgatcttcgagctgtactgcgacgtgtgccccaagacctgcaagaacttccaggtgctgtgcaccggcaaggccggcttcagccagagaggcatcagactgcactacaagaacagcatcttccacagaatcgtgcagaacggctggatccagggcggcgacatcgtgtacggcaagggcgacaacggcgagagcatctacggccccaccttcgaggagctgtacggcagcctgaagagaagcgtgaagagacagaaggagagcagaggcgtgggcaagatcgagaagtacagagacgagaacttcagcgtgccccacaacaagagaggcgtgctgggcatggccaacaagggcagacacagcaacggcagccagttctacatcaccctgcaggccaccccctacctggacagaaagttcgtggccttcggccagctgatcgagggcaccgaggtgctgaagcagctggagctggtgcccacccagaacgagagacccatccacatgtgcagaatcaccgacagcggcgacccctacgcctag

SEQ ID NO: 23089 - DNA, 495 bp, Artificial Sequence
  Description of Artificial Sequence: Synthetic coding sequence
atggtgaacagcgtggtgttcttcgagatcaccagagacggcaagcccctgggcagaatcagcatcaagctgttcgccgacaagatccccaagaccgccgagaacttcagagccctgagcaccggcgagaagggcttcagatacaagggcagctgcttccacagaatcatccccggcttcatgtgccagggcggcgacttcaccagacccaacggcaccggcgacaagagcatctacggcgagaagttcgacgacgagaacctgatcagaaagcacaccggcagcggcatcctgagcatggccaacgccggccccaacaccaacggcagccagttcttcatctgcgccgccaagaccgagtggctggacggcaagcacgtggccttcggcaaggtgaaggagagagtgaacatcgtggaggccaccgagcacttcggctacagaaacagcaagaccagcaagaagatcaccatcgccgactgcggccagttctag

SEQ ID NO: 23090 - DNA, 495 bp, Artificial Sequence; identical to SEQ ID NO: 23089
  Description of Artificial Sequence: Synthetic coding sequence

SEQ ID NO: 23091 - DNA, 423 bp, Artificial Sequence
  Description of Artificial Sequence: Synthetic coding sequence
atgcacagaggcgtgggccccgccttcagagtggtgagaaagatggccgccagcggcgccgagccccaggtgctggtgcagtacctggtgctgagaaaggacctgagccaggcccccttcagctggcccgccggcgccctggtggcccaggcctgccacgccgccaccgccgccctgcacacccacagagaccacccccacaccgccgcctacctgcaggagctgggcagaatgagaaaggtggtgctggaggcccccgacgagaccaccctgaaggagctggccgagaccctgcagcagaagaacatcgaccacatgctgtggctggagcagcccgagaacatcgccacctgcatcgccctgagaccctaccccaaggaggaggtgggccagtacctgaagaagttcagactgttcaagtag

SEQ ID NO: 23092 - DNA, 393 bp, Artificial Sequence
  Description of Artificial Sequence: Synthetic coding sequence
atggccgacggcaaggccggcgacgagaagcccgagaagagccagagagccggcgccgccggcggccccgaggaggaggccgagaagcccgtgaagaccaagaccgtgagcagcagcaacggcggcgagagcagcagcagaagcgccgagaagagaagcgccgaggaggaggccgccgacctgcccaccaagcccaccaagatcagcaagttcggcttcgccatcggcagccagaccaccaagaaggccagcgccatcagcatcaagctgggcagcagcaagcccaaggagaccgtgcccaccctggcccccaagaccctgagcgtggccgccgccttcaacgaggacgaggacggctacaccaacatcagctggaccaagctgctgcagtag

SEQ ID NO: 23093 - DNA, 222 bp, Artificial Sequence; identical to SEQ ID NO: 19062
  Description of Artificial Sequence: Synthetic coding sequence

SEQ ID NO: 23094 - DNA, 2667 bp, Artificial Sequence
  Description of Artificial Sequence: Synthetic coding sequence
atggacagaagcagcaagagaagacaggtgaagcccctggccgccagcctgctggaggccctggactacgacagcagcgacgacagcgacttcaaggtgggcgacgccagcgacagcgagggcagcggcaacggcagcgaggacgccagcaaggacagcggcgagggcagctgcagcgacagcgaggagaacatcctggaggaggagctgaacgaggacatcaaggtgaaggaggagcagctgaagaacagcgccgaggaggaggtgctgagcagcgagaagcagctgatcaagatggagaagaaggaggaggaggagaacggcgagagacccagaaagaagaaggagaaggagaaggagaaggagaaggagaaggagaaggagaaggagagagagaaggagaaggagaaggccaccgtgagcgagaacgtggccgccagcgccgccgccaccacccccgccaccagcccccccgccgtgaacaccagccccagcgtgcccaccaccaccaccgccaccgaggagcaggtgagcgagcccaagaagtggaacctgagaagaaacagacccctgctggacttcgtgagcatggaggagctgaacgacatggacgactacgacagcgaggacgacaacgactggagacccaccgtggtgaagagaaagggcagaagcgccagccagaaggagggcagcgacggcgacaacgaggacgacgaggacgagggcagcggcagcgacgaggacgagaacgacgagggcaacgacgaggaccacagcagccccgccagcgagggcggctgcaagaagaagaagagcaaggtgctgagcagaaacagcgccgacgacgaggagctgaccaacgacagcctgaccctgagccagagcaagagcaacgaggacagcctgatcctggagaagagccagaactggagcagccagaagatggaccacatcctgatctgctgcgtgtgcctgggcgacaacagcgaggacgccgacgagatcatccagtgcgacaactgcggcatcaccgtgcacgagggctgctacggcgtggacggcgagagcgacagcatcatgagcagcgccagcgagaacagcaccgagccctggttctgcgacgcctgcaagtgcggcgtgagccccagctgcgagctgtgccccaaccaggacggcatcttcaaggagaccgacgccggcagatgggtgcacatcgtgtgcgccctgtacgtgcccggcgtggccttcggcgacatcgacaagctgagacccgtgaccctgaccgagatgaactacagcaagtacggcgccaaggagtgcagcttctgcgaggaccccagattcgccagaaccggcgtgtgcatcagctgcgacgccggcatgtgcagagcctacttccacgtgacctgcgcccagaaggagggcctgctgagcgaggccgccgccgaggaggacatcgccgaccccttcttcgcctactgcaagcagcacgccgacagactggacagaaagtggaagagaaagaactacctggccctgcagagctactgcaagatgagcctgcaggagagagagaagcagctgagccccgaggcccaggccagaatcaacgccagactgcagcagtacagagccaaggccgagctggccagaagcaccagaccccaggcctgggtgcccagagagaagctgcccagacccctgaccagcagcgccagcgccatcagaaagctgatgagaaaggccgagctgatgggcatcagcaccgacatcttccccgtggacaacagcgacaccagcagcagcgtggacggcagaagaaagcacaagcagcccgccctgaccgccgacttcgtgaactactacttcgagagaaacatgagaatgatccagatccaggagaacatggccgagcagaagaacatcaaggacaagctggagaacgagcaggagaagctgcacgtggagtacaacaagctgtgcgagagcctggaggagctgcagaacctgaacggcaagctgagaagcgagggccagggcatctgggccctgctgggcagaatcaccggccagaagctgaacatccccgccatcctgagagcccccaaggagagaaagcccagcaagaaggagggcggcacccagaagaccagcaccctgcccgccgtgctgtacagctgcggcatctgcaagaagaaccacgaccagcacctgctgctgctgtgcgacacctgcaagctgcactaccacctgggctgcctggacccccccctgaccagaatgcccagaaagaccaagaacagctactggcagtgcagcgagtgcgaccaggccggcagcagcgacatggaggccgacatggccatggagaccctgcccgacggcaccaagagaagcagaagacagatcaaggagcccgtgaagttcgtgccccaggacgtgccccccgagcccaagaagatccccatcagaaacaccagaaccagaggcagaaagagaagcttcgtgcccgaggaggagaagcacgaggagagagtgcccagagagagaagacagagacagagcgtgctgcagaagaagcccaaggccgaggacctgagaaccgagtgcgccacctgcaagggcaccggcgacaacgagaacctggtgagataccccagctag

SEQ ID NO: 23095 - DNA, 1992 bp, Artificial Sequence
  Description of Artificial Sequence: Synthetic coding sequence
atgatcgtgcagatgaccgtgatcctgaagctggagatgccccaggacagcctgatcctggagaagagccagaactggagcagccagaagatggaccacatcctgatctgctgcgtgtgcctgggcgacaacagcgaggacgccgacgagatcatccagtgcgacaactgcggcatcaccgtgcacgagggctgctacggcgtggacggcgagagcgacagcatcatgagcagcgccagcgagaacagcaccgagccctggttctgcgacgcctgcaagtgcggcgtgagccccagctgcgagctgtgccccaaccaggacggcatcttcaaggagaccgacgccggcagatgggtgcacatcgtgtgcgccctgtacgtgcccggcgtggccttcggcgacatcgacaagctgagacccgtgaccctgaccgagatgaactacagcaagtacggcgccaaggagtgcagcttctgcgaggaccccagattcgccagaaccggcgtgtgcatcagctgcgacgccggcatgtgcagagcctacttccacgtgacctgcgcccagaaggagggcctgctgagcgaggccgccgccgaggaggacatcgccgaccccttcttcgcctactgcaagcagcacgccgacagactggacagaaagtggaagagaaagaactacctggccctgcagagctactgcaagatgagcctgcaggagagagagaagcagctgagccccgaggcccaggccagaatcaacgccagactgcagcagtacagagccaaggccgagctggccagaagcaccagaccccaggcctgggtgcccagagagaagctgcccagacccctgaccagcagcgccagcgccatcagaaagctgatgagaaaggccgagctgatgggcatcagcaccgacatcttccccgtggacaacagcgacaccagcagcagcgtggacggcagaagaaagcacaagcagcccgccctgaccgccgacttcgtgaactactacttcgagagaaacatgagaatgatccagatccaggagaacatggccgagcagaagaacatcaaggacaagctggagaacgagcaggagaagctgcacgtggagtacaacaagctgtgcgagagcctggaggagctgcagaacctgaacggcaagctgagaagcgagggccagggcatctgggccctgctgggcagaatcaccggccagaagctgaacatccccgccatcctgagagcccccaaggagagaaagcccagcaagaaggagggcggcacccagaagaccagcaccctgcccgccgtgctgtacagctgcggcatctgcaagaagaaccacgaccagcacctgctgctgctgtgcgacacctgcaagctgcactaccacctgggctgcctggacccccccctgaccagaatgcccagaaagaccaagaacagctactggcagtgcagcgagtgcgaccaggccggcagcagcgacatggaggccgacatggccatggagaccctgcccgacggcaccaagagaagcagaagacagatcaaggagcccgtgaagttcgtgccccaggacgtgccccccgagcccaagaagatccccatcagaaacaccagaaccagaggcagaaagagaagcttcgtgcccgaggaggagaagcacgaggagagagtgcccagagagagaagacagagacagagcgtgctgcagaagaagcccaaggccgaggacctgagaaccgagtgcgccacctgcaagggcaccggcgacaacgagaacctggtgagatgcgacgagtgcagactgtgctaccacttcggctgcctggacccccccctgaagaagagccccaagcagaccggctacggctggatctgccaggagtgcgacagcagcagcagcaaggaggacgagaacgaggccgagagaaagaacatcagccaggagctgaacatggagcagaagaaccccaagaagtag

SEQ ID NO: 23096 - DNA, 1077 bp, Artificial Sequence
  Description of Artificial Sequence: Synthetic coding sequence
atggccgagagacaggaggagcagagaggcagcccccccctgagagccgagggcaaggccgacgccgaggtgaagctgatcctgtaccactggacccacagcttcagcagccagaaggtgagactggtgatcgccgagaaggccctgaagtgcgaggagcacgacgtgagcctgcccctgagcgagcacaacgagccctggttcatgagactgaacagcaccggcgaggtgcccgtgctgatccacggcgagaacatcatctgcgaggccacccagatcatcgactacctggagcagaccttcctggacgagagaacccccagactgatgcccgacaaggagagcatgtactaccccagagtgcagcactacagagagctgctggacagcctgcccatggacgcctacacccacggctgcatcctgcaccccgagctgaccgtggacagcatgatccccgcctacgccaccaccagaatcagaagccagatcggcaacaccgagagcgagctgaagaagctggccgaggagaaccccgacctgcaggaggcctacatcgccaagcagaagagactgaagagcaagctgctggaccacgacaacgtgaagtacctgaagaagatcctggacgagctggagaaggtgctggaccaggtggagaccgagctgcagagaagaaacgaggagacccccgaggagggccagcagccctggctgtgcggcgagagcttcaccctggccgacgtgagcctggccgtgaccctgcacagactgaagttcctgggcttcgccagaagaaactggggcaacggcaagagacccaacctggagacctactacgagagagtgctgaagagaaagaccttcaacaaggtgctgggccacgtgaacaacatcctgatcagcgccgtgctgcccaccgccttcagagtggccaagaagagagcccccaaggtgctgggcaccaccctggtggtgggcctgctggccggcgtgggctacttcgccttcatgctgttcagaaagagactgggcagcatgatcctggccttcagacccagacccaactacttctag

SEQ ID NO: 23097 - DNA, 1722 bp, Artificial Sequence
  Description of Artificial Sequence: Synthetic coding sequence
atgagcaagaagccccccaacagacccggcatcaccttcgagatcggcgccagactggaggccctggactacctgcagaagtggtaccccagcagaatcgagaagatcgactacgaggagggcaagatgctggtgcacttcgagagatggagccacagatacgacgagtggatctactgggacagcaacagactgagacccctggagagacccgccctgagaaaggagggcctgaaggacgaggaggacttcttcgacttcaaggccggcgaggaggtgctggccagatggaccgactgcagatactaccccgccaagatcgaggccatcaacaaggagggcaccttcaccgtgcagttctacgacggcgtgatcagatgcctgaagagaatgcacatcaaggccatgcccgaggacgccaagggccaggtgaagagccagcaccccctgagctggtgctgccccatcgaccccgccggcagctgcaaccagagcatgggcagcgaggactggatcgccctggtgaaggccgccgccgccgccgccgccaagaacaagaccggcagcaagcccagaaccagcgccaacagcaacaaggacaaggacaaggacgagagaaagtggttcaaggtgcccagcaagaaggaggagaccagcacctgcatcgccacccccgacgtggagaagaaggaggacctgcccaccagcagcgagaccttcggcctgcacgtggagaacgtgcccaagatggtgttcccccagcccgagagcaccctgagcaacaagagaaagaacaaccagggcaacagcttccaggccaagagagccagactgaacaagatcaccggcctgctggccagcaaggccgtgggcgtggacggcgccgagaagaaggaggactacaacgagaccgcccccatgctggagcaggccatcagccccaagccccagagccagaagaagaacgaggccgacatcagcagcagcgccaacacccagaagcccgccctgctgagcagcaccctgagcagcggcaaggccagaagcaagaagtgcaagcacgagagcggcgacagcagcggctgcatcaagccccccaagagccccctgagccccgagctgatccaggtggaggacctgaccctggtgagccagctgagcagcagcgtgatcaacaagaccagccccccccagcccgtgaacccccccagacccttcaagcacagcgagagaagaagaagaagccagagactggccaccctgcccatgcccgacgacagcgtggagaaggtgagcagccccagccccgccaccgacggcaaggtgttcagcatcagcagccagaaccagcaggagagcagcgtgcccgaggtgcccgacgtggcccacctgcccctggagaagctgggcccctgcctgcccctggacctgagcagaggcagcgaggtgaccgcccccgtggccagcgacagcagctacagaaacgagtgccccagagccgagaaggaggacacccagatgctgcccaaccccagcagcaaggccatcgccgacggcagaggcgcccccgccgccgccggcatcagcaagaccgagaagaaggtgaagctggaggacaagagcagcaccgccttcggcatcagaagctgggacttcagcgccctgctgatgaagatccccagctacagccccatcagcctgagcggcctgcccgagagctag

SEQ ID NO: 23098 - DNA, 1332 bp, Artificial Sequence
  Description of Artificial Sequence: Synthetic coding sequence
atgcacatcaaggccatgcccgaggacgccaagggccaggtgaagagccagcaccccctgagctggtgctgccccatcgaccccgccggcagctgcaaccagagcatgggcagcgaggactggatcgccctggtgaaggccgccgccgccgccgccgccaagaacaagaccggcagcaagcccagaaccagcgccaacagcaacaaggacaaggacaaggacgagagaaagtggttcaaggtgcccagcaagaaggaggagaccagcacctgcatcgccacccccgacgtggagaagaaggaggacctgcccaccagcagcgagaccttcggcctgcacgtggagaacgtgcccaagatggtgttcccccagcccgagagcaccctgagcaacaagagaaagaacaaccagggcaacagcttccaggccaagagagccagactgaacaagatcaccggcctgctggccagcaaggccgtgggcgtggacggcgccgagaagaaggaggactacaacgagaccgcccccatgctggagcaggccatcagccccaagccccagagccagaagaagaacgaggccgacatcagcagcagcgccaacacccagaagcccgccctgctgagcagcaccctgagcagcggcaaggccagaagcaagaagtgcaagcacgagagcggcgacagcagcggctgcatcaagccccccaagagccccctgagccccgagctgatccaggtggaggacctgaccctggtgagccagctgagcagcagcgtgatcaacaagaccagccccccccagcccgtgaacccccccagacccttcaagcacagcgagagaagaagaagaagccagagactggccaccctgcccatgcccgacgacagcgtggagaaggtgagcagccccagccccgccaccgacggcaaggtgttcagcatcagcagccagaaccagcaggagagcagcgtgcccgaggtgcccgacgtggcccacctgcccctggagaagctgggcccctgcctgcccctggacctgagcagaggcagcgaggtgaccgcccccgtggccagcgacagcagctacagaaacgagtgccccagagccgagaaggaggacacccagatgctgcccaaccccagcagcaaggccatcgccgacggcagaggcgcccccgccgccgccggcatcagcaagaccgagaagaaggtgaagctggaggacaagagcagcaccgccttcggcatcagaagctgggacttcagcgccctgctgatgaagatccccagctacagccccatcagcctgagcggcctgcccgagagctag

SEQ ID NO: 23099 - DNA, 858 bp, Artificial Sequence
  Description of Artificial Sequence: Synthetic coding sequence
atgagcaagaagccccccaacagacccggcatcaccttcgagatcggcgccagactggaggccctggactacctgcagaagtggtaccccagcagaatcgagaagatcgactacgaggagggcaagatgctggtgcacttcgagagatggagccacagatacgacgagtggatctactgggacagcaacagactgagacccctggagagacccgccctgagaaaggagggcctgaaggacgaggaggacttcttcgacttcaaggccggcgaggaggtgctggccagatggaccgactgcagatactaccccgccaagatcgaggccatcaacaaggagggcaccttcaccgtgcagttctacgacggcgtgatcagatgcctgaagagaatgcacatcaaggccatgcccgaggacgccaagggccaggactggatcgccctggtgaaggccgccgccgccgccgccgccaagaacaagaccggcagcaagcccagaaccagcgccaacagcaacaaggacaaggacaaggacgagagaaagtggttcaaggtgcccagcaagaaggaggagaccagcacctgcatcgccacccccgacgtggagaagaaggaggacctgcccaccagcagcgagaccttcggcctgcacgtggagaacgtgcccaagatggtgttcccccagcccgagagcaccctgagcaacaagagaaagaacaaccagggcaacagcttccaggccaagagagccagactgaacaagatcaccggcctgctggccagcaaggccgtgggcgtggacggcgccgagaagaaggaggactacaacgagaccgcccccatgctggagcaggtgtag

SEQ ID NO: 23100 - DNA, 3054 bp, Artificial Sequence
  Description of Artificial Sequence: Synthetic coding sequence
atgagcaagaagccccccaacagacccggcatcaccttcgagatcggcgccagactggaggccctggactacctgcagaagtggtaccccagcagaatcgagaagatcgactacgaggagggcaagatgctggtgcacttcgagagatggagccacagatacgacgagtggatctactgggacagcaacagactgagacccctggagagacccgccctgagaaaggagggcctgaaggacgaggaggacttcttcgacttcaaggccggcgaggaggtgctggccagatggaccgactgcagatactaccccgccaagatcgaggccatcaacaaggagggcaccttcaccgtgcagttctacgacggcgtgatcagatgcctgaagagaatgcacatcaaggccatgcccgaggacgccaagggccaggtgaagagccagcaccccctgagctggtgctgccccatcgaccccgccggcagctgcaaccagagcatgggcagcgaggactggatcgccctggtgaaggccgccgccgccgccgccgccaagaacaagaccggcagcaagcccagaaccagcgccaacagcaacaaggacaaggacaaggacgagagaaagtggttcaaggtgcccagcaagaaggaggagaccagcacctgcatcgccacccccgacgtggagaagaaggaggacctgcccaccagcagcgagaccttcggcctgcacgtggagaacgtgcccaagatggtgttcccccagcccgagagcaccctgagcaacaagagaaagaacaaccagggcaacagcttccaggccaagagagccagactgaacaagatcaccggcctgctggccagcaaggccgtgggcgtggacggcgccgagaagaaggaggactacaacgagaccgcccccatgctggagcaggccatcagccccaagccccagagccagaagaagaacgaggccgacatcagcagcagcgccaacacccagaagcccgccctgctgagcagcaccctgagcagcggcaaggccagaagcaagaagtgcaagcacgagagcggcgacagcagcggctgcatcaagccccccaagagccccctgagccccgagctgatccaggtggaggacctgaccctggtgagccagctgagcagcagcgtgatcaacaagaccagccccccccagcccgtgaacccccccagacccttcaagcacagcgagagaagaagaagaagccagagactggccaccctgcccatgcccgacgacagcgtggagaaggtgagcagccccagccccgccaccgacggcaaggtgttcagcatcagcagccagaaccagcaggagagcagcgtgcccgaggtgcccgacgtggcccacctgcccctggagaagctgggcccctgcctgcccctggacctgagcagaggcagcgaggtgaccgcccccgtggccagcgacagcagctacagaaacgagtgccccagagccgagaaggaggacacccagatgctgcccaaccccagcagcaaggccatcgccgacggcagaggcgcccccgccgccgccggcatcagcaagaccgagaagaaggtgaagctggaggacaagagcagcaccgccttcggcaagagaaaggagaaggacaaggagagaagagagaagagagacaaggaccactacagacccaagcagaagaagaagaagaagaagaagaagaagagcaagcagcacgactacagcgactacgaggacagcagcctggagttcctggagagatgcagcagccccctgaccagaagcagcggcagcagcctggccagcagaagcatgttcaccgagaagaccaccacctaccagtaccccagagccatcctgagcgtggacctgagcggcgagaacctgagcgacgtggacttcctggacgacagcagcaccgagagcctgctgctgagcggcgacgagtacaaccaggacttcgacagcaccaacttcgaggagagccaggacgaggacgacgccctgaacgagatcgtgagatgcatctgcgagatggacgaggagaacggcttcatgatccagtgcgaggagtgcctgtgctggcagcacagcgtgtgcatgggcctgctggaggagagcatccccgagcagtacatctgctacatctgcagagacccccccggccagagatggagcgccaagtacagatacgacaaggagtggctgaacaacggcagaatgtgcggcctgagcttcttcaaggagaactacagccacctgaacgccaagaagatcgtgagcacccaccacctgctggccgacgtgtacggcgtgaccgaggtgctgcacggcctgcagctgaagatcggcatcctgaagaacaagcaccaccccgacctgcacctgtgggcctgcagcggcaagagaaaggaccaggaccagatcatcgccggcgtggagaagaagatcgcccaggacaccgtgaacagagaggagaagaagtacgtgcagaaccacaaggagccccccagactgcccctgaagatggagggcacctacatcaccagcgagcacagctaccagaagccccagagcttcggccaggactgcaagagcctggccgaccccggcagcagcgacgacgacgacgtgagcagcctggaggaggagcaggagttccacatgagaagcaagaacagcctgcagtacagcgccaaggagcacggcatgcccgagaagaaccccgccgagggcaacaccgtgttcgtgtacaacgacaagaagggcaccgaggaccccggcgacagccacctgcagtggcagctgaacctgctgacccacatcgagaacgtgcagaacgaggtgaccagcagaatggacctgatcgagaaggaggtggacgtgctggagagctggctggacttcaccggcgagctggagccccccgaccccctggccagactgccccagctgaagagacacatcaagcagctgctgatcgacatgggcaaggtgcagcagatcgccaccctgtgcagcgtgtag

SEQ ID NO: 23101 - DNA, 1596 bp, Artificial Sequence
  Description of Artificial Sequence: Synthetic coding sequence
atggagctgcagagcagacccgaggccctggccgtggagctggccagacaccagaacggcgacctgaagaagcagctgcacgagagacagcccagaatcgccgccctgagcgacaagcaggccctgggcaccatcaccgccgtgcccgtgaccggcccccaggtgagcagcctgcagagactggccggccagggcgccgccgtgctgccccaggtgagacccaagaccctgatccccgacagcctgcccgtggcccccggcagagacagaccccccaagcagccccccaccttccagaaggccaccgtggtgagcgtgaagaaccccagccccgccctgcccaccgccaacaacaccgtgagccacgtgcccgcccccggcagccagccccaggccctggccgagcccgccgccctggccagccccctgagcagcgccggcgtggcctacgccatcatcagcaccagccccagcaacgccgccgccatggcccccagcaccgccgtgagcgtggtgagcgacagcatcaaggtgcagcccctgctgatcagcgccgacaacaagcccccccccagactgctgagcagcccccaccccgccacccaccactgccccctgcaccccagcagcctgcccctgaccccccccagccccagcctgagccccagccccctgcacggcatcttccaggtgatcatcatccagccccaggtgcagacccagcccgagagcaccgccgagagcagaccccccaccgaggagcccagccagggcgcccaggccaccaagaagaagaaggaggacagaccccccacccaggagaaccccgagaagatcgccttcatggtggccctgggcctggtgaccaccgagcacctggaggagatccagagcaagagacaggagagaaagagaagaagcaccgccaaccccgcctacagcggcctgctggagaccgagagaaagagactggccagcaactacctgaacaaccccctgttcctgaccgccagagccaacgaggacccctgctggaagaacgagatcacccacgacgagcactgcgccgcctgcaagagaggcgccaacctgcagccctgcggcacctgccccggcgcctaccacctgagctgcctggagccccccctgaagaccgcccccaagggcgtgtgggtgtgccccagatgccagcagaaggccctgaagaaggacgagggcgtgccctggaccggcatgctggccatcgtgcacagctacgtgacccacaagaccgtgaaggaggaggagaagcagaagctgctgcagagaggcagcgagctgcagaacgagcaccagcagctggaggagagagacagaagactggccagcgccgtgcagaagtgcctggagctgaagaccagcctgctggccagacagagaggcacccagagcagcctggacagactgagagccctgctgagactgatccagggcgagcagctgctgcaggtgaccatgaccaccaccagccccgcccccctgctggccggcccctggaccaagcccagcgtggccgccacccaccccaccgtgcagcacccccagggccacaactag

SEQ ID NO: 23102 - DNA, 1470 bp, Artificial Sequence
  Description of Artificial Sequence: Synthetic coding sequence
atggagctgcagagcagacccgaggccctggccgtggagctggccagacaccagaacggcgacctgaagaagcagctgcacgagagacagcccagaatcgccgccctgagcgacaagcaggccctgggcaccatcaccgccgtgcccgtgaccggcccccaggtgagcagcctgcagagactggccggccagggcgccgccgtgctgccccaggtgagacccaagaccctgatccccgacagcctgcccgtggcccccggcagagacagaccccccaagcagccccccaccttccagaaggccaccgtggtgagcgtgaagaaccccagccccgccctgcccaccgccaacaacaccgtgagccacgtgcccgcccccggcagccagccccaggccctggccgagcccgccgccctggccagccccctgagcagcgccggcgtggcctacgccatcatcagcaccagccccagcaacgccgccgccatggcccccagcaccgccgtgagcgtggtgagcgacagcatcaaggtgcagcccctgctgatcagcgccgacaacaaggtgatcatcatccagccccaggtgcagacccagcccgagagcaccgccgagagcagaccccccaccgaggagcccagccagggcgcccaggccaccaagaagaagaaggaggacagaccccccacccaggagaaccccgagaagatcgccttcatggtggccctgggcctggtgaccaccgagcacctggaggagatccagagcaagagacaggagagaaagagaagaagcaccgccaaccccgcctacagcggcctgctggagaccgagagaaagagactggccagcaactacctgaacaaccccctgttcctgaccgccagagccaacgaggacccctgctggaagaacgagatcacccacgacgagcactgcgccgcctgcaagagaggcgccaacctgcagccctgcggcacctgccccggcgcctaccacctgagctgcctggagccccccctgaagaccgcccccaagggcgtgtgggtgtgccccagatgccagcagaaggccctgaagaaggacgagggcgtgccctggaccggcatgctggccatcgtgcacagctacgtgacccacaagaccgtgaaggaggaggagaagcagaagctgctgcagagaggcagcgagctgcagaacgagcaccagcagctggaggagagagacagaagactggccagcgccgtgcagaagtgcctggagctgaagaccagcctgctggccagacagagaggcacccagagcagcctggacagactgagagccctgctgagactgatccagggcgagcagctgctgcaggtgaccatgaccaccaccagccccgcccccctgctggccggcccctggaccaagcccagcgtggccgccacccaccccaccgtgcagcacccccagggccacaactag

SEQ ID NO: 23103 - DNA, 1434 bp, Artificial Sequence
  Description of Artificial Sequence: Synthetic coding sequence
atgagaagacagccccagaacggcgacctgaagaagcagctgcacgagagacagcccagaatcgccgccctgagcgacaagcaggccctgggcaccatcaccgccgtgcccgtgaccggcccccaggtgagcagcctgcagagactggccggccagggcgccgccgtgctgccccaggtgagacccaagaccctgatccccgacagcctgcccgtggcccccggcagagacagaccccccaagcagccccccaccttccagaaggccaccgtggtgagcgtgaagaaccccagccccgccctgcccaccgccaacaacaccgtgagccacgtgcccgcccccggcagccagccccaggccctggccgagcccgccgccctggccagccccctgagcagcgccggcgtggcctacgccatcatcagcaccagccccagcaacgccgccgccatggcccccagcaccgccgtgagcgtggtgagcgacagcatcaaggtgcagcccctgctgatcagcgccgacaacaaggtgatcatcatccagccccaggtgcagacccagcccgagagcaccgccgagagcagaccccccaccgaggagcccagccagggcgcccaggccaccaagaagaagaaggaggacagaccccccacccaggagaaccccgagaagatcgccttcatggtggccctgggcctggtgaccaccgagcacctggaggagatccagagcaagagacaggagagaaagagaagaagcaccgccaaccccgcctacagcggcctgctggagaccgagagaaagagactggccagcaactacctgaacaaccccctgttcctgaccgccagagccaacgaggacccctgctggaagaacgagatcacccacgacgagcactgcgccgcctgcaagagaggcgccaacctgcagccctgcggcacctgccccggcgcctaccacctgagctgcctggagccccccctgaagaccgcccccaagggcgtgtgggtgtgccccagatgccagcagaaggccctgaagaaggacgagggcgtgccctggaccggcatgctggccatcgtgcacagctacgtgacccacaagaccgtgaaggaggaggagaagcagaagctgctgcagagaggcagcgagctgcagaacgagcaccagcagctggaggagagagacagaagactggccagcgccgtgcagaagtgcctggagctgaagaccagcctgctggccagacagagaggcacccagagcagcctggacagactgagagccctgctgagactgatccagggcgagcagctgctgcaggtgaccatgaccaccaccagccccgcccccctgctggccggcccctggaccaagcccagcgtggccgccacccaccccaccgtgcagcacccccagggccacaactag

SEQ ID NO: 23104 - DNA, 873 bp, Artificial Sequence
  Description of Artificial Sequence: Synthetic coding sequence
atgagaagacagccccagaacggcgacctgaagaagcagctgcacgagagacagcccagaatcgccgccctgagcgacaagcaggccctgggcaccatcaccgccgtgcccgtgaccggcccccaggtgagcagcctgcagagactggccggccagggcgccgccgtgctgccccaggtgagacccaagaccctgatccccgacagcctgcccgtggcccccggcagagacagaccccccaagcagccccccaccttccagaaggccaccgtggtgagcgtgaagaaccccagccccgccctgcccaccgccaacaacaccgtgagccacgtgcccgcccccggcagccagccccaggccctggccgagcccgccgccctggccagccccctgagcagcgccggcgtggcctacgccatcatcagcaccagccccagcaacgccgccgccatggcccccagcaccgccgtgagcgtggtgagcgacagcatcaaggtgcagcccctgctgatcagcgccgacaacaaggtgatcatcatccagccccaggtgcagacccagcccgagagcaccgccgagagcagaccccccaccgaggagcccagccagggcgcccaggccaccaagaagaagaaggaggacagaccccccacccaggagaaccccgagaagatcgccttcatggtggccctgggcctggtgaccaccgagcacctggaggagatccagagcaagagacaggagagaaagagaagaagcaccgccaaccccgcctacagcggcctgctggagaccgagagaaagagactggccagcaactacctgaacaaccccctgttcctgaccgccagagagagagaccaccccagatag

SEQ ID NO: 23105 - DNA, 1743 bp, Artificial Sequence
  Description of Artificial Sequence: Synthetic coding sequence
atggactaccccaagatggactacttcctggacgtggagagcgcccacagactgctggacgtggagagcgcccagagattcttctacagccagggcgcccaggccagaagagccaccctgctgctgccccccaccctgatggccgccagcagcgaggacgacatcgacagaagacccatcagaagagtgagaagcaagagcgacaccccctacctggccgaggccagaatcagcttcaacctgggcgccgccgaggaggtggagagactggccgccatgagaagcgacagcctggtgcccggcacccacaccccccccatcagaagaagaagcaagttcgccaacctgggcagaatcttcaagccctggaagtggagaaagaagaagagcgagaagttcaagcacaccagcgccgccctggagagaaagatcagcatgagacagagcagagaggagctgatcaagagaggcgtgctgaaggagatctacgacaaggacggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgaccccggcgcccccgtgaagctgccctgcctgcccgtgaagctgagcccccccctgccccccaagaaggtgatgatctgcatgcccgtgggcggccccgacctgagcctggtgagctacaccgcccagaagagcggccagcagggcgtggcccagcaccaccacaccgtgctgcccagccagatccagcaccagctgcagtacggcagccacggccagcacctgcccagcaccaccggcagcctgcccatgcaccccagcggctgcagaatgatcgacgagctgaacaagaccctggccatgaccatgcagagactggagagcagcgagcagagagtgccctgcagcaccagctaccacagcagcggcctgcacagcggcgacggcgtgaccaaggccggccccatgggcctgcccgagatcagacaggtgcccaccgtggtgatcgagtgcgacgacaacaaggagaacgtgccccacgagagcgactacgaggacagcagctgcctgtacaccagagaggaggaggaggaggaggaggacgaggacgacgacagcagcctgtacaccagcagcctggccatgaaggtgtgcagaaaggacagcctggccatcaagctgagcaacagacccagcaagagagagctggaggagaagaacatcctgcccagacagaccgacgaggagagactggagctgagacagcagatcggcaccaagctgaccagaagactgagccagagacccaccgccgaggagctggagcagagaaacatcctgaagcccagaaacgagcaggaggagcaggaggagaagagagagatcaagagaagactgaccagaaagctgagccagagacccaccgtggaggagctgagagagagaaagatcctgatcagattcagcgactacgtggaggtggccgacgcccaggactacgacagaagagccgacaagccctggaccagactgaccgccgccgacaaggccgccatcagaaaggagctgaacgagttcaagagcaccgagatggaggtgcacgagctgagcagacacctgaccagcttcagattcccctag

SEQ ID NO: 23106 - DNA, 423 bp, Artificial Sequence
  Description of Artificial Sequence: Synthetic coding sequence
atgtacctgcagggccccagaaagctgatgacccagggcggctacgacatggtgcagaagctgttcctggacttcttcagaagaagactgagccagagacccaccgccgaggagctggagcagagaaacatcctgaagcccagaaacgagcaggaggagcaggaggagaagagagagatcaagagaagactgaccagaaagctgagccagagacccaccgtggaggagctgagagagagaaagatcctgatcagattcagcgactacgtggaggtggccgacgcccaggactacgacagaagagccgacaagccctggaccagactgaccgccgccgacaaggtgagcagaggcgagtgctggagagtgggcggcagaaccgtgtgctgggtgagcctgggcagccccctgggcagcgtgtag

SEQ ID NO: 23107 - DNA, 435 bp, Artificial Sequence
  Description of Artificial Sequence: Synthetic coding sequence
atgtacctgcagggccccagaaagctgatgacccagggcggctacgacatggtgcagaagctgttcctggacttcttcagaagaagactgagccagagacccaccgccgaggagctggagcagagaaacatcctgaagcccagaaacgagcaggaggagcaggaggagaagagagagatcaagagaagactgaccagaaagctgagccagagacccaccgtggaggagctgagagagagaaagatcctgatcagattcagcgactacgtggaggtggccgacgcccaggactacgacagaagagccgacaagccctggaccagactgaccgccgccgacaaggccgccatcagaaaggagctgaacgagttcaagagcaccgagatggaggtgcacgagctgagcagacacctgaccagattccacagaccctag

SEQ ID NO: 23108 - DNA, 600 bp, Artificial Sequence
  Description of Artificial Sequence: Synthetic coding sequence
atgagacagagcagagaggagctgatcaagagaggcgtgctgaaggagatctacgacaaggacggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgtgagcgaggagagccccagcgccagcgagagcggcgtgctgctgagccaggaccccagcgccaagcccgtgctgctgctgccccccaagaagcccgccgccttccccggcgaccacgaggagacccccgtgaagcagctgcccctgctgaagcagccccccgccctgccccccaagcccaccaccagaatcgccaaccacctgaccgactggcaccaggcccaccaggtgggccagagacaccccctgcccccctggcagtgggccttcagcagccccggcagcagcaagagaatccagagcagacccggcgccgtggcctacgcctgcaaccccagcaccctgggcggcagaggcagatggatcacctag

SEQ ID NO: 23109 - DNA, 510 bp, Artificial Sequence
  Description of Artificial Sequence: Synthetic coding sequence
atggactaccccaagatggactacttcctggacgtggagagcgcccacagactgctggacgtggagagcgcccagagattcttctacagccagggcgcccaggccagaagagccaccctgctgctgccccccaccctgatggccgccagcagcgaggacgacatcgacagaagacccatcagaagagtgagaagcaagagcgacaccccctacctggccgaggccagaatcagcttcaacctgggcgccggcgtgagcctgttcggcgacatggacgaggccagaatgggccccgccgtgcccaccctgggcagacccctgggcctggagctgtgcagcctggagaaccacggcctgctgaagaccgcccccacctacaccaccagcgcccacatctgcagcggccccagcaccggcggccagttcagcacccagggcatgagccccgtgcagggcgccaagagaagaagagtggtgtggctgcccctggagggcgaggagttcggctag

SEQ ID NO: 23110 - DNA, 1455 bp, Artificial Sequence
  Description of Artificial Sequence: Synthetic coding sequence
atggactaccccaagatggactacttcctggacgtggagagcgcccacagactgctggacgtggagagcgcccagagattcttctacagccagggcgcccaggccagaagagccaccctgctgctgccccccaccctgatggccgccagcagcgaggacgacatcgacagaagacccatcagaagagtgagaagcaagagcgacaccccctacctggccgaggccagaatcagcttcaacctgggcgccgccgaggaggtggagagactggccgccatgagaagcgacagcctggtgcccggcacccacaccccccccatcagaagaagaagcaagttcgccaacctgggcagaatcttcaagccctggaagtggagaaagaagaagagcgagaagttcaagcacaccagcgccgccctggagagaaagatcagcatgagacagagcagagaggagctgatcaagagaggcgtgctgaaggagatctacgacaaggacggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgaccccggcgcccccgtgaagctgccctgcctgcccgtgaagctgagcccccccctgccccccaagaaggtgatgatctgcatgcccgtgggcggccccgacctgagcctggtgagctacaccgcccagaagagcggccagcagggcgtggcccagcaccaccacaccgtgctgcccagccagatccagcaccagctgcagtacggcagccacggccagcacctgcccagcaccaccggcagcctgcccatgcaccccagcggctgcagaatgatcgacgagctgaacaagaccctggccatgaccatgcagagactggagagcagcgagcagagagtgccctgcagcaccagctaccacagcagcggcctgcacagcggcgacggcgtgaccaaggccggccccatgggcctgcccgagatcagacaggtgcccaccgtggtgatcgagtgcgacgacaacaaggagaacgtgccccacgagagcgactacgaggacagcagctgcctgtacaccagagaggaggaggaggaggaggaggacgaggacgacgacagcagcctgtacaccagcagcctggccatgaaggtgtgcagaaaggacagcctggccatcaagctgagcaacagacccagcaagagagagctggaggagaagaacatcctgcccagacagaccgacgaggagagactggagctgagacagcagatcggcaccaagctgaccagaagactgagccagagacccaccgccgaggagctggagcagagaaacatcctgaagagaaagtag

SEQ ID NO: 23111 - DNA, 798 bp, Artificial Sequence
  Description of Artificial Sequence: Synthetic coding sequence
tgaagccccttcacccccttcagccccctgctgagcttcttcctgagccccttcttcttcctgttccccagcctgagccacagcctgcccacccccagcctgcccctgcccagccccttccccagccccagccccgtgagagagcccctgcccctgcccagcagccccttcagactgagccccagccccagcgtgagcttcagcctgagcgccagaagagccaccctgctgctgccccccaccctgatggccgccagcagcgaggacgacatcgacagaagacccatcagaagagtgagaagcaagagcgacaccccctacctggccgaggccagaatcagcttcaacctgggcgccgccgaggaggtggagagactggccgccatgagaagcgacagcctggtgcccggcacccacaccccccccatcagaagaagaagcaagttcgccaacctgggcagaatcttcaagccctggaagtggagaaagaagaagagcgagaagttcaagcacaccagcgccgccctggagagaaagatcagcatgagacagagcagagaggagctgatcaagagaggcgtgctgaaggagatctacgacaaggacggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgtgagcgaggagagccccagcgcctag

SEQ ID NO: 23112 - DNA, 1248 bp, Artificial Sequence
  Description of Artificial Sequence: Synthetic coding sequence
tgaggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgaccccggcgcccccgtgaagctgccctgcctgcccgtgaagctgagcccccccctgccccccaagaaggtgatgatctgcatgcccgtgggcggccccgacctgagcctggtgagctacaccgcccagaagagcggccagcagggcgtggcccagcaccaccacaccgtgctgcccagccagatccagcaccagctgcagtacggcagccacggccagcacctgcccagcaccaccggcagcctgcccatgcaccccagcggctgcagaatgatcgacgagctgaacaagaccctggccatgaccatgcagagactggagagcagcgagcagagagtgccctgcagcaccagctaccacagcagcggcctgcacagcggcgacggcgtgaccaaggccggccccatgggcctgcccgagatcagacaggtgcccaccgtggtgatcgagtgcgacgacaacaaggagaacgtgccccacgagagcgactacgaggacagcagctgcctgtacaccagagaggaggaggaggaggaggaggacgaggacgacgacagcagcctgtacaccagcagcctggccatgaaggtgtgcagaaaggacagcctggccatcaagctgagcaacagacccagcaagagagagctggaggagaagaacatcctgcccagacagaccgacgaggagagactggagctgagacagcagatcggcaccaagctgaccagaagactgagccagagacccaccgccgaggagctggagcagagaaacatcctgaagcccagaaacgagcaggaggagcaggaggagaagagagagatcaagagaagactgaccagaaagctgagccagagacccaccgtggaggagctgagagagagaaagatcctgatcagattcagcgactacgtggaggtggccgacgcccaggactacgacagaagagccgacaagccctggaccagactgaccgccgccgacaaggccgccatcagaaaggagctgaacgagttcaagagcaccgagatggaggtgcacgagctgagcagacacctgaccagattccacagaccctag

SEQ ID NO: 23113 - DNA, 1644 bp, Artificial Sequence
  Description of Artificial Sequence: Synthetic coding sequence
atggactaccccaagatggactacttcctggacgtggagagcgcccacagactgctggacgtggagagcgcccagagattcttctacagccagggcgcccaggccagaagagccaccctgctgctgccccccaccctgatggccgccagcagcgaggacgacatcgacagaagacccatcagaagagtgagaagcaagagcgacaccccctacctggccgaggccagaatcagcttcaacctgggcgccgccgaggaggtggagagactggccgccatgagaagcgacagcctggtgcccggcacccacaccccccccatcagaagaagaagcaagttcgccaacctgggcagaatcttcaagccctggaagtggagaaagaagaagagcgagaagttcaagcacaccagcgccgccctggagagaaagatcagcatgagacagagcagagaggagctgatcaagagaggcgtgctgaaggagatctacgacaaggacggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgtgagcgaggagagccccagcgccagcgagagcggcgtgctgctgagccaggaccccagcgccaagcccgtgctgctgctgccccccaagaagcccgccgccttccccggcgaccacgaggagacccccgtgaagcagctgcccctgctgaagcagccccccgccctgccccccaagcccaccaccagaatcgccaaccacctgaccgaccccggcgcccccgtgaagctgccctgcctgcccgtgaagctgagcccccccctgccccccaagaaggtgatgatctgcatgcccgtgggcggccccgacctgagcctggtgagctacaccgcccagaagagcggccagcagggcgtggcccagcaccaccacaccgtgctgcccagccagatccagcaccagctgcagtacggcagccacggccagcacctgcccagcaccaccggcagcctgcccatgcaccccagcggctgcagaatgatcgacgagctgaacaagaccctggccatgaccatgcagagactggagagcagcgagcagagagtgccctgcagcaccagctaccacagcagcggcctgcacagcggcgacggcgtgaccaaggccggccccatgggcctgcccgagatcagacaggtgcccaccgtggtgatcgagtgcgacgacaacaaggagaacgtgccccacgagagcgactacgaggacagcagctgcctgtacaccagagaggaggaggaggaggaggaggacgaggacgacgacagcagcctgtacaccagcagcctggccatgaaggtgtgcagaaaggacagcctggccatcaagctgagcaacagacccagcaagagagagctggaggagaagaacatcctgcccagacagaccgacgaggagagactggagctgagacagcagatcggcaccaagctgaccagaaacaagttcagaagagacttcggcagacagctggagggcaagtag

SEQ ID NO: 23114 - DNA, 693 bp, Artificial Sequence
  Description of Artificial Sequence: Synthetic coding sequence
aacctgggcagaatcttcaagccctggaagtggagaaagaagaagagcgagaagttcaagcacaccagcgccgccctggagagaaagatcagcatgagacagagcagagaggagctgatcaagagaggcgtgctgaaggagatctacgacaaggacggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgtgagcgaggagagccccagcgccagcgagagcggcgtgctgctgagccaggaccccagcgccaagcccgtgctgctgctgccccccaagaagcccgccgccttccccggcgaccacgaggagacccccgtgaagcagctgcccctgctgaagcagccccccgccctgccccccaagcccaccaccagaatcgccaaccacctgaccgactggcaccaggcccaccaggtgggccagagacaccccctgcccccctggcagtgggccttcagcagccccggcagcagcaagagaatccagagcagacccggcgccgtggcctacgcctgcaaccccagcaccctgggcggcagaggcagatggatcacctag

SEQ ID NO: 23115 - DNA, 1308 bp, Artificial Sequence
  Description of Artificial Sequence: Synthetic coding sequence
atgagacagagcagagaggagctgatcaagagaggcgtgctgaaggagatctacgacaaggacggcgagctgagcatcagcaacgaggaggacagcctggagaacggccagagcctgagcagcagccagctgagcctgcccgccctgagcgagatggagcccgtgcccatgcccagagacccctgcagctacgaggtgctgcagcccagcgacatcatggacggccccgaccccggcgcccccgtgaagctgccctgcctgcccgtgaagctgagcccccccctgccccccaagaaggtgatgatctgcatgcccgtgggcggccccgacctgagcctggtgagctacaccgcccagaagagcggccagcagggcgtggcccagcaccaccacaccgtgctgcccagccagatccagcaccagctgcagtacggcagccacggccagcacctgcccagcaccaccggcagcctgcccatgcaccccagcggctgcagaatgatcgacgagctgaacaagaccctggccatgaccatgcagagactggagagcagcgagcagagagtgccctgcagcaccagctaccacagcagcggcctgcacagcggcgacggcgtgaccaaggccggccccatgggcctgcccgagatcagacaggtgcccaccgtggtgatcgagtgcgacgacaacaaggagaacgtgccccacgagagcgactacgaggacagcagctgcctgtacaccagagaggaggaggaggaggaggaggacgaggacgacgacagcagcctgtacaccagcagcctggccatgaaggtgtgcagaaaggacagcctggccatcaagctgagcaacagacccagcaagagagagctggaggagaagaacatcctgcccagacagaccgacgaggagagactggagctgagacagcagatcggcaccaagctgaccagaagactgagccagagacccaccgccgaggagctggagcagagaaacatcctgaagcccagaaacgagcaggaggagcaggaggagaagagagagatcaagagaagactgaccagaaagctgagccagagacccaccgtggaggagctgagagagagaaagatcctgatcagattcagcgactacgtggaggtggccgacgcccaggactacgacagaagagccgacaagccctggaccagactgaccgccgccgacaaggccgccatcagaaaggagctgaacgagttcaagagcaccgagatggaggtgcacgagctgagcagacacctgaccagcttcagattcccctag

SEQ ID NO: 23116 - DNA, 1665 bp, Artificial Sequence
  Description of Artificial Sequence: Synthetic coding sequence
atggacaacgccgtggacggcctggacaaggccagcatcgccaacagcgacggccccaccgccggcagccagaccccccccttcaagagaaagggcaagctgagcaccatcggcaagatcttcaagccctggaagtggagaaagaagaagaccagcgacaagttcagagagaccagcgccgtgctggagagaaagatcagcaccagacagagcagagaggagctgatcagaagaggcgtgctgaaggagctgcccgaccaggacggcgacgtgaccgtgaacttcgagaacagcaacggccacatgatccccatcggcgaggagagcaccagagaggagaacgtggtgaagagcgaggagggcaacggcagcgtgagcgagaagaccccccccctggaggagcaggccgaggacaagaaggccggcagcagccacagcaagaagaccaccggcagcaaggccagcgccagccccagcaccagcagcaccagcagcagacccaaggccagcaaggagaccgtgagcagcaaggccggcaccgtgggcaccaccaagggcaagagaaagaccgacaagcagcccatcaccagccacctgagcagcgacaccaccaccagcggcaccagcgacctgaagggcgagcccgccgagaccagagtggagagcttcaagctggagcagaccgtgcccggcgccgaggagcagaacaccggcaagttcaagagcatggtgccccccccccccgtggcccccgcccccagccccctggccccccccctgcccctggaggaccagtgcatcaccgccagcgacacccccgtggtgctggtgagcgtgggcgccgacctgcccgtgagcgccctggaccccagccagctgctgtgggccgaggagcccaccaacagaaccaccctgtacagcggcaccggcctgagcgtgaacagagagaacgccaagtgcttcaccaccaaggaggagctgggcaagaccgtgccccagctgctgacccccggcctgatgggcgagagcagcgagagcttcagcgccagcgaggacgagggccacagagagtaccaggccaacgacagcgacagcgacggccccatcctgtacaccgacgacgaggacgaggacgaggacgaggacggcagcggcgagagcgccctggccagcaagatcagaagaagagacaccctggccatcaagctgggcaacagacccagcaagaaggagctggaggacaagaacatcctgcagagaaccagcgaggaggagagacaggagatcagacagcagatcggcaccaagctggtgagaagactgagccagagacccaccaccgaggagctggagcagagaaacatcctgaagcagaagaacgaggaggaggagcaggaggccaagatggagctgaagagaagactgagcagaaagctgagcctgagacccaccgtggccgagctgcaggccagaagaatcctgagattcaacgagtacgtggaggtgaccgacagccccgactacgacagaagagccgacaagccctgggccagactgacccccgccgacaaggccgccatcagaaaggagctgaacgagttcaagagcaccgagatggaggtgcacgaggagagcagacagttcaccagattccacagaccctag

SEQ ID NO: 23117 - DNA, 1698 bp, Artificial Sequence
  Description of Artificial Sequence: Synthetic coding sequence
atgggccagaccagcgtgagcaccctgagcccccagcccggcagcgtggacggcctggacaaggccagcatcgccaacagcgacggccccaccgccggcagccagaccccccccttcaagagaaagggcaagctgagcaccatcggcaagatcttcaagccctggaagtggagaaagaagaagaccagcgacaagttcagagagaccagcgccgtgctggagagaaagatcagcaccagacagagcagagaggagctgatcagaagaggcgtgctgaaggagctgcccgaccaggacggcgacgtgaccgtgaacttcgagaacagcaacggccacatgatccccatcggcgaggagagcaccagagaggagaacgtggtgaagagcgaggagggcaacggcagcgtgagcgagaagaccccccccctggaggagcaggccgaggacaagaaggccggcagcagccacagcaagaagaccaccggcagcaaggccagcgccagccccagcaccagcagcaccagcagcagacccaaggccagcaaggagaccgtgagcagcaaggccggcaccgtgggcaccaccaagggcaagagaaagaccgacaagcagcccatcaccagccacctgagcagcgacaccaccaccagcggcaccagcgacctgaagggcgagcccgccgagaccagagtggagagcttcaagctggagcagaccgtgcccggcgccgaggagcagaacaccggcaagttcaagagcatggtgccccccccccccgtggcccccgcccccagccccctggccccccccctgcccctggaggaccagtgcatcaccgccagcgacacccccgtggtgctggtgagcgtgggcgccgacctgcccgtgagcgccctggaccccagccagctgctgtgggccgaggagcccaccaacagaaccaccctgtacagcggcaccggcctgagcgtgaacagagagaacgccaagtgcttcaccaccaaggaggagctgggcaagaccgtgccccagctgctgacccccggcctgatgggcgagagcagcgagagcttcagcgccagcgaggacgagggccacagagagtaccaggccaacgacagcgacagcgacggccccatcctgtacaccgacgacgaggacgaggacgaggacgaggacggcagcggcgagagcgccctggccagcaagatcagaagaagagacaccctggccatcaagctgggcaacagacccagcaagaaggagctggaggacaagaacatcctgcagagaaccagcgaggaggagagacaggagatcagacagcagatcggcaccaagctggtgagaagactgagccagagacccaccaccgaggagctggagcagagaaacatcctgaagcagaagaacgaggaggaggagcaggaggccaagatggagctgaagagaagactgagcagaaagctgagcctgagacccaccgtggccgagctgcaggccagaagaatcctgagattcaacgagtacgtggaggtgaccgacagccccgactacgacagaagagccgacaagccctgggccagactgacccccgccgacaaggccgccatcagaaaggagctgaacgagttcaagagcaccgagatggaggtgcacgaggagagcagacagttcaccagattccacagaccctag

SEQ ID NO: 23118 - DNA, 537 bp, Artificial Sequence
  Description of Artificial Sequence: Synthetic coding sequence
atgggccagaccagcgtgagcaccctgagcccccagcccggcagcgtggacggcctggacaaggccagcatcgccaacagcgacggccccaccgccggcagccagaccccccccttcaagagaaagggcaagctgagcaccatcggcaagatcttcaagccctggaagtggagaaagaagaagaccagcgacaagttcagagagaccagcgccgtgctggagagaaagatcagcaccagacagagcagagaggagctgatcagaagaggcgtgctgaaggagctgcccgaccaggccggcagcagccacagcaagaagaccaccggcagcaaggccagcgccagccccagcaccagcagcaccagcagcagacccaaggccagcaaggagaccgtgagcagcaaggccggcaccgtgggcaccaccaagggcaagagaaagaccgacaagcagcccatcaccagccacctgagcagcgacaccaccaccagcggcaccagcgacctgaagggcgagcccgccgagaccagagtgtag

SEQ ID NO: 23119 - DNA, 1905 bp, Artificial Sequence
  Description of Artificial Sequence: Synthetic coding sequence
atggacaacgccgtggacggcctggacaaggccagcatcgccaacagcgacggccccaccgccggcagccagaccccccccttcaagagaaagggcaagctgagcaccatcggcaagatcttcaagccctggaagtggagaaagaagaagaccagcgacaagttcagagagaccagcgccgtgctggagagaaagatcagcaccagacagagcagagaggagctgatcagaagaggcgtgctgaaggagctgcccgaccaggacggcgacgtgaccgtgaacttcgagaacagcaacggccacatgatccccatcggcgaggagagcaccagagaggagaacgtggtgaagagcgaggagggcaacggcagcgtgagcgagaagaccccccccctggaggagcaggccgaggacaagaaggagaacaccgagaaccacagcgagacccccgccgcccccgccctgccccccagcgccccccccaagcccagacccaagcccaagcccaagaagagccccgtgccccccaagggcgccaccgccggcgccagccacaagggcgacgaggtgccccccatcaagaagaacaccaaggcccccggcaagcaggcccccgtgcccccccccaagcccgccagcagaaacaccaccagagaggccgccggcagcagccacagcaagaagaccaccggcagcaaggccagcgccagccccagcaccagcagcaccagcagcagacccaaggccagcaaggagaccgtgagcagcaaggccggcaccgtgggcaccaccaagggcaagagaaagaccgacaagcagcccatcaccagccacctgagcagcgacaccaccaccagcggcaccagcgacctgaagggcgagcccgccgagaccagagtggagagcttcaagctggagcagaccgtgcccggcgccgaggagcagaacaccggcaagttcaagagcatggtgccccccccccccgtggcccccgcccccagccccctggccccccccctgcccctggaggaccagtgcatcaccgccagcgacacccccgtggtgctggtgagcgtgggcgccgacctgcccgtgagcgccctggaccccagccagctgctgtgggccgaggagcccaccaacagaaccaccctgtacagcggcaccggcctgagcgtgaacagagagaacgccaagtgcttcaccaccaaggaggagctgggcaagaccgtgccccagctgctgacccccggcctgatgggcgagagcagcgagagcttcagcgccagcgaggacgagggccacagagagtaccaggccaacgacagcgacagcgacggccccatcctgtacaccgacgacgaggacgaggacgaggacgaggacggcagcggcgagagcgccctggccagcaagatcagaagaagagacaccctggccatcaagctgggcaacagacccagcaagaaggagctggaggacaagaacatcctgcagagaaccagcgaggaggagagacaggagatcagacagcagatcggcaccaagctggtgagaagactgagccagagacccaccaccgaggagctggagcagagaaacatcctgaagcagaagaacgaggaggaggagcaggaggccaagatggagctgaagagaagactgagcagaaagctgagcctgagacccaccgtggccgagctgcaggccagaagaatcctgagattcaacgagtacgtggaggtgaccgacagccccgactacgacagaagagccgacaagccctgggccagactgacccccgccgacaaggccgccatcagaaaggagctgaacgagttcaagagcaccgagatggaggtgcacgaggagagcagacagttcaccagattccacagaccctag

SEQ ID NO: 23120 - DNA, 1938 bp, Artificial Sequence
  Description of Artificial Sequence: Synthetic coding sequence
atgggccagaccagcgtgagcaccctgagcccccagcccggcagcgtggacggcctggacaaggccagcatcgccaacagcgacggccccaccgccggcagccagaccccccccttcaagagaaagggcaagctgagcaccatcggcaagatcttcaagccctggaagtggagaaagaagaagaccagcgacaagttcagagagaccagcgccgtgctggagagaaagatcagcaccagacagagcagagaggagctgatcagaagaggcgtgctgaaggagctgcccgaccaggacggcgacgtgaccgtgaacttcgagaacagcaacggccacatgatccccatcggcgaggagagcaccagagaggagaacgtggtgaagagcgaggagggcaacggcagcgtgagcgagaagaccccccccctggaggagcaggccgaggacaagaaggagaacaccgagaaccacagcgagacccccgccgcccccgccctgccccccagcgccccccccaagcccagacccaagcccaagcccaagaagagccccgtgccccccaagggcgccaccgccggcgccagccacaagggcgacgaggtgccccccatcaagaagaacaccaaggcccccggcaagcaggcccccgtgcccccccccaagcccgccagcagaaacaccaccagagaggccgccggcagcagccacagcaagaagaccaccggcagcaaggccagcgccagccccagcaccagcagcaccagcagcagacccaaggccagcaaggagaccgtgagcagcaaggccggcaccgtgggcaccaccaagggcaagagaaagaccgacaagcagcccatcaccagccacctgagcagcgacaccaccaccagcggcaccagcgacctgaagggcgagcccgccgagaccagagtggagagcttcaagctggagcagaccgtgcccggcgccgaggagcagaacaccggcaagttcaagagcatggtgccccccccccccgtggcccccgcccccagccccctggccccccccctgcccctggaggaccagtgcatcaccgccagcgacacccccgtggtgctggtgagcgtgggcgccgacctgcccgtgagcgccctggaccccagccagctgctgtgggccgaggagcccaccaacagaaccaccctgtacagcggcaccggcctgagcgtgaacagagagaacgccaagtgcttcaccaccaaggaggagctgggcaagaccgtgccccagctgctgacccccggcctgatgggcgagagcagcgagagcttcagcgccagcgaggacgagggccacagagagtaccaggccaacgacagcgacagcgacggccccatcctgtacaccgacgacgaggacgaggacgaggacgaggacggcagcggcgagagcgccctggccagcaagatcagaagaagagacaccctggccatcaagctgggcaacagacccagcaagaaggagctggaggacaagaacatcctgcagagaaccagcgaggaggagagacaggagatcagacagcagatcggcaccaagctggtgagaagactgagccagagacccaccaccgaggagctggagcagagaaacatcctgaagcagaagaacgaggaggaggagcaggaggccaagatggagctgaagagaagactgagcagaaagctgagcctgagacccaccgtggccgagctgcaggccagaagaatcctgagattcaacgagtacgtggaggtgaccgacagccccgactacgacagaagagccgacaagccctgggccagactgacccccgccgacaaggccgccatcagaaaggagctgaacgagttcaagagcaccgagatggaggtgcacgaggagagcagacagttcaccagattccacagaccctag

SEQ ID NO: 23121 - DNA, 2139 bp, Artificial Sequence
  Description of Artificial Sequence: Synthetic coding sequence
atgggccaggccgacgtgagcagacccgtgaaccccgacgccgtggaggaggccgaccagcccaccaccgagcccggcatggtgctggacagcgtggaggccggcgacaccaccccccccaccaagagaaagagcaagttcagcggcttcggcaagatcttcaagccctggaagtggagaaagaagaagagcagcgacaagttcaaggagaccagcgaggtgctggagagaaagatcagcatgagaaagcccagagaggagctggtgaagagaggcgtgctgctggaggaccccgagcagggcggcgaggaccccggcaagcccagcgacgccatgctgaagaacggccacaccacccccatcggcaacgccagaagcagcagccccgtgcaggtggaggaggagcccgtgagactggccagcctgagaaaggccatccccgaggaggacctgaagaagagactgggcagcaccggcagccagcccaacagcgaggccgagagcgtgcccgagaacgtgcccaagccccccctgctgccccccaagagacccctgagcagcagccacgaggccagcgagggccaggccaaggacgccaccagcagcggcggcaccgccagattcatcatcagcaccagcatcaccaccgcccccgccgccaccaccgccgccaccagcctggccaagaccgtgaacctgagcgtgacccccagccccgcccccagaaccctgcccgccgcccccgccagcaccaacaccaccgccacccccagcctgacccacatggtgcccgccaagcagccccccatccccccccccaagcccgcccacagaaacagcaaccccgtgatcgccgagctgagccaggccatcaacagcggcaccctgctgagcaagcccagcccccccctgccccccaagagaggcatccccagcaccagcgtgcccaccctggagagcgccgccgccatcaccaccaagacccccagcgacgagagagagaagagcacctgcagcatgggcagcgagctgctgcccatgatcagccccagaagccccagcccccccctgcccacccacatcccccccgagccccccagaaccccccccttccccgccaagaccttccaggtggtgcccgagatcgagttcccccccagcctggacctgcaccaggagatcccccagcaggaggaccagaagaaggaggtgcccaagagaatcctggaccagaacttcggcgagccccacatccccagcagactgccccccctgcccctgcacatcagaatccagcaggccctgaccagccccctgcccatgacccccatcctggagggcagccacagagcccacagcctgctgttcgagaacagcgacagcttcagcgaggacagcagcaccctgggcagaaccagaagcctgcccatcaccatcgagatgctgaaggtgcccgacgacgaggaggaggaggagcagacctgccccagcaccttcagcgaggagatgacccccaccagcgtgatccccaagctgccccagtgcctgagagaggaggaggagaaggagagcgacagcgacagcgagggccccatccagtacagagacgaggaggacgaggacgagagctaccagagcgccctggccaacaaggtgaagagaaaggacaccctggccatgaagctgaaccacagacccagcgagcccgagctgaacctgaacagctggccctgcaagagcaaggaggagtggaacgagatcagacaccagatcggcaacaccctgatcagaagactgagccagagacccacccccgaggagctggagcagagaaacatcctgcagcccaagaacgaggccgacagacaggccgagaagagagagatcaagagaagactgaccagaaagctgagccagagacccaccgtggccgagctgctggccagaaagatcctgagattcaacgagtacgtggaggtgaccgacgcccaggactacgacagaagagccgacaagccctggaccaagctgacccccgccgacaaggccgccatcagaaaggagctgaacgagttcaagagcagcgagatggaggtgcacgaggagagcaagcacttcaccagataccacagaccctag
